United States Patent 8,067,671 (METHODS FOR GENETIC CONTROL OF PLANT PEST INFESTATION AND COMPOSITIONS THEREOF) - sequence listing, part 23

SEQ ID NO: 29035 - DNA, 960 bp, Heterodera glycines
taaattcaagaaaatttgaaaattcatggccttttttgatttttcagataggtaccctcaaatttcaggccaaatctgaaaaatcagtagtagacttggtagccctgcagaagaagcaaaaaaattcaacgactaatttaacgaaaaaaaatcaaaatgttaccccgccaaaatttattttatttagtcccgtcatttgagtcctaatggtagaggaaatttcagtaccgtcgcgaagatagatgacttatttttcggaattttcttcactaaaatcaaattttggctcaaaaaatgacgaaaaaagtcataaaaacgcaaaaaagccataaaaatgccaaaagatattttaaaaaattttaaaaaaggtcacaaaaaatgcattttagaagcttcaaacaaagtatagaacacataattcatttgacttaaattcccatccctaaatatgaatgtagaataaaatctcaggtagtaaaaaaaaaataataaattaaaaaaaacattattctacaataataatttttttaaaaataaaaaagggcaatctttaatttactatgtttttaaattagatggttgaacttttagacaataaaaatatatttttatgttttacaatccttaatttgatgcccaaatttctggtgcccaaacttcccccccccccgcgtccatgacatgagtccctttcgcactgagccatttcagtcccagttctgtaactgtgtacataggggaattgttgctgccaaagaatttttctgattcttactttacagatagaaaggagaagtttgtatataaaaattgttcgattttgattcaaagatttcaaattaatattttcccagttaaattttgaatttattattaaaacgaacaaattggaattattaaaactgttaattaatgtgaaaggaaaattcaacaaattaatttttgaataaatttaaaact

SEQ ID NO: 29036 - DNA, 1131 bp, Heterodera glycines
cagtccactttcacgcctatggcgccaagccgtccccctttagtgtcctaagaggaccccgtggccaagccattgtctcttcattagccccccccccccccggtcggctaactggcgggggatttgggatttgttcgttgcttcgacgagattttctcgtccatttttgtttgtccagtcagattaaacaacagagagagaggaaggacatcccacagtttcttcctgcttcatccattcattttcattctcacccagttatttctctgtgtgtccccccggggcgattttcttttttttcggtgtccgtccgccggcggtcaactcagtccctgcgctgtgaagtgagtgaccgtcgtttgtcgagaacaacataaccagggccgggactggcttctgcttttgtgcattcggggtggacacccactcactgcttgatcaccgacacattgttaatgctttagccgctttccccccccccccccctcccctctgatttcgtaattatttggcggctttatccccccccccccaacccttttgcgttttgttttgttttattttcttgtcgtcaccggactttacgagaacaggaatatcatcatcacattggataagaaattgtacgagtaaaaattacatggaataatgcgactggcaaggcttttcacacttctgctgcctgctcgtggtggcatttttggcacatcgttttgccggtgacggcacaaatattcccttggggcgatttccccccctttttcaattgtcaatcattctcagcaaaaaacaaaaacaaacagacaaaagagaaaacttcaaaaggaacaaaacagtcaaagtcaaactgaaatctttaatttatggtttttggttcaataattttggattttggggctttgttttttggagttttggcataaatctttgattttcggtttggcttttaatcgcattgaccgttcacatttctcatcatgcaattttaattgatttattttttagcatttcatccatattaaaatgatcaaattgaatcaattcattacttttttggtgcactgtcacacattttccaatggaatattactgataattgaactctgcagcagggatgggtcaaatgaaaaa

SEQ ID NO: 29037 - DNA, 1386 bp, Heterodera glycines
  misc_feature (23)..(23): n is a, c, g, or t
  misc_feature (51)..(51): n is a, c, g, or t
  misc_feature (61)..(61): n is a, c, g, or t
  misc_feature (95)..(95): n is a, c, g, or t
  misc_feature (144)..(144): n is a, c, g, or t
  misc_feature (1324)..(1324): n is a, c, g, or t
aattttcgtttttttaacttttnatctgtcatcacaggagtcacattttcncataaatttncaaatgaatcatcatcaattccctcgatatcgtntaggagaattaagaaaataataaataattcaaaaacaatttttaacatntaagaaactaggaaataatttattaggtttaaacagactaatattaatattatattaaaattaccagtattttgccatgattcagcaagaaaacaattaagtattagaaaatcaatgaatattattattttacaattatttttcaatttaggtttgtcaaggcattaataaattttttagaaagattaattgtaaaattttttcaattttaaaacaattaaattttcattatttttaaattagattaaatggcatttatcaaaagatttttgtcagcatgtatgatgaatagggttataaattatatgattttgcatattttttctgcgcatatgcaatgaagaaaggggctcaaaaatagcagttctgcgttaaaattttttgatttggtgaaggtttttagtccatataatccaaattttggggttttcgagaataaatccatatttcgacatttttgcatttttagtccatattttggccatttttaacaaattttcacaagaaaaatgcaaaaaagcgaaaaatacacccctaaagagcgactttttttgtaaattttttaaaaatacacgcctaaaaaagagagttttttttttcgaaatttcggaaagttttttaggtattttgtccacttccgaaaattttcgctgaaaacagaatgagattattacaaaaattttgagatgtatttgatttgcaattgtgaagtttgaatttaattaaaattggcattttttaaatgttaaatccattctttggcagtttttagcgtatttttaagtctaaatttcgcaaatattgaattaaatacatttttcggaatttgttaggtttaaaagatatattttggcagtttttattccatattttggtccatatttcgccatttttgagctttttagtccatattttatgtacatatttagcgcttttttagtccatataatttataaccctaatgatgaatattgagtcaacaaatacaatagtaaatctgttttgtaaaattttctatcaagattttaactgaaaaaccaattaaaaaaggtatttttattaaacaattgtcaatgattgatgacattcattgctataaaaataaaacaaggtgctatgacgttactcaaaaggctacccgacttttgggacccgacatttggggattttaataaacaanaaaaaatatttaattttatgtccaaaattagacaaatttacgtctgctttagccagatttaa

SEQ ID NO: 29038 - DNA, 987 bp, Heterodera glycines
cttcgcctcgctcctcttgattctccaactcattaatcacattccttctcatcccctccggctgtaagcacggactttcgaatattgttttctctgctgctctcacacttttcttcgccattcttcggctgctttgccccaggccaattttgcccatcacttttaatcgctcttccttttctctgtccaaggaagtggttgtggccagaaattctcgccatggctcattgtgatcatttcttcggccaattcgcaccaaatcttccttcctccggctttcttcatcattttgctcttccattgatcgctttcctcttggatcaattaccaccaaatcatttccgtcccactcttcgtttataactttttccaccacatattttgccacaaccgggtccaaacccggttttttactcattttgggtatttgctcctcttcctcctcctcttcatcatcttctaatatgacttcgtccacttgttttaacttctctttttccttatttcgcttttccagttcaatttttcgcttgtttgtctcttccaatttcattttcatcatttcaaattcattcaaaagtcgtttttcctctgcacttaactgttcatcgtcgaatggcaccacttcaggcgcttttggtgaatccatgactaaatttgatatgattttggttcagcaaaatttggatcatttttttcgatttttcggcatttttatttaattctgtatcttttgaaatttccgcacttttttctttttgtttttctgtttctgtatttatgtccaatatgctcatgaataaatccccaacagaaatgacattaattcttggtgaattatcccaatcataattttgatcaaattcaaattatcaatgggttttcggaataagttattgttatgtcgcgaattctctcaatttctagaatttgttcgtcaatctcacccaattgttcccaatatatttcacttttcccctcagtttt

SEQ ID NO: 29039 - DNA, 1875 bp, Heterodera glycines
aggaatgagcaaaaattagaataacgttttagaatttcttctaaggttggtctctttttggagaaaaaaacgatttttctgggtacagtttctaaaagaattttttgatttttataagaaagttttataaattgttaaaatttgaaaatatatagaaaattgaaatatagtacatatttttgtatttggtttatttaattctaaacccgttaacaaattgattaaaattttcaatttttgctcagcaaaaaaagttaaaatgcagcgaaattaggaaaatgctctgataatcacctttattaataagatgctgatagtttttgaaaaaatccttaacaaaaatgcaataaaaatgaaaaaaaatgaccccaaaaaattgaaatatttaagtttttcgtgttaataattatttttagtagataattttatttatttatattgtttagatgtaaaattcaaagagtaaataaattgtttaccattaatgcccaatattttaaatttttgaagcagtaattcactctgaattttgtgttactgtgtatttttaataaatataggttttttgtaaattaataaaaattagatactgtactataattatattattattaaaaaggcttataaacgtgtcacacaaaatcccaaaattagtagaataaaaatgaaaataattaaatataaaaatgttaaaaattaatttgttataaataaaaagagaattaaaacagaaatagaaaatttaattaatagacaaaaaaaaaatacaatcaaaaaatgtttagcaaatgccaataaattcaggagttcgaaatttaatttcaaaatttattgagataaatcagggctttctttcaaaaatcaaaataattaaaaaataaaatttatcaaaaattttatcaacaacaaaaactaaaattaataaaaaaaaatgtaaacaagcaataataataaaggaaataataatgtaaaattgtatatttatatttaaaaaagatattaaaattttttaagcgaacaatgcgattattttaccctgtaatgcaaaaaggaagaaataaaaaaaagacaacttctgagtataaatattattaaggatgaaattttaggttctaaaaattgcgaaaataggaaagttttttagttcaaaaacccaaaaatagacaataaaaattgaaaatatgcactaaaaagttccaaacagtcccggtcacggcgagacaaaataagtagggctgcgacatttagtgacgaaaaatctcgaaatctttaactaaaatagtgatgaaaaaagtgcaaaaatagtgacttttagtgatattattttcggccaaaaattaagcaaaaaaattttaaccactgaatatagttggaaaagaggtgcatttcttttctaatagtttcttagcaaatatgaactttttaaatcaaaaaatttgtcaaggaaaaaaattgggggaataatttttaagaaaattttgaaaaaaaaaaatttaaggtcgtttattatgggtgtatttttagaaatttttaaggtcgattcttaggtgaatattttttatttttattgcatttttgttgtgaaattcctaaaaatgtcgaaatagtgacaaaatggatacatttttgaatataggcaattttccaaatttcaaaatttttcttttttaaggataaatttttgagaaaattttgggtaaaacgccaaaataagtgtcaacatatgtttttaaaaatttttttaaggtttctcggcataaaaataaaaaacctaaaaatagtcacttaaatataaagctgttcacaaaaataccacctagcctagtgtataaatttataataaaaaatttataaaaaatgaacactttcacatgc

SEQ ID NO: 29040 - DNA, 950 bp, Heterodera glycines
cttgccagatcggacgggtgcgcatgactttctgaacatctatattatgaaacaaaaaaatcgattttttcaagtgtccgtttgagggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctcccataaatctgggcgcatcggctcggggggactgccccgaaacaaaaaaaatcattttttcaagggcccgtttgggggactccaacaattatggggaagaaaaatcccacgcaaaattaaaatacaggctttgggaaagttattcccgaaggaattcggcctccccctaaattttgggggcatccgtttgggggggattggccccaaaaaaaaaaaaaaaaattttttttaggggcccctttgggggagcccaaaaaaatatagggaggaaaaaaacccccccca

SEQ ID NO: 29041 - DNA, 962 bp, Heterodera glycines
  misc_feature (880)..(880): n is a, c, g, or t
actttttgtttatatttaattagttttttcattttttaggtgtatatttaataattaataaaaaaattagccaaataattgcattaattaattaatttttttggtgttaaaatttagacgacattaaaggcacatgagcgagtgcatgacataacgcaggtattttaaacttaattttatattttaatttaagcgtattatttatttttccgtaaatttaggcgtaatttaaatttatttattttttttgtaaatttaagccctatttatgcaataaatgcggcgaatcatttcattacatgtgcgagcttgaataccatgcaaaaacccatctgcgtaagcaattttaatatttttaaataatatttaataaaaatttagaacaaaaaggctacaaatgcgagtgtgggcgtacattttaccaagtcagtctgacaatgaacatgggatttatttttcagtatttaatttgaaaaaataataaggaattttattaaaaaaaactattttaaatttattaaattacacttccaaataaatttgtattatgtgaacatataaattataaaggaaaacccatgaaattttatgggcatttagaaaataaaaaaaatttttgaaattctatttttattattaaaatttatctgaaaaatcctagagaaaataacaataggtgctaaaatcaaacaattcttataaatgtaaggacagatgacagaaatcattgataatttaaatgattttccatttgtacttcgccaaaagcggattttgttgaaatcagcttaagtctttatcccaatattttaaattaattttattaataacaaaaaatgctttttagtacacagatttgctctaccataagcatcccggngaggatgaaccgttgccagcggctgtgcccgtgccgtccgcctcattggccgactttagcgctttgacatgtccagctcatc

SEQ ID NO: 29042 - DNA, 1223 bp, Heterodera glycines
aaaaagacggtcacgcgccttaagtcggggggccaaatgcaacgagcgaagcggcggcctttggagggtcagtcaaatcgccccaattaacaaattaagccatttgaaatggagcagaaaagtacacaattggtaaatcatttagatcaaaaacccataaaaatgcactttaggcaattctcaatgacgcttggcaatgatgagtgacacggacagaaaacgtatggcaggcctgctgatcatcggcaacaacggcacactgtcaccaattgtgacgactccggcgccacaaataccggcacagcgcagtaattagtaaacaaaaacaaaaaaattgtctatttaatgaaattagcaccaattaactgttggcattagtttattttcatccttaagtaatttcaaaacggcgccgtaagcgtgcaacgtgcaccacgacaattagctttgatgcgcgccaacttttaaaaagtattttaaaattatttatgcttcgaaatatttattcacggaaaaacaaaaaacggcactttgttaattagctcaaatgatttaattgcggataaatacaacaaattgcagcggaccagcaacacgaatatgggcggacacgcggtgcgactgatcggctggggtaaacaaacatgcactgacgggaccatccaagacttttggatagccgtaaactcgtggaacaccgactggggccaaaagggcattttctacatcgccaaaggcgtggacgaagtcggcatcgaaagaatgggaattttttggggcacgccgaaagtttaagacgaattgattggcatttgatgtattcaaggcgacaaattgagagttttttactttaaatgctaacaaaggaaggtccccaggtgtccgtgggatttccaaatgaaactttgtgggtgcatagagcacccatgggttcttaagaaaaatggtttcaatttctgccaaataagtacgagtgccgagttatgacgtgccaaactttttttatcccaataaattgaataatctattgcactgttttgtgctgtttagtggtgcagaggttgtgttctcacctttactttttccccccacaagttcgaatccctcttaagtaaattaattttttttaattttgcccttgaatacccttttagaaatgtaattattttcatttataatatgcatttatattttttaaatttatttttgaacgaaaaatgcat

SEQ ID NO: 29043 - DNA, 943 bp, Heterodera glycines
tttttcatttcattttaaaattggggaagaaaaaaccccaatttaaactgctaattgtttagtcgaatacatttcgaattaaaaaattattttccaaaaattcacacgcagaagaataattaataagtgaaaattttatgtgtgaaataaggttcggctttaacatttgtaagaaataacggaagaattaattttattaaaataaatatttgtaatttttgatatttttacattttgtcagtatttgataatgacatcagtctgatgagtcattatttggtcgttctgtgcccatcgccgggtgctcacactttcgccgatcaattggcccacaaaatggccgctgatatcactgtgttcgtccggctgatcgaagcggtgccccggggggcaaaatttgacaaaatttggaaagaaaaaaaggaaaaccaaatcatcgatttgtacgacagctttttcgagatggactatagcaacgaatatcgaacacaaatgcattttacgtggaaattgtttgacgctgtccgatcagagctggccgatcttagttttttgatcaacgagaaaaagctgagacagaaatgggacggcatggaaaagcgggcacagcgcgacgccgcggaccaaacagcgagcgacgatggtacagtgccaaccgcgccaattttggtggccaaattacatgcgcaaacgctgcaaaagttggcatttgaaaatgccgaaacggcgaaacggaagacggcagaaatggccaaacatttcagggaaaagctgaagacaggtgaactcataaaaggggggggggggaagcaaacattcggaatttttgcatgtgctaatattggcacaatgacatcaattagtgccaatcatcccgctgattatggcatgggcattttggtgccaaagacctctgacgttataacaactcatacaaaaggca

SEQ ID NO: 29044 - DNA, 1207 bp, Heterodera glycines
  misc_feature (88)..(88): n is a, c, g, or t
gtagagcgcgtctagctcattcgaataacatcaaactggtttgttttgtcacgaaacaacccgctgatgccacgtcgaagaaaagtcncaaaatttgacatccataaaactccattttttcatcggccagcgtgtttaaagcaaacccgaaactgataggaaatttaaattgatcataatagaagtttaatttttatttgtcccatgcattttctgggaaatcttttcgcgaaaagttgaaaaattccaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaagtgtctaaaaatttttgttgttaatattcagaaaacgtgttttttttactgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagat

SEQ ID NO: 29045 - DNA, 589 bp, Heterodera glycines
ttttggaattttgattaaaaattcgaaaaaatttttatagtccattattttagcttagaaatgtcaagccatgtaaatcgacctttttgctcttcaaaagaattttaaggtgcattttttcaaaaaaaaaattgaggacaatggaggggggacgataggcgctgccgggaaaagtttttgaaaatttgagtttgatttgttaacagatttacacgaaaaaatgacaaaattttgctactttgagctacattttagaaaaacatttagcttttttggaaatcttttttgataaaaaagttatgcgagtgttactcaatttcatttgaattttggagtctttttaacagttgaaattgttccaaattttcaaaaatccaaagttctaccttgaaattttgaattaaagacatttcgccaaaaataattattaaatttttcaaattttgggcagtttcgctggcgaaatttaagcccgttttagcctggtcaaattgaccgggcccgggaccgggcttagccatttgaccgggaccgggccgcccggtaaaaagcccgcctggcccccgggcccgtccgggctctagatttt

SEQ ID NO: 29046 - DNA, 1327 bp, Heterodera glycines
taaattgaaagaccacactgggggacccgacatatcatgtccccaaatgccattgtcatcaaatcggtttcttaaattttgggatcctcaaatatcaaatgctcaaaatttttccacaaattaacatgccgctcaatttttgggtgcttttaaaattaaaaaaaaccttttttcaactctcgaaaataaataattcgtgattattaattaattatttaattaattaattattttatttttttacttttttcgttacttctccaaacaaattttcacatttttttgaagcatttttgcttttcttatcccttataacaattttgtaattgccagaaggcgaaacagtacccgcaaaagtcacttcgtttccaagaagtgattctgtttggagcaaaaagaagaaataatataaaattgtccaatacatttaatcaaatctattaaaaattaaaataaaatttctttaaaatataataataaaaattataaatgattttgataggtattagctatttctgcaagttaatatgaaggttttagaaaaggcttttctcaattggaaacaatggaattattttcaattcactcatcacatgcaaatcaatcaatcaatcagccgatggcaaaatgggaaaacgggcattatcaaaaatgtaaattgattttgtattttaattgttatatatgaatatttattttaataacttacatttttacgatttacgaaatgaaagaaaaaaaaattgttaggaaaaggggcgctatttgcttttttctattgttagagcgggaaaatgtcttaacgccggagttttgggagtcactgatttcttggacaaaatggtgagttttatatgaagataaatctcatcagcagagcttatccgcctgcttatactacataaggatttctaaattttgttaaactttgtatttacaagacacggagaaaagcaccaaattttgtagttttatcacaataattaaaagtgcagaaaaaatataaaaactgagagaaaagaaaaaaattggaaaattaaaaaagacaatatctgcgagatttttgacgtcggcgctcaaacatcgatttgatgaggcgaagaggcgaagctgaaataaaaacaaagtcctttcaaaatatgtacataataaagtacaagctaatttcagtgtgttcattcctttgattggttataaaattacaaaatggtaactttttagcccgggaatttaaattgacgggtgcgaaatttgtaaaaattggataaattttcaaaatgttcccagggtgactgtaagcaccgccggactcttaattctcttaatt

SEQ ID NO: 29047 - DNA, 389 bp, Heterodera glycines
cattttgtggttttttgatatgccaatgaggctaaattttcaaaatgaggctttgaggctttttgtggttttttcagaaattttgaggctttttgtggtttttgttaaattttccaaaaaaccacaaaataaagaagtttttaatgaaaatctgctaaaaatatggtcaaaattctcaatttttcccccggcggcgcctatcggcaccgccggaccctaaaaatcctttattttcttaaaatttttgcttaaaattgtaaaatttggccatttttgtgggcaaattctgttaccaaatcacattaaaaattacaaaaattttcccggcggtgcctatcggcatcgccggacccctgttcccccaaaaaattggaagaggcgccgcaaaa

SEQ ID NO: 29048 - DNA, 708 bp, Heterodera glycines
ctgactttgtaattggtaaatatatggtcaatattttctactagctcacatttttgcttttcttttttttttatatatcttcatttttttatcaaaaaaaccatttatgtataaaaattaaaataaactccgatctaaaaaaattaaaaaactcttattgtaaacaggaaaactactgtatttatattttataaattttatacagtttcccttctctaacaattacagtacgcccaatatttcacagtcacctgtgttgcgtctgatttgaatatgtttgatgaattttgtggttttgttgttaaacgcatacgtgcccaacttgagtacctcaacaactgcacgagtggcgatgtcgatttttgccatgtgattttgttaaacagttgtccaccgtacatcacacagaaacacatcaaaatgtacggtagtttaaattatggaaaaacatgaaaaatgggagcggagtcgtcaaaaaattattggcttatactccagggacagtaccaggatttcggcttggggcgagtattggccccgggggcgacgttttacaccacttttttttgcggtgcccttttttaaaagttttgatgaaaatttggcttaatttgttaacagatgttgtcaaaaactcctttttaatccgaaatccaactcgggtaaattatggaactcttgaccttgaaccattcaaaattccgctct

SEQ ID NO: 29049 - DNA, 877 bp, Heterodera glycines
  misc_feature (657)..(658): n is a, c, g, or t
attttgcaggctaatagagcatctaaagagctttctcttccttacaacaatgttggatttggttggcaaagaaaaaagctatagccaaaaacgagatgttgtcctgcaacagtcccatgatcgtgacggactccgcgcaaatactctcgcccgttgtctgcgcatcggaagtcgcgtcgtcataagcctgtaaaagttcgtgcggtttcgtatcagcgacctctaaaagggtgccatgtaatcccgacactgggtaataatttttgaaaaattcaaaaaaatctctccaaccaattcgatcaatttgaatcgcttcacagcctaggtagcgaagctcaagaagcgcgaaggatataggtagcgggctgaaattttgcatacgtatgcaccctgggacggggcattcgggaaaaatacggattttccggtccggttgccaactgagtaccaggggcttatttcacacttttgcttgcgtttgaaggcccataacttttttcggattttaagttgaagtgttgactaaaatacaaaaaaaaattcagacctctacctataataggaagggctgcagaaattggcaacttttcagtaccaactttgtccaattcagtccccgtcgaataactcattaagctttgatctgagcgggggggnngggggtggccagtagacttattatagagctcaatgagctcgatttttcaaattttaaatttcgaaaattttcaaaattttcgagttaggcctaaaagtatgttttacagcagagatgtgcaggaaaatcatggcatataaaagcacaaatggaaagatgccaaaaaccattcatcaccaaaaatccaaaattaacactaaatttctatttttgcgcccc

SEQ ID NO: 29050 - DNA, 679 bp, Heterodera glycines
tctgtttctcttcactttctcttcctcttcactttctgttcctcttccactttctgttcctcttccactttctgctcctcttcgagtttctgttgctcttcttctcttccactttctgttcctcttccactttctcttcctctttctgttgctcttcttctcttccactttctgttcctcttccactttctcttccactttctgtttctcttcttctcttccgctttctgttcctcttccactttctcttccacgttctgtttctcttccactttctcttcctcttccactttctgttcctcttccactttctcttccactttctgttcctcttccactttctcttccactttctgctcctcttccactttctgttgctcttcttctcttccactttctgatcctattccactttatcttccactttctgatgctcttcttctcttccactctctgttcctattccacattatcttccactttctgttgctcttcctctcttccactttctgttcctattccactctatcttccactttctgttgctcttcttctcttccactttctgttcctcttccactttctcttccacgttctgtttctctttcactttctgtttctctttcactttctgttcctctttcactttctcttccactttctgtttctctttcacttt

SEQ ID NO: 29051 - DNA, 788 bp, Heterodera glycines
tgccaatcaaatgagtgaatgaaatttgagtttacatatttgtggattttgaaaaaaagttgatgatccatatcaaaaaattaaaccaaaagctttgtcggaggtgctactgtaggttgtgtaataacacagacaacaactgtgggatcatggaccgctctcttagtattgtacaaatcaaagaatcattgcctaaaataccgtaccccaacacacccttcccgaaaatacacagtaagctccaccagtctctgggtgttagatcactacattattttttatttttcataatcacttactcacataaaaagtcaaatgaaaaagtcctataattaatacagtagtctatcttaacatcgaaaattactgtataatgttatattgaggcctattaagcatcctcccatacactgtcgcgccgtattgcgcacactatgcgcaaaaaattcagcgccgcggcacatcacagcagcggcacaaagtgtccgtctgtgcgatgaccgtggattttttttattgtgccccgaggcgcgctgcgcggcggtgaaagttgtcccacgcatgcataattttgatggggtgcaacaaaaaaaaattaggaagaatgtctcgcgctcacatcttttcttccatctttcagcactctctttctctactttcctctctcccgtttttcagcactatttctctctaagcgcctccgccctttttctctccctctctctttgtctcacattattcagtgttttctatctcgctctcatcctctctcaaacatactcatatgc

SEQ ID NO: 29052 - DNA, 803 bp, Heterodera glycines
ataactggaaaattaacaaattttacacataaaattggcctttcagatctattccgactttctcaaggacaaatgtgccaaaacttgtggccattgcttatccgaagaagacaaagttcggcttgagaatgattacggcagtgacagcagcaatagcgaagattatgaccaaccctttgaatctgttcgacgcattcgaaatcgtccttcagctgctccccccgccggcgggcagaaaaattcagcggacaatggcactaccgttgcccaaagggccaagggtacggtatttcaataataaaaaaaaagtcaaaatcatttgcaattaattgtgattttttggttcaatttatcatttttcagaaggctcttcaaagcgaagcaaatcaagtggaaaattttccgagcgaattatcatagaaattgggggcggtgatcaaaaagaacacatcgaattgcgggggaaactcggcgaagcattacggtactaaaaacaaaaagatttaaaatcgaaaaacaaaattttaaaaaataaattaaattatatcaaattaacaaaaaaaaaatttaattaattgagcaaaattttaaagaatttcgcgagagattttgttggagaatgacgaagaaaatgatgatgaacaagcggagaagaagaagagaaagcggcagaagaaaaagcaaaggaatttgagtccgcttttggtgattttggaaaaagcgcaaccgaacgaagccgaagaaacatttccggaagaaatgggaatatttccggaaggacggaagcgaaatgggaccgaaat

SEQ ID NO: 29053 - DNA, 977 bp, Heterodera glycines
  misc_feature (857)..(858): n is a, c, g, or t
  misc_feature (891)..(892): n is a, c, g, or t
tgatttcccgcaaggaaacgttggcacaaaaatgatacctgcccatttttgtgtatatatatatatatatatatatatatcagggatgaaacggaattccttttcgacatttttggcgtcgtaattccggtttcctaaataattgggaatcaaattctgattccaaaacttaaagtcggaaattttcgacaaaaaattaatataaaaaaaaaactatgagtgattctagtcagatctggtcctttttatggtattttgtacctatttcaccatttacgaagacttttttaaaaaataatcatttataaaaaatttatttacatattttctgattttttgtaaatatttcgggatttttcttacataatatgtacatgttttaccatttttatttttgacagccctagttatgaacataatttttatgctataataagaattttcttagaataacatttgattgagaaaatataatctggtcagaacataatgtttctggtcggatttgtgctgagtcggaccgaaatctgggtcgagatttggtatcgaaaaacgcttttcatgactcgggattctgacgacaaattggtctgcaccctttgaattttatttgggttctgatttggaatcgtttgcctgtggcaaattttgtgatttattgttttccggaattttctagaaaattgtggtgcatgttgggctttctcagcggcccttgttcattcaactgcggtttttgaaagccgagtcggtgacccggatcgtctttacctgttttctgcgcaatgcctggttgattgtaccgttcgtgaggagccttatgaaggatgcaaaggagttgctgttatggacgcatnntgagtaaccaatttttaactattttgtaaatgnngataactataaaaggtgtctttgaattacatggttttgcgtcccggattttcatatccaaattttgtggcgactgattcctgaaa

SEQ ID NO: 29054 - DNA, 1309 bp, Heterodera glycines
  misc_feature (48)..(48): n is a, c, g, or t
  misc_feature (1296)..(1296): n is a, c, g, or t
aatataatccaaatagctcagtttttcaatataataataaactaatanatagtctctgatcgatcatcaacaaatgaatgaatattaaaaaatcaaaaaaagcaaattccatttttaaattttctatttgtacaatgcttttacatttattttattataattttataaattaaaatattcatcctttaaaaattagttgagatggaatgcaaaaatttcatatttttaagcaccccttaaatttcacataattttcacgttatataattgaaaatcatctttttatagttttttttatttctattattttaagctaattaattgattttgaaggctaaatatttttaatcatttacataaaacacatcccaaacagcccaatttttaaatataataaacgaataaatgagcgaatattaaaaaataaagtaattgccattttttaataaaaattttccatttttggtaatgcttttacatttgtttttttataattaaaaaacatttgttcttttaataattggttattaatccaaatatttcacttttttcctgtcatataattgaaattcgccttttaaaggctatccaattacattaagccaagaactcaaaatttacattcctaatgtcctgacaattttttttttaattttttgatttatttgtccatctacgacatttcacaaacattaataaaaaatatttcctaaaagttaatatgtgaaattcttggaaatgatagtttttaaaataattttatttttattttcttgtgattctcgttttttgagcgcatttttctaaatgatcatttggttcagtaattcgtcagccagatattaatttttaatatactttaattgaaagatcattaagttcaattccaaagttttagtttgtttgcccaaatatttcatttaaataatttatttttattttttaatagactttaattgaaagatcattaagttcaattccaaagttttagtttgtttgcccaaatatttcatttaaataatttatttttattttttaatatactttaattgaaagatcattaagttcaattccaaagttttagtttgtttgcccaaatatttcatttaaataatttatttttattttttaatagactttaattgaaagatcattaagttcaattccaaagttttagtttgtttgcccaaatatttcatttaaataatttatttttattttttaatatactttaattgaaagatcattaagttcaattccaaagttttagtttgtttgcccaaatatttcatttanataatttattttt

SEQ ID NO: 29055 - DNA, 1459 bp, Heterodera glycines
  misc_feature (11)..(11): n is a, c, g, or t
  misc_feature (21)..(22): n is a, c, g, or t
  misc_feature (41)..(41): n is a, c, g, or t
  misc_feature (44)..(44): n is a, c, g, or t
  misc_feature (58)..(58): n is a, c, g, or t
aaaatattatnaattttgaannttaattttgaaagaatttntantaaatttattttanaaaattataattaagtgactaaaaatttttaataaattaaaaaaaacttttaggttgccgcacagttcaaaatgcaaagaaaaacatttaaagatattcatttacaattttttttgaattttttcacgaattacgccaataatgagttcgggttggcaatgattttgcgcaaaaaccgggcgcaatttcacgccttcgccatttgttaggcgcagaaatagacaatttttggtggaaaaatgaatacatttttcgtcaacaattgataaattggaactgtaatttttattaaaaaaattatttaaattttaatttattaattagacatttatatatccataataatattaaaattaattaataatttcccttattttatttttccacgacaaaacacgtctattggaacattaccacagtactctgatatcaaatgaccttcctggtgatcagatacggttgaagcatcgtttatcagcagatcttacggtattttgctttttcctaagtcagagtggtccattttcaaataaaaaaaagaatttaattaaaatttgaaataaaaattttttatttgcaattaaaaagtttgaaatttttgttacaaatgtcgaaaaaaaactcttcctcaagtattttggtgaaatttttgaacaatttaacaaaaattaatcagacggtccatttttgaaaaattgaggaaaacttgaaaattcaaaaaaattttttgtattatttgcaatggaaaaaatttgaaatttttagataaaatgcctaaaataacatcatgcattttagtcatattttgggatataattttgattgatccacccaaatttcaggtgtggatgtgccgttttgaacatctgttgagcctccaattgcccgcagttaggcaggaaatagagaaaatttggctgttcttccggtgttactatgacatcatcagcgattttgagccgccgattagcacggaaattgattggcctttagcggctgccacaaaggaattaattttgagtaattaattagtgaatttattactttataaattaatcaataaaaaatatcggaaatacgtcaagggaaatggagttgatagaaattttaatttagtatttattacatcatttttgggtaaaaaaaagtgatttaaaccgtttaaaaaccctaaattttgaaaaatggcgccaagacaagaaacagtaagaaagctttaatgggattactgtaagaagcccctctattatttataggtttttaaatttaattattgttttttttgcaaaaaatatgcagtaaatcaatttaatttccaagagccattatcatctattattttaaaaatgatttttaaatatgggaatgatgtaatattcctaatttaaattaaaaataaat

SEQ ID NO: 29056 - DNA, 774 bp, Heterodera glycines
aggggagggcggtgtcaagtgttcttgtgcctcgacatttttgccgcccagcaaaattgaacatttgcgccgttcatccaaaaatatatttttcaaatattgttatcattttcaacatattttcctcaatctactacgcgacaacaaaaatttgattaataaacgaaatactaaaaaactaatcacaatgattgatatctgtacgagttgccattgccattggccgggacttgcgcattcgcaattttgtccattacattttaataatgattttcatgatcaggctgttcggcgtgtgcatgtgaccctaacggcgtgaacattgacccaagcacgggtgaaccatatttgaaggttggtttcctttttactatttcagtgacccccaaaaacattcgtctgatacttttttataccatctgccggtgcttttaattgatgcaaattaaattacaaaataatttttgttttttaagtgtaacgacattgatggacaatgccattgcaagcaaggaagagggggacgaacttgcgcggattgccaagacttttattggggtgcagtttgaaaaaaaaaacttaatttttactgcatcgttgggtcggattttgtcaacttttttttaggtaatccatttgctggggaatgtatgtcatgcgaatgcgacaccgacgggtcgcaaacgctgcagtgcgatcggcagacggggcactgcgtgtgcaaaccgggcagcggaggcccaaagtgtaaccattgcgcccgagggtgaacat

SEQ ID NO: 29057 - DNA, 1158 bp, Heterodera glycines
agcttctccacgggctgagagagaccgccaagagcactttcgtcaacagtttgacgaagcggaagtactgcaggaacaactacaaaaccaagaagagctgcagaatgatgagaatgtggacccgcaactgcatcagcaacgtgcagcacagcaggcgcaatatgaacgtctcgtgcgtttacaattgcgagagtcccgccgttttcgaagcggggtcgcttcgtcagttctcgtcccccctcccttgttttgggagggggactgtgtcatttgcactaatgcacgtgcaaacttttacaacattcgctgtgggcatgtgtgcctctgcgctgattgcgcagttgctgccgtaatccagcgaattactgtttgtgttttgtgccgtgctccagttaatggcatatacccatatgtccgttaactggagcacggacggatattgtgttagtacatatttaaattaattgcgaataattttggcaaaacaaaaaaatttttttgtaattgacttttttttttaacactaacacaacatttatcagtatatgtttgagaccatccacttaatcctttttattatcgatcacttaattcattaacctaatcatcttatgtaaacctttttttttaattggacgacattttctaacctttgcattattatctcaataaagacccgtaaagttcaaaaagtttaataaaaaacgtgtgaaattaagttaattgagtgaaaaaatttaaaaaaaaaacaaatggttaaatcagccaccccgtgacacttccgtttaatttttggaaatacaaaatgaaaatttaaaaaatttttgtgccattttttgttgttgttcgccatctgcttcctccgcacttttcctcctttttctactcttcgttcaatccttctcgcactttgaacgcttcaaacaatgcatttgcctgaatttttaaatatttttggtcaggcttatcaaaacacagaaacgaggaaatgtgtgagagagagagagagagagaaatgagatgcaaaaaacaatagggggaccaacacggaggaaggcctgcctaccgcttttcacagctccgaaataagcattgaagggggggaccaacacgagggaaaggctacccatcaacacccagactttatgaaatgtgaga

SEQ ID NO: 29058 - DNA, 1238 bp, Heterodera glycines
  misc_feature (82)..(82): n is a, c, g, or t
  misc_feature (96)..(96): n is a, c, g, or t
  misc_feature (111)..(111): n is a, c, g, or t
caaaacagaattgggaatattactgatgctattacgagatgaattaattttgttgtcacgttaatatcttggatactataanccctatcaaatttntagttaagttgtatnttatattatatattaaaaaggaaaggaagcgaaaaaatgttttttataataaaaattcggaatttttcggcgctttttggcactgcgacgttttgtcccgacgacgtttcagcaacgacgttttgttcttctccgctcaaaataataaatgaaagtgggaattttggaattctctccctccttccggttaggcctgcttaagtgtttaattcttgaggtcattgctgttcatggctttaccaaacgtgaaatgctcgagctcaaatatatggttcggatgattggtgctcgcttcagtgttgccattgaacagaaaagcgattttttggtcgtcaataaaaggtgcgtttcttttacacatttgaaatttcaatgcaccaatttctcgtgcagtgttttcactgaaaatttgtgccaattggctgcaagagttggcactgttttggtgaatttccaatggcttcttgagctgtatttcggctcgatcatttgtctaacttcacccgaccatcaacgcttttctccccagaatgaaaatgcttcactcactgcttcatcttgctctcctcttgcactgtcgaaagtgtgcgaagtgtgtcataaattattgggtaacaaaactcactttttgtagtttctttagtaaattaaggttttttagctccttggagtcattcgccgatttcattaaatcaagaaattattcgattggctcatgaaatgaaatacaacttaaaaaatgacatcgccattttcccggaaaagcaatttaggtgagttagggaaaagaaaacagtgttacaattttggcagaatctccaacaaagcgcctactgaaaaacaaatcgaagcggctattgacgtttatgcaaattcgggaaacaagcctaaagtattagcaatttttcaatatagaaaacctaattaatggtttttatgttcagtatgccattcttttcgaaggttttttccccgaccaaattgactgtctttcaaaaaaagcgcgttttcttggtgctgatatcgtttcttctgttgcgttgtgtacacattttgtgacttcgagtttataccggacgtttgacattttctttcctttcacttaattaaatttgctgcttaagtgt

SEQ ID NO: 29059 - DNA, 1114 bp, Heterodera glycines
  misc_feature (1107)..(1107): n is a, c, g, or t
aattattatcacatcgaaattcacttctgctggagataagaaacgcccaaaatatcaatcaaatggcaaaaaagggcaccgccaccaaaggaaaagccaaaggaaaagccaaagcaaaataaaaaacaaatgccttttccgtcggccatttgcgaaggcaattcgctcttttggtccaaaagaaatgaatcggtcagcatttttccgcctccgtccgccgtcgaattttgggaggcgttgtgatcaccgccaaccgcggaagaatcggaagagttgggactgaacaacggaggttggccggacgaagacggtggtgaggcggcatcgaaagggagggggaggacggacacctgcgaaagtgcagaaaaagtgatgagtcattgggtggcgcaaatgcgaaaggacaaaatgatatcatcgggggaagaagagcatttttgaaacttccaaacagagcgagacatacccatcaataaatttgaaattgcaaataattttatgatcggttaattaattaattaattgtccatttcccccgtccttcaccaccgaatggtccctttgctgatgatgattgttgtgcaaaagctgttgcatttgtgcggtggtcgtctgcatttcacaaattgggagacccaaaaagaaaagggaggggaggaaaagcgaagtgatcagcaacaggagagaatggagcaaaattaggacattggcaaatgactgaaagggacgaacgacggacactaattgttggacagaattgctgatcgatcagaaatatggacggaaatgccatccataaagggaggatgcggtaaaagcaaatccctttgaaggtgaagtgaaaaggaaggccccatgaaaaacgcgaagcacgagatatttaggtaagacttggactcagcccacccgaaaaaatgacatgaatttgttataaaactgcttgatattgaatattattcacgaaaatgtatgagaaagtgacgatatatagtgaaaatttttttttatcaacatttgaaatttttcaaaaaacgtcatttttgagtgaatttatcaagaaatatgctgttaggtatctatttaaaactgtatttttagctaataatngggtgat

SEQ ID NO: 29060 - DNA, 302 bp, Heterodera glycines
gaaccccgtgggcgggggtgcctttcgcgggggcggaggattgcgggggtcagagtcgcggggccgggggcggggtgagcaaatgactcgcccccggggacgggggcgggggtttgcttttaattagcttcaaaaaatctcacaaaaattaatttttttgaatgatgtgtttggctccacattcctttagtctatgtatcgcctcgatttaattctttttggtataattgcacagatattgtctaaaaatgaccaaatttagggaataaattatgccaaatagtcaattttatgggtgtttt

SEQ ID NO: 29061 - DNA, 1137 bp, Heterodera glycines
caaaaaagtgttcgaaaaaaagagatagtcgtttttacatacgattatgaacagaaagaccgtaaatgactctgaagcgtccataggccggagaccacaactatatacgcattataaaaaggaaatgacagaagcctcgaatgttagttatattgcgtgtcacaaaatctcttcctgaaaaaattttcaaaaaagtgttccgaaaaaaagagatagtcgtttttacatacgaatattgaaaagaaggcgtaaatggctctgaagcgtccataggccgcagaccacaaagtaaaatgggacaacattcataaaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctctttcctaaaaaaattttcaaaaaagtgttccgaaaaaaagagatagtcgtttttacatacgattattgaaaagaaggcgtaaatggctctgaatcgtttttacatacgattattgaaaagaaggcgtaaatggctctgaagcgtccataggccggagaccacaacgtaaaatgggacaacattcataaaaaaaggttggcctcaaaagggccattcccaagctaatttcggaatttgctgataaaatcaaatagcctaaattatatacgcattataaaaaggaaatgacagaagcctcgaatgttagttatattgcgtgtcacaaaatctcttcctgaaaaaattttcaaaaaagtgttccgaaaaaaagagatagtcgtttttacatacgaatattgaaaagaaggcgtaaatggctctgaagcgtccataggccgcagaccacaaagtaaaatgggacaacattcataaaaaaagggtgggctcaaaagggcccattcccaagctaatttcggaatttggtgataaaatcaaatagcctaaattatatacgcattataaaaaggaaatgacagaagactccaatggtagttatattgggtggcaccaaatctcttcccgaaaaaaatttccaaaaagtggtcccaaaaaaagaaaaagtccgttttacctaccaatattg

SEQ ID NO: 29062 - DNA, 1374 bp, Heterodera glycines
tgaaaatggccaacggaaaaaattcaaattcgacatcacctccgtattccatcgataaaacgactacggtagcgaaggatgataatgtaaataatgccgaagcagatgatgtcaatgaactacaaaattcaatgagcaaaaccacttcggtagagatggataaagacgatgatggaaatagtgcggcatcggacactgacaatgtagtacagcaaatttcaaactcgtcaccatcgtattccatggaaaaaacgaatactgtagagacggatgctgttgagaatgatgatgacgaaagtaatgcggcagcggaaactgacgatgtagtaccgtattccatggacaaaacgacgacggtagcgacggatgataatgagagttacgccgaagcgaatgatgctaatgaaccaccatactcaatgaacaaaaccattacggtagagatggataaagacgatgatggaaatagtacggcatcggacactgacaatgtagtacagcaaatttcaaactcgtcaccaccgtattccatggaaaaaacgaatactgtagagacggatgatgatgaaaatgggcagcaagagaatggtggaaatgcaaatggtggtagaaaacagaacacatcatccataagcatcagcagcagcagaagaattacaacacacaatgaatttgatgatgaattacagaacatccaaaagtcgaatggttgcgataccaatgagaatggagataataatgatggaatacggtatgaaaaaaagagttggatgacaactgagaaaaaatcttccaatattggtggaacaaatgataatgatgatgacggaaatgatggacggaagaggaagagcaaatggacaaaaaaggcatggaaatggaggaatgaagatgatgatgaagaggaggaagatgatgacgaaaatgaacaggaggaagaagaagaaattgttcagcgcaaaacaggtattagaaaaaagtgaaaatttaaattttcgaaatttagtaagccaagaaaaatgaaaaaatgggataaccgggattagaaattttttaaatcttcaaatgtgtataggattagaaaaattagaaaattgggaaaaagtgaaaaactttatactgaaagttagaattttaattgtgaattagcagggaatagatgttgaaatttataaaaaaaatttttttttgtcagaaatttccgaaaaaaatgatggaagaaaatggaagaaatcatggcaaatgtcttgggaagaagaaaatgatgaagatgaagaggaggaggaggaggaggaaaattataatgggaagaaggaggaagatgatgaagaagaaatgtttgaagagaacggtacaaaattaatgtttaataat

SEQ ID NO: 29063 - DNA, 1075 bp, Heterodera glycines
  misc_feature (1001)..(1001): n is a, c, g, or t
gtcacgaatgtcgaattttcggtcagtagttacccgaacacatgattttggcattttggaaggcaaaattgcaattagttcttccccttttataggaaaaggacgaatttgggatggaagtgcggcgcaacggacggccaatgcccgtggagtatttactcgtcgacgtcccctgcggcgtccgtttgcaagaagtgcacaaattcactgttccggagtcagccgacgaaacgtttcccatcgaaaatcgcacaatcgtcgaccaacaccaggcgagagattccattagtttagttttgctccatgaaatttttgtagaatttgcgcgacttggccaagtacgtcagtgcctttgacttgcccgatcagtttctcaccatggcctccgacttccatttcctcctctttctgttcaccaaccatcacgtggaattcagcgtggccgagttgaagtcgctggtggcgtcggtgcgcaaaagcgacgcccaaggggcgaaagaatgggcagagcgaagtgaaaattggggcacgttgcttttgctgagtcaaagcggaggtaagtgaccgacagaggccgacgcggttaatagtgccgatggtacccccccccctttttgaaaaaagaaatttttttcgagaaaagattgtatcaggggttttaagggctgcagaatccaaatctgacattattttcgacctattcgaaccccgaacccgggttcgggcaaaaagtcgaaaattcaaattttcgatttcgcattttttgtctaaaaatggtttaaatgatctttaaccctgaaactatctttaagggatcggcggacattcgccgaccgcaccagtcagcgaaagtgacgccggcagttggaactgtcaacactgcacaatgctaaacccacggcagagaaacgattgttcggtgtgcggcctgcccaaagcaaactaacattgaacgcgggatgaaaagatcgatcacaatgatcgctcggattatatgctgnggtatcgcgtgaatattatagtttcgggtccaaaacaacggagccatttcccagcaactggccacaacacctca

SEQ ID NO: 29064 - DNA, 1398 bp, Heterodera glycines
atgtgtgtttataccgcatcttctaattcatatgtattattatatgtgattatactattccttatacaatttaacattaaaaaaatactattataaatataatatgtctcggacctgaatgccatcgttaattggtgccgacggagagcaatatctgtagggtatagcgccttcgccaggcaccggcacaagttgtggaggacaatctaagttaattttttcctaatatttactgaaaatgaaataatttcataatgaaaatgaatgtatggcactataaatgtttttttcaatttatgatattaaaaagaacgttataacgatttctatttaaaaaaatctctatttaatatattaggaaaatgaattagggtatttgaaattgataattattctaaaattcattcacttaattaacattgatataatcattttcctatatgtcacctatttactgtttttgtctatgcttacaaaacatggcataactttgattaaaggcaatcaaattttacattcttggtacctttcgatagcccatctttttctctattagcttgcttaagttcaaataaaattaccaaatttaacatagttatggcagaaatagtactttttttcatgcaacttttccaaagttgaccaatttttttttgaattatgcaggctaatagagaaaaaacttggctatcgaatgataccaagaatgtaaaatttgattacctttaagcaaaagttatgtcatttttcgtcgaaaaactaaattggcggatttatcaaacgacctagcaccacatttttccatacatcccgtgtcgatgctgctttccggcgaacggcaacaataaaacgcgttcactgatgacgttgtagtggaaaaccaacagaagaaatttccaggacaagagccatccacgtctatcagaaaaacatttcattttgtttcgcataagactgcgattttattgttttgagcgaaattaaattctctgacattttaattaataccaattatttttaatgcttcagaagaggcaaataaatatgtgcacatacctatgttcaaattctgggcatttcgcccttattccggcatttttgaagaattaattaccaaaattcaattaaaaaatgcaccgattatgtccgacctcttaaaaaattcttcaaaaacttggaaaaagcaacaaaaattttgagatttttggacaaaatacaattaaaaattctttttaatgattgaactaaaaatgaaaaacaagttgaaagttgaattttgtaattaaactctttttttattaaaaaaaaaatgaatttaaaattcttttgtaattaaaatatatcacttggagtgcaatgcataggctgtagtgacaatgcggaaatgaacggtgaaga

SEQ ID NO: 29065 - DNA, 1870 bp, Heterodera glycines
ggggacctctagagctattgattccctctcattctttggtcaatttgtcctttgcactgtgcgaatgggagagcagcgtggacgagctgcacccgagcgacccgcgctaccgacgctatatgatggcacggacgatgctattggcacggcatcgacggcgaagcaaaaggaatagggacgaagttgcgagagaggagccgaaggaggaggaaaaagccgaaggggaggacgaaatgaccgagtttggccagaatctgctactgacggacaatgaagaagaagaagggcacacgacgacggcgaaaacgaagcaaaaaaagacggcccaaaggacggaggaacagccgccgcaggggggacggacggtgctgcgaagttggcacaattgggtgggccgataccgaaacagactgaccggcatttcacagtcgggcaagtttttgttgagggggcggggggggcgagtcggaactaggggtaagtaacccgcaagcgaaaaaattgaggaaatgcagaatgatgtcccatttatgatcaagaccaatgcaaaaacagatttaaaatacgacagattaagtcaaaaaatggatttaccaattcagaagtgttttcgacgagaaatcaacgcttcgctgcttcgtatttaaagcccggccagcgctccacgctgaccggccgccttttgagcggggacagggccaccgtccgtttcaaagcttgggaagcgaccaggcaattaatcaattgtttgattggcatcattaaatgcctgaatgcttattaggtctctccaattgcgagtgtgctgtgatcggactgatcgagaagagaattgtgtgtttgccaccgaattgggcgtgaagcgttcgagccgaaaatggacggactatttggccacgtgtccccagggcacaaaaaaggtcaaatttcttttgcatttttctaaggcatcagctgggtgtttgccattattcattcatttgataattaatttcagatcattttcgagtgtagcaaccagggacccttcccaggggcgtgcggagtggacaacattcagctggtcaatgcttactggccatccggtacttcgatgaaagcaaaccgaaaattataaaaaaaagaaaagtgaaatatttaccggtggtaccaaatatggtaattattggttaattgctacaaaaatccaagatattaaatgcataagtgataacaattaaaattccaaagcttctatttatagttttcgtttgtgaatcataaattaattttttgagtatttgtctgtattacgccactgtcccctattttggagaaattctctaatttggagacatttttcattaaataaaattttccaagatacaactaattagtaagtataatttgttttcctgtcggtccacaattttcaaaccataaaggacaaaacaaattgccggggtcaaagaatggcggcgatgacactcaaatggcacccacacatttgctgctgttcatgggccaatttattctgtgtgatttctgtttcattactcattcattcattcgtcattaatgatttctctgagtcattgctaagaaacaaatgaaaaatggaaaaacggacgttattttattttattaactaacaagcctttcaaatgggaagcaaaaagcacaacaaattaacggtaaatgaacggcaaaagtaaatttaacttactttttaatttagacacttttatttgctctaataacttttacgattgtaacttctcagaatgcgacaaatgtaggaaaaatatcattcagacattttttaaatatatttaattaaaatatattgaatttgtctaagggcagtgacagtaattgtccatcattgttt

SEQ ID NO: 29066 - DNA, 2101 bp, Heterodera glycines
  misc_feature (73)..(73): n is a, c, g, or t
  misc_feature (81)..(81): n is a, c, g, or t
  misc_feature (2078)..(2078): n is a, c, g, or t
  misc_feature (2085)..(2085): n is a, c, g, or t
cagcgtgcttacggtagagaaaaaaaaaaattttcctacagtatttttcgcaaattttccatataaattttgnaaaatttntaatattataaaatatttaaattaacagttgtccttgcccgcatccgattgaaagcaacaattttgctacctcatgtgtcgtttctgagcgaggtagccttgtaaagattttttttttgagaatttcttatcccctatcgcacgctttaggcattctgcaacactgcgcgtgccgtgagggctacgcgggcgaacgctgcgagctgtgcgcgcctggattttttggcgacccattggtgccaaacggcgagtgtaaacgctgtgattgtaacaacaacaacgacctgagcaatcctggtaaaatttttattttttaaaagaattttttaaattttttcaaccctcaggcgcttgcaatccgcggactggcgactgcgcgctgtgcgaaggcaacacggacgggcgccactgcgagtactgtaaagcatggtaagtacggtggataaagtacggtcgatgtgaaaatttattaaaatttttaaaatcaagactaagttttcataaaaaataatttatgctcaagagctttcgaattttcctagaaatttttctgcaaaacttttagtcattaattttaaaatcgtaaatttctccataaaaaacgaaaaaaatttcaggaattttcaaattaaaaaatatttcaatttctttttagctaacttcaaaatttcttacccttaataaaaaatctaaaaaaatttaatgtaattttttcaataggtattggggagacgcggtgcatgcaaagaattgttcgttgtgcgcgtgcaaccaatgcggcgccgcgtactgcgatgggcaaaacgcgcactgcgagtgccagccccgtgtgaccggtccattgtgcgatcgctgtgaagaaaatgcatggggctttgactcgtgcaagggctgcacgccgtgccagtgcgggttggccgcgtccaactcgcagtgcgacctgaagaacggccaatgcgcgtgcatgcctggtgcaggtgcagccaacaaaaaaaaaactatttttggaaattttttttttatacgaaaattttcaaaagctggccaattttgtgatcaatgtgcgcatggcttttggaaatatggggcccatgggtgccaaaaatgtgactgtgaagcggacttgtccatgggcacggtgtgcgatgtgcagacgggccaatgccattgccaggagggggcaaccggtgggcgaatgttgttgaaaaaattgaaaataaatatttaaaaataattaattttattttttatttttttctgtttttgggcaaacattttctataattaaatattttttattggattttatattcaaattattttattaaatatttttgtcatattattttattaatttaaatgttaataaaatattgttttataagttactataactatatatttttttaaaatgcaaaacttttttaaatggttgggcaagtattattttaaataatttttaaacaaataattatttttaaattaattctacactaaaatatttttgcgttaataatttttaatttttgaaaatatatttatttatttatttttttttaatgttgaataaaactaaaaaaaacattttctattcttttaaaagaaaaaatatgtagtaaaataatttattttttggtgttaaggtcctcgctgtgacaaatgtctaccagggtatttgcgtgtgccaaactttgggtgccgtttctgcgacgaatgcgtttatgctttggtaattttttttttttcaaatttcaaaagaattatcgtttttttcaaaaaattacacattcattattaaaggattttaattttttaaataaaatttctctgcattttcgaaacaaaaaaaaagtccccaaattatttgcctagaattaggtttctacaatcaaaaattctcaatttttcataactaaaatttcaaaaaaatatattctcagctactctacctgtaattttatgtgattttaatgattctttaacaaaaaatttcccangctccangcactgatgcgatgaa

SEQ ID NO: 29067 - DNA, 1339 bp, Heterodera glycines
aaaaaaaagcgaaatgcgaaaaagtaaaatatgcgaaaatgcgaagggcgaaatgcgaaagcgaaatttttttctgcaacttttttaatagttaaaatcataaagcaaaaaattattttttttaattttattccaaatttaaaaatcaataaaccgcttttttgaggcgtgctttttccaaaaaaactttttgggaagagggggcaggccgtcgcggcaggtgccgccgggaaaatttgattaaaatttgttgacagattttcactaaaaaatgatcaaattttgtgatttttatcatttttctaatgagaaatgagttttggggcgccgctgagaacagtttttcatcaaattaccaaattttgcgattttgggccattttctaagaaaaaataggagttttgggggcgcggcggtgccgataggcgccgccggggaaaaaattggaaattttgatcatttataaacaggttttcactgaaaattaatttccaataatgaacaattaaacaacggggatattttatttatacttgtagttaacaattaaattttttttaaacaaataaaaaatattaaaagtaatcatttgtaaataaatctcaataaaaattttgaaattttttcagctatgcctattcaaaaatattcttttggatgaatttcacatgaatttattttggtgacataaaaacatataaaaatatttatgatttctatttccgctttattttaagttttggagggtaatcatcacaagtaaaagcagtgtaaagcaaaaaataaaaaaataaattaccccatttaattacttcattcattcatttgcttggaggaagccacgccatatgtttttgtatataatataatttacatataatatatgcgcatatgtggatatattctagcaatcttttataaaaataaataaaaatatccatattattattattataacatgtaaaaacccacaaaaataatgcataaaaaaagccataaatttattattattatattcaacacattgcttctttttcattcatttttcttatttagtctctcaaatcaaaccaaacaaaaacaaaaaaatgcttaataattttattttctgcgcttttttcctctgctttttgcatcgttttccacttggttctgctgctaatgatgaaattgatgaagcaatgcccgggtttggtgaagaaaatgctgaagaaccaaaggcaagcggagcaattccgacggacaaaaaagccgaaaaagaaacatttgcaagtaaaaaaccacagaaaatggccagaaaaatggcacgcctccaaaagttcgcttcacttgttgagtt

SEQ ID NO: 29068 - DNA, 1608 bp, Heterodera glycines
tgaaattgcgcacgtcgctaagaattgtggaaatgaactgctgtaaaagcgcatcagcaatttgggcgaaggagaccagcaaaacgtcacaagccttaaaatgaacaaataatggaaatattgctctgtttttattttattcaatatttccatcaatatatttttttcgtaagtattatttaaatatttttggcatttcgcattaatattgattgcactaacagcgcttttgtgcggcacaaattccaatcgcacaaattttgtgttcagtgcggccatttcttcggcgcaaaactgaggcatccgatcacgaaattggcgacgcttaaagaacaaaatctgttagtggaaattgtttaatcttaatttttaatccgcgactttgtttgctcgaaatgcctttggaagaggctcgagagtttcgttctcgacttgagacaattttagttttttcattacttttttatttaatttttttttgctcacaatttttcggaatggcaaatgcgccacgaaacgtttttgatcaagcagtaaaactatttgtatggaaacgaagccattatcgttgggctgcacaaagaaatgggcgagtaaaaattcatcggggcctttttgatagtttcgaggaccaagtggcaatttgtaaagaggcatactcttgttgaacttgcaataacgaccttcgaggttctaggaaaagttgaacacatttaactattaattttaaaaataacaaataattaagcatttaattttgaaaaaaaaattataaaataaataaatcatttaattattattttttcatagctattccataaaattcaatttttcatttaaagattaaatcgcattagctttaaaaatgtacatataaaagataatattcatttggtggactcccttttacacagggctcgcagatgaaaattttcaaaagcctcatttggcaagaaaaaaagcctcatttttacaaatttattcaaaacacgtttaaactgttcaaatattctatttttaattgtccatgatcaatttgagcaattttttgtagaactaggtaaacattttgggaaattctaagctttaaaagcgaagttgatttttttgcgccgctttttccaaaaaaaaaacttgggaaagggggaggccggcggtgccgatagacgccgacgggaaaaattttgtgatttttaatacgatttgttaacagatttgtccacaaaaatggccaaattttacggttttgagcaaatttttaagaaagaaaaattaagaattttgactatatttttagctgattttcattgaaaaaaattcttaattttgtgaattttcggaaaagaattggttattttctagtttttatcctatcaaaaaaccacaaagtgaggctaaagcctcacatctgcgagagtgaaaaaagccgacaataattggtcaaacgcatcaaaacacacgacgacacgaaagtcttcactgtcattctcaatcattccttaaaaaaatttgaacttcgcaaaagggagcatgcgaagacggagcaagtagtggggcgagacggagggcagaggaagcagtctgacgagcgccgcaggcggttgactg

SEQ ID NO: 29069 - DNA, 566 bp, Heterodera glycines
ttaagacagttttcggcacttttacacttacctgtagctttattttctttaaaaaagagaaaagaaataaagaagtcaaagacatgacgggccaggacgttttcgtaccgccgttttcgtaccggagacttttcgtaccgccgttttcgtaccggagacttttcgtaccgccgttttcgtaccggagacttttcgtaccgccgttttcgtacgagttgatttgcaaaaaaaattgcattcaaataatttttttaatctttaagtaattacttttaatgttttgacaatttaagctttttcagtaacgatggacttaacaatattgtccctcaaaatgatcacaattatgccaaagcctatgtaatcccgaaaaccttaacaattttctccgtgtatttcccgaaactatgagatgcgaccttattttgtcccggaattttgttatttttgttagatttatgaattttcgacattatattttatgaatgggaaataaaaatgataaatttttggatctattagctctgtatgttttctaatcgaatctgacgcttgtaccagaactc

SEQ ID NO: 29070 - DNA, 892 bp, Heterodera glycines
ccagtggcggcagaagtccattcccatcgcacattgtcgccacgttttagagtcgaagtggaggacaacgatgactgacaaattaacgagaaatgaatttgcattgttataaatttaaaaaagggattaaaaaaattcataaaaattaattttaactccgtttttaccattggaaagaaagtggaaccaccggatgatctctgctcgagtgaagaggcggaagataacaggggggacatattttgttgaacaccgccaaaacgatcatcaccagcaaacggcgagccaattttactgcgtttgggtgggggtgagccagaaatggagtgcccatttgacgggccaatacttaaaaaatggtggggtgcgctgactgattttgtgagccacacgcattccaaacagcaaaaattgcattgccattcatttccaaaaaaccaattgccaaaatcggtcaaaactcggcctgatttcgaatttgggtctcaaatgtcgactctttgaaaattttataccaatgaacaaccgcagcgttcgacttgaagggattttaagaaaatgatatgccaaaaaaaggtgtcataacaactcgcacaaaaggcaattcatacattattgttttttgttgatttgaaaaaaatcaaattaaaaaaaattcatttgatttttttaacaaaaattgtacgaattgccattgccaagatgcggattggttgctgtttgtgagggggggagggaagggaaacaacaccttttggcaggcgacgaccactgctgggaggaggacggactctttccgccgctgccgcgatcccatcggtcgagcgaagcgggaccatgcttggcggagaaaccgccaccatctttttctgccaatttttgctgaaatttg

SEQ ID NO: 29071 - DNA, 813 bp, Heterodera glycines
aaacaaaatacccataaaaattagtcatcatttattattattatttttactattattattattaaatcatattcatacaaattattttaattattccaaataattgctcattttcttaaaatgtaggtgatatcagaaaagcaattatttgaaggccatggaattcatccctgcttccactcatgtacttttcactgtaaataagcgaacttaaatactgttttagcgttatgagtcatttaatttaacacctgctgctggagtggagaggtttagtgttaccgtaatctacatgatactgaatatattataaatcccgtacccctcgcaaaattaaattcaacgcatttaaaaaccaaaaaagatttaagttgtttagggatcattaagataatgggggggggggggaattaaatgaaaaaaatggggggagcagccgctgatgctttttaagttccgcgaaaactcaaactgtgagaatcattcatttgcgtcacaaaatcataaggggctgtggggagcacgacgatttaaaaatgaacagtttttcaacctcctcagaaagggggggggggataattagacacggggggataaatggagaaggggggattattcttcgacagatttattttagtaaaatttttgaaaatttttgaacatgtcgccaaaaaatatcatcgagtcaaagaaaaaccatttttattgcattttttataagaaattctgctttttctagtttttcaactatctataatgcacaaaaaaacacattctttttcaaaaaattttgttttagcgccacttttcatc

SEQ ID NO: 29072 - DNA, 762 bp, Heterodera glycines
  misc_feature (633)..(633): n is a, c, g, or t
aattcaaaattacagtgcaattcgtatgctgctggaaaagtcgcccagcttgctgcatgaacgggacccgacaaacggaaacacggtaaaaacgaaatcgcaaaaaaaaaatttctggttgccttaaaaattttgatttttttttcgatcccattttggcattcttcatttaaaccaatttattcttcaactgtgtgctttttcgaccaaaattatttgatttagttgacataacttaaaaatctcgtttttatggcaaaaaaaaaaaatttttttttcccagtcgtcaattacaatttccgattgccaaaccgtttaagacttacggaattccgatgcccaaaaaatgcatcttccatccgttcttaattttttcaaaaaatttctaccccaaaacagtgtttgcatgcagccaaccagaaggcctcgttgatgagcttgcttcagctgaagcacaatgagttggacctgaacgcccggaacaatgccggcttcactccgttgcatttgttcgtgatgcgtgaagaccttggtaagaacggacggaataaatgagagcaaaattggcacccaaatttttgttttttcccaaattttgaccgtccctgcccctgtcaccattccattcggttncactgccctgatacaaatgagagacgaaaacgcgggatttttatcaaatttgttgtgctttcggtgactttcggtggcgctgatcatgaatatgacattaatttcaacccatgtagaacccctgagtcg

SEQ ID NO: 29073 - DNA, 972 bp, Heterodera glycines
ttcagaaaggcccaaatcaataaattcctcagcaaacttcttgagttcttgagagctcaggtcgtgtttcaagcgacgccaatcgcagcgcaaaacactcgcgcctccgtttgagtgcgtttcaatgtgtataaaccttcgaaactaaattaaaattaccaataaaatataatttttcgtctatttaccctttcggaaatttttggcaatttgtttgtttcccgctttcttctgccttggttttttgaacattctgtttctgagtgcttcgcttcattgcaaattggaatgtttgtgtcgttcagtgggaattcttcgttatctctataaatataaaaatatgaaggcaaaagaatttttgaaattttcattatttcttttgcaatgttatgaaataatttatagaatttacagattaataaataacagaagctgaataaagggaaaacaattgtaccgcagagtccgttggctgttggtttcggcttcaaaattggacagctcatttttagcttcctttgtgagtgctgatggaagtggagatttggaagcatccgaaaaagacgccgatacttttggtatagtaaatggaatgggaaattttgtgtccgatgcaacctgacataagtttaaaattgaaatttcattttgttcaattaattacttgagggtgcacagaatttgatgtagcgtcacttttcttgtcacttttgttgcaatttgaagtgtttccattcggtctttgtgcgtttgaattgtcacttttgtgcccggtcaaaacagaatgttccatctttttgcctgacattgcgttctggtcacaatcggtcttctttgttccgcttttttttaatttcttcatttgtcgtgtgttgtcttgttcttcgtcatttaattttcgcttttcactttttttgtttgctttttgcagatccatcaaaattggatcagtcgcaagaaacatttcagctg

SEQ ID NO: 29074 - DNA, 802 bp, Heterodera glycines
actgatgtcgatacaatgaaaaagaattcgacccttcaaactcctgtttttatgggctcaagaattgatgaaataaagaaaaaggtaaccgacaccccacttaaaaatcaaatatcttttttaaaatcagtttcttcttgaattggaagaaaaacaacagaaaatcgttcgcttggaggcgaaacttttggcagcagaaactgagatcgattcgtttgatcagttggagggtggcccacccatctctccctggtctttcctttatttgcccttttatagaagaaatgcttgcagagaatttcaaattgcaaagggagcttcttaaaatcaaagtccgtttcggtttgattactattgaaaatgcgttcaaagcgctcggctgttgcgacaaagaaattctggaggagattaaagccgcggcctgtcagtgattcgatttaacattgtcttatatttcatcagatctatttgtgttaccgattatccgtacaagtacatggtaatcgtacgctttactggtcccacaaaaaaaaaaaaggaatttccaactttgtggtgcaattgtggggttttcgggggcggtgatcacgaatatgacctccatttagacctatttcgaatctcgaacaaaagtcgaaaattaataaatttattttttcgacttttgttcgaattcgagtccggggttcagaattgaccaaaaatggtgttagattcgtgattagcgaccacgaaacccccaggaaaggcgtttttgaaaagtaatttttaattttataaaaaaattgttcgaattcgcggg

SEQ ID NO: 29075 - DNA, 1259 bp, Heterodera glycines
ttcatattttgctgatttatgaagcagaaagtgacaggtttgttgtcaatgatcctgaattccaatttagaaagaaaacccgacgaaataaccaatggtgttggtagttgagcttcattccacgctgaagcaaccgcaatttttcttggtgtgatttgtccgaacttttgtaatccttctcacaaaggtacgaacactgtttgttttctttgaaatttatctgaaataatggcaatggttaaattgttttttaaaacagaaaacctcatagggacttggcctaatccgttcaccgaacaaaacctgacccaagttttcgacaggcgactcttgctcactaccaatacaaaagtcgaagctgtaaccaaatcgctataaagaatatccattggaattaatttgcctgtggtattcatatgggatgacggattgatcactgtcaagtttgtttacgaacaaagtcactttattctgtaaaagatggaggcagattgtcaatggatgggtaaaacttaccaggcaagtgggctttttatcctttccctcacaaaagttcacaggcgctaaacctggcaaatagaaagacctcgctgaaggaataaatacagcaaagaaaagtaatattcgcaaattcataatttgcttcctaaaaattaatattattaacttttttgtagtttaactattgttctaatttgtaataataaaaacacaaaataagaaaaacagtgtgtcgaaaagaaagggcgaggggggggggggatgaatgcgagcattagtaacagccaaaaggcaaaagcaatccacgacacaacaatgacaacgacaacacaaaccaccgctttttcccaatgcttttttggcatgttgttttttttaatttattctttttcgaatcgaattttttttttcaatttgtcgtctgaagacttaatacgatcgttgtaacgtcttggaaaaaatgtcagatgtcatatattgtttcaatttacaaccaaccatcgtatatccgccgacattgtatatgtatgtatatatgacgaaacgaagggaaaaaattgttgtaaattcatccgtactctcaaccagggatggggatggcattccgatttccgacgttttttggctcggaattccgacttccgaaattttttgggacttggaattccgatttctgaaaaattttggggccttggccattcctggtgcagatttgatgcattttgagctcaagattgattaaatttgagctaacaaat

SEQ ID NO: 29076 - DNA, 759 bp, Heterodera glycines
tcttcagtttctcttctgtgatcgttagtcgccgcccgtttattcaacaaaaaactgtcattgcgtcccgaacgactcgcgcgctcagagaaagagaaagcctcgggcattttccgtctccctctgcgtctctgcttccagtcaggcgattattattaaatttttctgtttcgcgcaaccctcgggggcggtttcgtcggttgtacgatcgcccgtgttttccatgcctttcatcccacccactcgaccattaacttcttcgtcccccccgtccgtcgtccatttcgtgtttttggcctttctctctcacccagacgataggcactttttagcgctgctgctgctatcattagtgaataatttggtgtaaaatgttttgggttacattcgctggattttggcgagttccgaggggagcgatcacttcagaagctgggaaatgaaccagaattggattggattgggcggaatgaaccatgtgcttattgctcagcccgaaaaagcatttggcggaataaatctgtccctccccgctcctccggcggacgttcacagcccaacagcggcgaaaggtttgcaccagcagcagaagaagcttttccccgtgcgcaattcgtttcccccgcccggtccaactcggcttttcccccaatcccccgtttatgagaagccaatgcttctgcagcattcagatgtttggagtgatgaatgtggtgcggatcaatccgatcccccccaatccctcaccgcttcgcgttc

SEQ ID NO: 29077 - DNA, 1603 bp, Heterodera glycines
ataaattcttagttttcttaactcgaaatcaaaattttggtttttttagacaaaatctgttaaaactccaccgcgctaaatctattgctaatttcaacattattttttttcattttcaatattccttttcaacatttaatccatcctcctatctatccatctcgtgcacaccctcaataacatcccagcaaatcctaccaaatcccccgcgggaatcgattcaattttatatcccatcccaatccaccagtgtcatcctcctctccttttaaacatttggatgcttctgtctgcttagtagatttgcgcttgcattcgtcggcattagtagatggagttactaattgattcccattctcattcaaattagtgtccggacaatccgtcattggacaattcgtcaaatacttttttcgcaaaaatcaaactaaagaaaataattattttgattgattgtccattgacgaattttccattaattgattttcttggaaccattcaaattttgataattttaatttgcgtcaggaaagaaccaattctgccggacgggatcggtatcccgcgggattgtatcgggatcccgccctcgggatccatcccgaacccttttaaattcaatgagatcccgagtcgcctatccttccctaccattttgccaatcccatgggatcccgcgtgatttgagtcattacatttttcgaatacaccattttctaattaagatcttgcacattcaaatacaatttactttttcatttgctaattatcttaaccaattccttaaaaattccaaaaattttacacggaaacgcctatcgcaccgccattcaccccaccaataaaagcaaattttcggcccaaaaagttggccatttatgaagatctgttaaaataactaaatttcaaaatttacctggcagatcctaagaaattttggtgcttttacaatctctcaaaaaacaagggaaaaacccatatataaattgtatgaaattcccttttcaggttttccggatgaagttaaaattattaaaatttttttttacaatttattttacaattccttgcacaacggctaatgatgaaggaaaaccgcaaaaaagacaaggtatacaataataattattattattatcaattaaatttaatcattacgaattattaaattgccaaattaagccccatttgatgagcttatcagcggagcattgcaattagtgcggcccatttttggcactgctgcgcgacaatttgctaccagcagcaaaattgattcttcaaaagagcagcagaggggaaaccgaatcaaagtagaaaaataaatttatgtcataaattaattttaaaaaaagaaaaattcaacaatgaaggctcgcacattctcacttaccgttaaaagagtgaattaatatttttttgaatttaaattcctctgacgtaaatgttataaatgccgaaaggctgctaatctatctgctgatctggaaattttatctagcattgttgcattatgccgcttaactaatttgtgcgcggttgtgttaaatttgcgcgccataattttacttgttcaaatttttttgtctgttacttagaacta

SEQ ID NO: 29078 - DNA, 1171 bp, Heterodera glycines
atttttatctcttaatattttgtgtgtggtcaatggcctactatgtcttcctgtcgtttttttgaaaattgatttttccttttatgttaatccccaaaccaaagtgttttttaaatttccgcaactaataataattgtaatattttttaaaatgcaaaattgtaacaagtttttgagagagaattggaaaccaaagggaaaggcgaaattagtggaggtgctttcagcatgtggccaaagcccaggcgggcacaacaaccccaaacgatttgatcagctggcacattatctaaaaaaagtttcggcattagataataaaaagaggagatattggtgttatacttatcgcggacaacggcacacgtgaaatgcgcggagtagaaaaatctggttatttattggttttatttattttggttaacaactaaccgttctcattgattgctgctcctccctcaactgaacccttgactccattggctccattcgaagcggaagttgatgctgttgcgcctatagccattcgatggcgacgagctctctcctcgaaacgttgcccgagtagagtagcagctgccatcggaatatagcggaggtggaaatttccgcgtccagcatggttcttaacaaaataagtatttttcatataaaaatttaaactgctcagaggtttagaataaaaattacattcgatgtgaagcattccaatgttcgatgtgcgcgattctgtaacacacagccatttgatctatcaactgcgatcgcaagttgaagatgatgcggttctgatcactgaacattcttgtaactcctgaatggcatcagaagtgcgggcggacattttgatcagttgattaatggattcttattcatttttttttaattgaaaataagcaattataaaatgacaaatttaaacatattaaaagcccactgaatgagcaaccatagctattgctctactcaagaattattctcgccgttcgttacgccctcaaagacccaaagccttccatatttgcaacaatcatcaaatcttctgaaatttcaaaggcgaccaatagaggaaagtacttgatctgttaatccgcaatctcttttatcattccgcaattaacgccaaccctgagtctaatgcaaatattgttttgctgatggaactcgtgaattc

SEQ ID NO: 29079 - DNA, 829 bp, Heterodera glycines
  misc_feature (823)..(823): n is a, c, g, or t
cgatattccctactaaaatttatttaaaaataatccttttttcaaatatttataacacctcgtaaagtataaaattcccccatttgatgccgcaccaatgagcaaaggaattccagtgatcgcttgtccgaaccaagcagtgatcggagaagagattgagggcctaattaacatggcataaagtgccgaaataaaatatccaccaatgttaacgatgataatgcatgaaagtgcacgaaaagtacgataattaatctgatcaactgagggtaaacctaaaatattccttaattaattaattttttattaatttgctggccacctgctgatttaatttttatcactattccaacaaacaaataaataatcatagtcattaaagtgaagcaaaagtaaattgcgatttgatgattaggatgcttaaaggaatattgctgctttcattttataataaaagattgttttttaaaaaaaccatgaaaaaatcgatgtaatgtccagtgaccatctgatcaccatacaattcaatattctgataaaaagtgaaacataaatctatacagaaaatagagcaaatcaatgttatcgtagtcaaatacagtcggattttgcgtttattttgcctgtaaaatttaatataaatggtgattttttgtctattttttacatttcatcaaaaaatatgacaattagtcggtcaatggcagtgaacaacattgccggattaattccacctgcatttaaatatattttaaatatatatatatatatttatctataattttagctgtataaattacctaatccaatcaaaggaattaantaaaat

SEQ ID NO: 29080 - DNA, 844 bp, Heterodera glycines
  misc_feature (681)..(681): n is a, c, g, or t
attattaaaaggaagcattggattaattatgtcatttcctctcattatgaccataaatgtaactgttagtgcaaataaccttatgaaaaatatttacaaagttaaagataaatgcacaaaatgtgatttcaaatgtggtcttaaaggaatagaacttactataccagattttatagaaaagttcgaaatttgctgtatgggaagatgccaaacaaaatcttacgcaaagaaattcaccttttatttagaaaaacataaacttttggctgaacattactgttcggtaacatattggtcaaaaaaagaaaaatatttataaaaaacactttgtgtgccaaccaattgaagaatgcactttaataaattgctggttttgtttagaaaagttagtaaacccagaatgtatgttgctggaaacccgaattttaatgggaattgggctggcctgcattttggcggttattttttgcgtaatcacaaatattttaaaattaatacaaagtttatggtggcttataaaaattgtattctttggtccttatttgggaattaaattcgtatgcaattttaaaaattataaaactaatgaggatgagttacaaaaaggactattgaaagaattaaataaagatgacaaagaaaaggttcaaaaaagacgaaatcgaagattgtacaaattgngtagcattactttgatgatttttctcattatcaatacaattgtcgaaataacggaaggagcagcagaaattgtcgtaatacaatcgaattctgaagattgtgaaaggaagtcaaatggatcagtatgcagaatacgccgaacagcagaattaactatattacc

SEQ ID NO: 29081 - DNA, 881 bp, Heterodera glycines
catgtcttcatctatcggctcgtccgccgagcacactcctcactaggtgtagccggggcccggtgttgaaccgccgcccctactgctgccgccgacgtcgagcatggcggagtccttgaaaaacaatttaaattgagaaaaatgtattttattgttttattcggattggtggcaaagggagcggaacaaaatgtcgccacaaaaaaaaataaaaaaatttctttaataatttcataatccaaaacctaaatggtgttactgaaaaaaaaatttgcaaaatttcaagaacacaaaaaaaaatctgaaatttttttgggtacttttcggttatgcggccacacccctccaaattttaaaaaagaaaaaaaaaggcgccaatggtagcgcgcacaattgtttatgtggcataaaagtcgttatttgagccaaaatgtcaacgaaagcatcatcattatgctaattgcagtcgttgtcaaaggtaagtaaaaaatttcccattaaatggtacaaaatttgcccaaaaattgaggaggacatgttgggaaatttcaaatgaaaatttttcatcattcccaacaaaaattgctgaaaatttaccgaaaatttggcccctttctccagcaacaggtccaactcctcctcctcctcgtcgtcctcatcgttccgccgtcgttcactgccgaacacgtccgcctcgtcgtcgtcctcgtcgaacatgtccgactgacgccgcgggggacacggctcctccaacggcaccgccgccgccgcaagcgctgacgacgaagacgatgaagacaattgggcagcaagggcctggaaagtaaatgaagttttggattttttttaattttaactgccaatagaacccctcccccctc

SEQ ID NO: 29082 - DNA, 1262 bp, Heterodera glycines
  misc_feature (112)..(112): n is a, c, g, or t
  misc_feature (118)..(119): n is a, c, g, or t
  misc_feature (121)..(121): n is a, c, g, or t
  misc_feature (136)..(137): n is a, c, g, or t
  misc_feature (139)..(139): n is a, c, g, or t
  misc_feature (143)..(143): n is a, c, g, or t
  misc_feature (146)..(150): n is a, c, g, or t
  misc_feature (155)..(155): n is a, c, g, or t
  misc_feature (161)..(162): n is a, c, g, or t
  misc_feature (167)..(167): n is a, c, g, or t
  misc_feature (1258)..(1258): n is a, c, g, or t
cccataatttacttttatacaaattgggaaaaaattggtcccccaggtaaacttttaatgtggataaaggggtttttgagcttaggacttttcgagttaaaattggggattntttatnntnaagtaaaaaagttanntntggngtnnnnnagggntctgtnntgggncctttattatttttgatttatattaacgatcttcctgatgccttgccatcaggagtgaaaataaaattatatgctgatgatttgttataaagcaagagccgacacagaaattatgcataaagcattgcataatttattcgaatgggcaaataaatggcagatcagaatctcaatttaaaaaacttttgtattatatttgggttcaaaaaacccaaaagaaacatacaaatttgatgggaatacaataaatgctgtggatacaattagggacttaggagtaaatattgacaacaaattacaattttccggtcatgttaaccaaataacaaggaatgcgtatttacgtatgcgttccttgtttcgaataattaaatccaaatcgtctaagatttggattacgttatacaaaacttatattaggcctttattggaatacgctccggaggtttggaatccgtctcttcaaaaaaatattaaacaaatagaaaggtgtcaaaaatatttcaccaaaagggtattttttaaatgcagccttccgccaattccataccaaaatcggttagaatacctgcaactgccaacacttgagaataggcgaaagctgtttgatctgttcatggcgcataaaattgcttatggccgaacagatctgaaactattttctatttttaatccctcaacgcgctttaacatccccttttacagatttaacacaaaatacaaactaggcaaaaaattcattccctttgctgggagggtaacaaaattatggaatcaacttgataaaggaaaaacaaattctttaaatcaatttaaaacaaaacttagaagttcactagggtaatatgtaagaccggaaaagctagaattattaacaaattcctaagtgatttggtatttttatattttgacctcatttgactttgacctcaatttattaatttaattattttcacattgtctttttttaattcctgtgatcatccatatattttgtaacttactctacgacacatttacctgaatagtcgtcagagtaaatggttctcacccttctgatgacttttttatttttacggacaaataaatanatat

SEQ ID NO: 29083 - DNA, 766 bp, Heterodera glycines
  misc_feature (9)..(9): n is a, c, g, or t
  misc_feature (22)..(22): n is a, c, g, or t
tagagtctnttctttaaaaatnttgctcaaaaatcgcaaaatctggcccttcatagtggtgaaaaaatctgttaacagttaacactaaaactttcctaattttctccggcggcgcttatagacaccgccggaccccgcccgccctgttcctaaaaagttttttagaaaaagaaaacgtgccgcaaaaaaaaaaagacaaaaaatttttttttatttaccaattgcacaaaaaaaaataaattgaattgtaaattaaaaagaaataaattataaattactctaatgaatcaagaaacacccctcctaatttgggatttctaacaaaaaaaaaattacccccccccctcttctaccgaagccaagggtctgctggtggttgttacgtatgctcttagctaaagcccaatgaaaccgagactttcacgagaccgagaccccctcgagcagtactacaggcagaaatggcatggcatctataagaaaatgacgtcttcctcgtcctcgttctcgtcctcctcctccccctcatcttcggcacttttgtcaccccattggctttcccgcaatggcatatatccccggcggggttcacagctgcgccttcgcctcctccaaccgttgacggacgatgaggacgaggaggcggcactcatcggctgcaagctgttgctggtggtggcatggctaaaaagaaaaataaatttttgaatttactgtaatcaaatttgtataagaactacagtagggcagcattagaatcagggct

SEQ ID NO: 29084 - DNA, 864 bp, Heterodera glycines
  misc_feature (55)..(55): n is a, c, g, or t
tttttccttaccctaagagctgcagaaattgtgaattctccttcagaaaaatggntccattaccgcaagagctgcggaaattgtgaattaattctcagaaaaatggctatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccgcagagcctcttcaaaattttttccatttaccctaagagttgcggaaattgtgaattaattctcagaaa

SEQ ID NO: 29085 - DNA, 1247 bp, Heterodera glycines
  misc_feature (841)..(841): n is a, c, g, or t
  misc_feature (848)..(849): n is a, c, g, or t
aaaccatgacaatgaatgtcctggattactgtaggctcctttgtgtcccattattccccatttcaatacagtatgcaacagtaacgcctttattacgggaaaggaaatgatacattattaggctctttacccgcttagggctcgggaacagagactgcccagggagagaggctcgttatgaataaagtggtcaagagcaagaccccgggatcgtaataaatcactgctgattttattgctttgattgaattattatttattcgaatattataatatgttttcgtcaaggttttttgtattttatattttacatatattttttgccaggtcaactgatcgccagccatttaaacgcctgtcagagttcagaattttcagttttgtacaaaacccattgcatggttttggcaatcccaaacgtttgttgcttgggtggttaatttccaaaaatcagattacgtgattggtctctttttattacttgaatatttattgcctattagatagtaaaatttcaaaaagttaatgaatttgaggattatagggtgcatttaaatttagggttatagaaatataaacaattgaaaaaaatatttaatccgtgataaaactgttttgttaatatatataatattaataataattagagatcgacattttgaaaatgcctggacctggacctggattccatgttggacctggaccttgatttcctggacaaaaatccagaaaaatccatgtccaggaaaaatccaggctcctcgagacctggatccagacctagatccaggaaaaatccaggcctagatccaggtcaaggtcgatctctaataataatgtntttacannaagaaaattcaaaatccctcaaattggttcccgaattttgaaaaaatcctcgttttttttagtctttcttgggagaggcgaaattgttggctggagaatttcgttcaattcccattcaccaatcataatcatggtatatgtcagggatgttgatcgtttcgtgtttcgtgttcgtatttttcgtattttcgtgtttttaggacgtttcgtgttcgtgtttcgcatttcgcattttattttagtttcgtattattcgtatttcgtattttattttagtttcgtattattcgtatttcgcattttattttagtttcgtattattcgtatttcgcattttattttagtttcgtattattcgtatttcgcattttatttttcgattcgcaacatccctggta

SEQ ID NO: 29086 - DNA, 1315 bp, Heterodera glycines
  misc_feature (52)..(52): n is a, c, g, or t
atttttaaataatgacatagcaccaacaaaaggcatcctccaacaaagtcgntagacaaccaaaaccaagtagaaaattcttctttgtgcttatctgtacttataagtgctccggaattttaggcatttgccaaaaaatacatcactaaaaattataaattattggtaacattcgagagcagtaattactttgtccattggatcgacacactttgtcttgttttctgtcgacattttgtccaaccatgtcgaaattgccaaaaacacctttttatcacttttcccaccctttaagagcaaaaatcgtttcaccacaaatttattcaatttcttatttttcagccgagaattgcttttttcatcgcgattttctcgaaaaaatgtcttgtgcatttgtgcttatttctaagatttggtgttatttttgttaggtgtgcttatttttgcgatctccgaaaaaattatttttgtgaaacaaaaacaaaaaaaataaattgttttccttgattttattagaaaaacatataaaaattaaaaacaaaaagaaatatttaaaataaattactatttcatacctaaatttaaaaatttatgtgatttttttttcatttttaacagttttggcaccaaaaatggtaattttagtgaaataaaaaaagaaaaatcccagaaaaatttacggcattccaaagtgaaatttcgccattaatttgcagtttttcctgcccaaagatttcgcacaagaattgttgatcaatttgcaaaaaatcatttgttctgagcagagtttccacctttgtatcaatataatccaaacaacgattggcaaattcttaaaatattataaaaatttaatttttacatttaatagtgaaaaatcctgtctcacttccaagtcgagaagtcgagtcaattgaacagcctcaaaaatattgggcaattgtgaaatgggaaaagttacacaagcttcgacatacatattgaggcgacaatgatcctatacgattgagcaaattggggagctggagtatgcagcgtcggtagttcagctagttgaatcctttccggaaggcctgagacgctgatacaaatcccgccctggaaaggctactcgtgccgtgacaacctaccgtgaaagggataactatgccatgacgtcccagcactcagcgactatcgacgacccatggaaaattaccaaggccttcaatgttttttcttagaaaggggcccccatttttctgggggtgtaatcttttgtattgacccgaaaggaaaaaaaaaggggggggggatgtcccccagggaattgatg

SEQ ID NO: 29087 - DNA, 600 bp, Heterodera glycines
cgcaaaagagacgatttaaaagcgattcgaaaattctatcctcctgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaacgtgtttagaccgcagtaactcggctcagagtgaagattaagggacgcaaaagagacaatttaaagcgattcaaaatctatcgac

SEQ ID NO: 29088 - DNA, 2149 bp, Heterodera glycines
  misc_feature (1957)..(1957): n is a, c, g, or t
  misc_feature (2000)..(2000): n is a, c, g, or t
aaaaagatgaagaaaagcgcagcagcagcagcaatggctgtgttgtgtgtggagttgctggctgactgatcatgtaatgtatatgtatttaacccacactttccataatatatatgtcaatcgcatggacaaatgggcaaaacaatttgagtggagatgagaggggagtaatttgaacgagagtttgaaaattttaatttttaagagcctcgggtattaatgatttgagggttcttgttttttaaattgcatttaaatatttaattctggttaaattcttgccatttaaaattttttttccattttggatgagcagcaaattgagcaagttaccggctaatgtcttttttgaggtcccactattgattttgagggtccagatttttttttaattctttctaaatattaagtctgattaaattctttacacactttccgagcaagttcattttccatttttttaaaatttggattcagcattttcttcctctccctaatcgcgacattttgtccccctaattttccatttattccctctccccctcccacttttgcctccttttccaatttgttcgaggatcgaccccccccccccaccctcggcgtgtacataatatttatattgcttataatgagattatgtaggggcttcatcaacagcagcagcaacaacaacagaagtctctccccgtattctcacaaacacccccccccccctcctttttttcacgtggcgccgtgtcgcccgccactaatttaataatgcttaaatcaaaacaaaaatgaaaacccatggtcagcagatattggggataatgtgccctttaaaatttgcactttaaaattcaaagcaaaattgttatgagaagggcccggcttcttaggagtttttgtttgcttttctacggctttgtttctatgagaatttcacgaacacatatttttagccagcttataaatccttaaatccaattggacttcacccgccccccccaccactatgatgtaggagagcccctaatatagagacgtagggtactcgatgagtaacaggagaatacaaacaaagctatggaaaccgtacgtcactgagaccatccaaatggtaaacccaaattgctaaaaataaatcaaaatttttaagacgctctacgtttatatttggaccgttgaatccatctaacaattatcctattttggcatattatgaggcgaaattccgtggcgacgctgggtattttcaaaaatattttaacgaattattttaaattaagaaccttcggtatcggcctgtgtgatggatcccttgaccgtagcgatttcgtgtgttggagccagaaatcttatggatatgagtcgtcaggcgaattgctaggattttccgcaacaggcggtccaccagttgtgcattcgcaccgttttttccaaatgatattgtcgggtgtggaattaatctagcaactcgtgaggctatttttacattaaatggccaaaaaatcattttgtttacttgcaaaacattgtaaaagtttgatttgaatttttagatactactggcctcagaattgagaatccggccgtttcaatgataggcagcggaacgttagctactgtaaattttgggcccatattgatgttcaaactttccaaagtttttgagccgtaaacagaaacacataaaaggttaaaattttgttggcaaaaatagaaatttattgaaaatattttgactttttttgcgcaaatatggccaaatttttattatgtaaatgttccctttattttatgtgttagtacgattatattgtttttcattagacggttgtctttgtccttttgtgaaattttaaactgtcctataaactgttgatatggtaaaaaattaaccaaaattctaataattgcaagtaacagcatgtactttaataaataaaaataaaaataaccaaatgtttanataaatcaaaaagcgaaactataataatgaaaagaattgtaangaaatggcgaacatatgaataaatttgattttgtagcgataacaatggaaatagggagccaactcgaacaaaagcaatttagaccaaacattctttttgcgctaaaatcacgggtaattaaaaaaacaacaaaatttttcataattttt

SEQ ID NO: 29089 - DNA, 743 bp, Heterodera glycines
cagtgagtcgcgaccgactatgattaggacacccttcactcggcttgaaaccacaattggtttgactgcgcgtatcacttcagctagcgttccatttttcggtccgatgtgaatggactgatcaaagaagggctggagaaggcttgccgatgaatctccgatcagcacgcgtgggtgcagtaggatttggtccgccttatgcactgcttcagcacgaaccaattccaggatccatgccgattcgtcaaaaattggcttccactcttcttggtcttctttgcgcagtcttttcaggccttcgggtgggtgcatcgtcagtgggccataggcggtttttgccaaaatgtcacgcggcatagcaactgccaatccacttggtgagtgccttgtaatggtcttcatcgctgggcaactttctagtggtcacaaaatcgcttcttttgccaatataagtacaaagttccaactttggcccgcattccaaaatggtttccacaaaattccgagcagctgccattgacgaaatggtgcccgagcgaaggacaaagattgaaaggagtccttgcatcggagttttgacggcaagcgacccgatcggactgcttccaaggactgggtccaactccgccaaaagcaatttttcgcaaaattcatggctttccgatccagggcaacaggttgaggtccagccgagttctgtaaaatggaatttccctaattttttcattaattccggatcgttt

SEQ ID NO: 29090 - DNA, 1349 bp, Heterodera glycines
tgcaggaaaattattaaattttaaaaattttttaacccctccaagaatatgccaaaaaatgtaggcttaacttttttacttaaaattcgatcactcatattttttgctaattgagcagaagcgtaacaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaagatgattaaaaaatttttccttatattttggttatatcgtttt

SEQ ID NO: 29091 - DNA, 603 bp, Heterodera glycines
aaaaataccagtcgatagagctcgaaaaactatgttccccacccaggtctccatttctctgggaaaaatcgttaaaaaaccctaaaattcaaaaaccaaaaaaacgttttttaggcctaactcgaaaatttttgaaaattttcgaaattttaaaatttggaaaaatcgagctttcaaagctctacaataagtccgctggagccccctcgctcagatcaaaccctgacgcggtattcacctgggactgaagtgaacaaagttggtactgaatttctcctattttttgcagcccttcctactataggtagaggcctagaattttttttgacttttagacaacacttcaacttaggttcctaccagcggaaagtttttgattcgagatttagaaaaaaagttatgggccgtcaaacgcacgaaaaaatgagaaatcagtccctggtactcagttggcccttggaccggaaaacctatatttttcccggatgcgcctcaaaaagttgtaagacctttccactactttcagggcgctcccggccttcggccgggagattttgtttttgcaaacgaaactccttgtcaatataacatatatagtaacta

SEQ ID NO: 29092 - DNA, 584 bp, Heterodera glycines
gtcggggatcggtgacgcggatcggagaataacctcccaccaatttaataaacaattaaatttttcttttttacttttgaaaagcgtctttaaaaagtaaaaatctgtttttcaccttcttcattttctcattcaacactcgctgtactaatataataaaagcgtgtcgaagtaagttttaccaaaaagaatttgtcgcgcagtattgccggaaggctttttctcgtcttcttccaaccctctcatgagtatttgtattccttggtatcatacgatagcccatgagttgcttattagcttgaaatttcaaaaattatattaggatgtttcaatatatctaggaaatacatgataagatgatcatgacttttgaaaatgaacacttatccccatactccgaacctactgagttcgtagccccgttgggtctgtttcgtttggatattatgtttttgacgaatatttttagaaaagcacggataagcgctgtcataacaatgacctaattaggcttaaaataagattatatctatttaaaaagattggtttctaagacattttttggaagaaacgattttaatgta

SEQ ID NO: 29093 - DNA, 1068 bp, Heterodera glycines
  misc_feature (842)..(842): n is a, c, g, or t
  misc_feature (851)..(851): n is a, c, g, or t
  misc_feature (945)..(945): n is a, c, g, or t
  misc_feature (958)..(958): n is a, c, g, or t
  misc_feature (1012)..(1012): n is a, c, g, or t
  misc_feature (1016)..(1016): n is a, c, g, or t
ttttttatataaaattttatttgcatcaaattttaaatgtgtcacaattttcgttagagtaaggtcacaaacgttttcattttcttaaaaagaaaataatatgtaaaaacccaaattaaatagaaataattcttccatttccaaatttttgaaaaaaaaacctctgaaaatggtgacactaccagccccaaatattttcttactgtatttttgaatttttttaaaacataaaattcagcgagcaagaaggatgtgcgccgctttatcgacgattatttgcgtcatgatggcctttttgtgatacgaatgttaacattacacacagggggtaattaattatttaattacttaattgtatggctgggatttttagataagcaaaacgctaaataagtaattaattgggcataaaaaattgcaagcaattatgaaaattacaaaaacgcaaatatatatatatatacgaaaatcggtaaataaaattttttttacgattagcttgaaaaacactcaaaaaggctaacttttttctattgtaagcgattactcaataattcaaaaattttttgaaaggagcaaaaattttaaatagccaaaattttgttccgaagataagtttaggagtgcttttttctttttgaatttttgttaagcaattttttgaaaatcctgaaaaatatgtacttttaaataatatgtagaaagacaattaataagaaattggattataaagttagtctagaaccgtcaaatcatgtggaaaatgtgtattttcttgcttattttcatttcgcataaaataactatttacctaaaaatccttcacttcccttttatttttnttttatttnccaaaattctttttcattaatttttaatacttaatttttccattctccttttcatttcttttattcccacataattcattaaatttataattancaattcatacccntatttctaatttccaacaaataattaaaagaaaaacacttttaatattattttnaatnctttccctatgtagatcaaccatttagaaaatgctttgaataattagcgaaa

SEQ ID NO: 29094 - DNA, 1009 bp, Heterodera glycines
ggggacctctagagtctgccaaataaaatttatattatgagagaaaaaaattgcccccccaatgtagtattttacttttcccgaatagcttttcagacttcagttacgaatttttttctgaaaattcgaatttttccagaaattctggaataacttttttcgttttttagatagaaattccaaataaagtccataaaattctcctgatttttctctatttttaaggctttattcctgtaaaattgatcaacccttcgatttgttatgaattttcaaatattaggccaaaatcccgaggccaaaaaattgccaaaaaataaagaatttttaaaaaattccaaaaataatgaaacgaaaaacaaacatcagattcgtgctcagcacatcaaaataccccagaaaaatatttttgacccccattttcaacccaaaaaaaattttcgaaaatttctagggggcctagctcgaaaatttttgaaaatttcctgccatatggcacaccattcgatagagcttaaaaagttctacaattttgccctaaggcattttttggctaaaaccgacccctgacgagttatgggcccgggactcaaatgtcccgcttaggccaaaaattttttctatttccggaaaaaaatcgaaaattttctaaaaatgtcaccaatcgatagagctcgaaaaactatgttttggaagtggtctccgttttcccgggaaaaatcgttaaaaaatcataaaattcaaaaacccgaaaaccgttttttaggcctaacttgaaaaattttgaaaattttcgaaattttaaaacttggttggatagcctttcagatactacacatttttgctcagaaacaatttttcggtcaaagcaacccctggcgagttattcgcctggtactgaagtgtacactttttggggtaaaaaaaattagccaaggctacagccttgggcgcccaacgtagggcttaggttttgctggcaaagttgtcggggatagtctgacttaaa

SEQ ID NO: 29095 - DNA, 748 bp, Heterodera glycines
taattttgcgcttggaatgggtgttgttgttgttgcttcagctgcgtttgttggctgctcatccttaactccaacccaattatcactcctctgtcaattgtcatttgtcttctcacccttccatcccaccgtacggcgaatactgtgggtactgttgatggaatatttgcggttgagcagacggcgagtactgttgcggattcatcctcgtccttactgtacttctgccggaaggaacgcgcgtaatgccgccctttttgccccgcatcttaacctttgacttattgaggccaaattggtacactcacattgaccacacaaatgtaataaatggctgtgactaccaacgcgaggagtaaaagaccgccgagtaaaatggcaaaaacaacggcaatctgtggtgaacaattccaattttgatcaaaagccgggcttcttctttgttagcctgtccctcctccgcccacctgatagtcgtaatattttgttgcatatgccattgctgtttttctgctgttggaatgctaagatggatggacaaagcaatgtgtgtcaaaatatgacgagtgaaattccttgtgcttcgttcgcttgctgattcaaacgtcaaattgccggcgatcgattggagcggggccaaggcgcggggaaacgacggctgagagtgagcttttgtggtggccactcgccgcgtctgtcccttccgccgcctggcgttttgccccccccccctcccgccagtcagctg

SEQ ID NO: 29096 - DNA, 1242 bp, Heterodera glycines
ttgattctgtattccgctatgataccgtatcgttttcccgtctctaccaattctcttttactccaactgcaatcaaaaattgtttgactgtgtgactttgatttctcataatctgttgtttcttttttttacacataattgttttgtattcttttgacgattaattttttttatctgactttctttttatgttaatattttcgccaacagttgcatttcaatcactttttgtttttcattcgcaattcgtttgccttatattcgatttgtttgtttttagggtctcaaaaaatgccaaacaaatcaaacagtcgccaaagcaatttgtttgcattttttcaaaagaagccaaaagatgagcctatcgaaaaggaggagaagcagcaaaaggtgagtatttttgacaagaaaaaacaatgccttattaatggtgagtttttagtgtgttgagaatgagtgcgagaattttcacacgccccagcgaaagcggacggaagcgacccgaaattctgtcaacaaaagtcagccgatgacaccgctgaatcagcaacgaaatcagtcattggtggcggaaccacggaaggacaccacagacaataacacgacaaacgcagcatttaccgactcggaggaggagggggaagacagttcgtgcggcgttgggtttatgagttgcgcttctttggccaccccttcttcggctgaatgtgcttcggcaccgaaacggcgacgagtgattttgtcatctgacgacgaagaagagaaaatgatgggaaatggacagagaaaagaccaaaagggggacgaaacggagaatgaaccccaaagacaggcgacgaagcgaaagcgaagggacgcggcgaaagaagcgaaggaaaggacgcctccttccgttgtccgtgtcccgcgggacgaaatacagacgacgccttcggcaaaatgtgcacattcattcatcaattcatttgtatgccatctataattaagaattaatatcttttttatcctttttccaattcattacagagcatcgacttaccaaacgcttcttccgtgcagttgcccttttcatcgcttcagatccaacccaaagacttgaaaatacgcaacaaaaatgaccaaatcgcagagagcgtaaacgacggtgatgaggaagccgaacgtttccctcacttggactttgactttcttcgcactgaaaaaatcaaagacgccaaaggacgaaagcccaatcacccggaa

SEQ ID NO: 29097 - DNA, 992 bp, Heterodera glycines
caaagaaagccaaccccgcagaggttgaagtcgcagatctcgacgacgcaaagcagccaacgtcttcgactacccaacccttttctggaagctcgcacgcccaaaggtaatgtttgctctggtggcagcactacaatgtcttcttccgttgcagtatggggtgttcacctttatgtgcaacgaatgccgtaacgaaaacttcaagcgaggcgacaagcgcttcatccttacactggcagtggccaagagaagctggagttcacccaaacattctgccaagactgtgccatgttgaactttgactgcaccgacctgatcatgaaacaccaaaaaaaggatgatggaccacagaagaacggaggacggaacacctttttcaagacggaaaaatgatcgtttaccattcattcattgatttttcgttaaaatgagtaactctttctttgtaattttgcccagcaatacgccgggatttgtcggcaataaaacgaataaattcaaagtacacttgccaaagaaattagtgtttgatgggccgggatggatagtgggcatgtctggcataatatatcccaacaggtgagtgggtttgcacagttctcattgcccttgtacagtttagctgggcgactgtagggaccctggagaggcaatacgtagtggtgcacctgcgcgatggtcgcaagttccggttcagagtgccaaggggcagcttcctttcgcctcagcagcttgaacgtggaatgcaccatggcatgatagcggaaatggaacgacacctgacccgaaaaaggtcaatacagtacccggatgagggggagattgttgacatggaagtcgttgaggaggaagagcctgaagaagcaccattaaatccgttgaaaaatcgcacaaaactcgctcaacttagcctgaagcatgagcgagacaaaaaagagagagaggaggaggataaaaggcgacagcagcgagaagagcagcagcagagaaag

SEQ ID NO: 29098 - DNA, 912 bp, Heterodera glycines
aaaatacccattttagaatgtgtttttatttggaattatttatcacaaaaacacatttccgactatattattatgaaaaatacccattttaaaaatgtgtttttatttggaattaattatcacaaaaacacatttccggttatatttatcataaaaaatacgcattttaaaaatgtgtttttatttggaataaattatcacaaaaacacatttcctgttattttagcttgaaaaatacgcattttaagaatgtgtttttatttggaataaattatcacaaaaacacatttccggttatatttatcatgaaaaatacccattttagaatgtgtttttatttggaataaattatcacaaaaacacatttccggttatatttatcatgaaaaatacgcattttaagaatgtgtttttatttggaattaattatcacaaaaacacattttccggttatatttatcatgaaaaatacccattttagaatgtgtttttatttggaattaattatcacaaaaacacatttgcggttatatttatcatgaaaaatacgcattttaagaatgtgtttttatttggaataaattatgacaaaaacacatttcctgttattttagcttgaaaaatacgcattttaagaatgtgtttttatttggaataaattatcacaaaaacacatttccggttatatttatcatgaaaaatacccattttagaatgtgtttttatttggaataaattatcacaaaaacacatttccggttatatttatcatgaaaaatacgcattttaagaatgtgtttttatttggaattaattatcacaaaaacacattttccggttatatttatcatgaaaaatacccattttagactgtgtttttatttggaataaaatatcacaaaacacatttcc

SEQ ID NO: 29099 - DNA, 715 bp, Heterodera glycines
atcacttcgaaatttgaaaataggcacgacaagcaaatcgatcggagcgcaattccaccgcctttttgctggtccaacccccgccggcgggggacgaagaagcaaaaggggagggcaaaagcagcgaactgatcattttgagggtgggtttttgtgccatttgcatgggtgaagcattgatttgtttgaaaattcaaaaaaatattcaaacgatcagttgccgaaaaatacggccattggcaccaaattaatgcgattggtggacgacgaaaaatgcggcactgaatcagcggcaagagagggagaagcattgggattggaaatggtggtgccgaaagggcagcagcagaagcggaacaaattgccttttttcatcgatcagaggacaaaatggctgaggttggccaaacggatggaaattggccaatacgccggtgagtcattcattaatgatcgtttaaagtttattatatttgatcaaatcagtgaaattgggttcaaaagttatgttctgcagaggacggatcattccataatccaaaatgccttgctgaaagttatgttttaaatctaaattcgttcaccagattgacctggtcatactctaaactttgagatcattgattagtattaagccttagcttttggatgattattttttaatgatcactaaatgatattatatctgatcgctctggcgaatggtcaggaagtg

SEQ ID NO: 29100 - DNA, 1028 bp, Heterodera glycines
ctttcccaattcgtcagcaagacgaactgatgtttggtcgaacttgtagatgaaaaggtccaagtccgaaccgtgtcgagccaattgacataatgaggaaccaaaaactaggacttgacaatttatgcccgcatatttgagccactggttcatcctttctgacaatgcaaatttctcatttgtcttttcctccgtctcggccacttcgtctgcgtggctcatcaatagttcactgattgagttggcttttgtcgaattttttggtttattcccccttttagcttcgtctgtgcttgttatttcgagattttcgaaactttttaagtcgaatacgtcttcctcaacaggaatattttgaaaattttcttccctattttttggccatccataatttggctgaacagcccgtgttgtaccttttggtgttgcctccttcacatcatctcggagttgcatcaacaatcgtcccagtgtgttcgaaccgttccactgttgtatgtccgctgttggccatttgtcataaatgagtcccggtctacaacccaccccccaaaactggtcgggtgataattcgcaaattatggccgatccagtgctcaacagcacatctttaagatcaggcaccgaaaacttggctttaagtgcttctttcatgatgccaactttgagctcagcccattcttggacagtcacttcgtcctccccgttcatgtttgcgaatttcttcatctcaaatgcgcttattcttttgccatatctatttgtccccagcataatcgcatccgccgcgtcgaaacgtttcagatacaacgctttttgggcacagtaatactgctccacacatcggtaggttcttccgtggatgacgaattcatacgcttcgttgaaattcgaaaagtaaaattgctgattaaaaatcctagcaattcgcctctttcttcaacccgacacggcggcaaaatggtgctctgtcattgatgaacggcggaattggcgggatactttccatttccaaaatcgtaaacggc

SEQ ID NO: 29101 - DNA, 1210 bp, Heterodera glycines
  misc_feature (942)..(942): n is a, c, g, or t
  misc_feature (954)..(954): n is a, c, g, or t
  misc_feature (969)..(969): n is a, c, g, or t
  misc_feature (1026)..(1026): n is a, c, g, or t
  misc_feature (1030)..(1030): n is a, c, g, or t
  misc_feature (1034)..(1034): n is a, c, g, or t
  misc_feature (1040)..(1040): n is a, c, g, or t
  misc_feature (1043)..(1043): n is a, c, g, or t
  misc_feature (1049)..(1049): n is a, c, g, or t
  misc_feature (1056)..(1058): n is a, c, g, or t
  misc_feature (1067)..(1067): n is a, c, g, or t
  misc_feature (1079)..(1079): n is a, c, g, or t
  misc_feature (1081)..(1081): n is a, c, g, or t
  misc_feature (1086)..(1086): n is a, c, g, or t
  misc_feature (1091)..(1091): n is a, c, g, or t
  misc_feature (1095)..(1095): n is a, c, g, or t
  misc_feature (1101)..(1101): n is a, c, g, or t
  misc_feature (1103)..(1103): n is a, c, g, or t
  misc_feature (1164)..(1164): n is a, c, g, or t
gagagagcagcgtatggagattatatttgttaaataattttaagcctttaaggtttttgggtaaatattaaaaaaatgtttgtttattgttaagctggttttgttcacttaattcaaattattaattcacaagaaaatccgccgtaaaaaatatgctttttattttattcaaaattttttatatattttttttctaaataatttgtagatagatttattatatggacagttggaaatcataacaatgatggttcgttactaagaaaaaattatttacaatagaagcaaattcagcgtatccaattgagaaaaataaacggattttatgccagttattttgacaatggttcgataaaatataagaattaatcagtttttatgtcgtaaataattttcttgtttgaaaatttatccaatttttcttataatcatccatttaaatcctccaaaatctctcctccaaactgtttcttccattttgaaatggtccttctatcaatttgcaatattttagcagtttctttgtcactcatttttgggttttctctttttattttccaatattttttcataatgataatgcttgacaaaattataaattcacaaaaaaaaattactaatttaataatttaacgaaataaattttatagaattaatattttttcgattaataggaaatgttttccaacgctaataattacgtattaaaaaattaaaagccttggatttattaccaaatctgcaggacaaaaatatgtaaaataggacaatttatgattaaatattacaaagattttcatttccttaggacaaacatttagtttttgaattttactcaatttcaattaaatttcactttctactaatgattcaagtgaattaatccgttttttgttttatggcgcggcatctccctttgcgtgtttcccttttttttttctnttttggtgccgncgctgggcctctttncttgcttcgtgggtgcggggcggtgcgtgctccgttccgtgcgcgttcgtgctttcngtgnctgncccccntcnttcgtntcttgtnnnctcctggcncttttcttcccncncctcncctcntgcnttcgcngncatggttttccctttctcgtctaaagtccgtttccttcccctcccctgctaatgccgcctncaaagggaccaccaatttgttaactatttatttataattatttgca

SEQ ID NO: 29102 - DNA, 980 bp, Heterodera glycines
  misc_feature (46)..(46): n is a, c, g, or t
cagaaaaatggctatctcttttaggaccaatttctatctcgtaacnccgatgctaatccgttccgcagagcctcttcaaaattttttccatacccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaaacggttccgcagagcctcttcaaaattttttccat

SEQ ID NO: 29103 - DNA, 989 bp, Heterodera glycines
  misc_feature (898)..(898): n is a, c, g, or t
  misc_feature (949)..(949): n is a, c, g, or t
ctgaagaaaaagtagtggccgctttttgctgctgcctccaaccagggacaggcgctgccggtgtcacagcccgaattttcgattggcgtttccctcccgttgatcaggaacagatcaccttaaaagattttgggttttattattctaccacttttagtccccataaaaaaaaatttttgataatttaaggcaaaaaatggaagtggagtacatgaaggaatctctttccacttaatgttagaaaaacaagtgggcatagcctcatcaccagtcaaaaaccatcaatccatggcacacatcaatagccctttggtccacacacaaatcccactcacccagcgtggtgtacgtcgtctcctccttgcgccgcacctgcaagttgtccgagaagtatccgctgctgaaccacgcctgcatttggtgcgtatcaaaaggaccgcgctgagttccactcgggtccaagtagcaccaaaattgggctgtttgggtggtggtagccggggcagaagcaacgccagcagcagtcacagccgaggaagacgaggagggcggcggcggtgttggtgtccctttgctcactggcgccaccgcggcggcagcgacggcggtcgctggtggcttcttcaacgcgtgggccggagggggttcctgaactggccgaatttgtggtccatggccaaacgcattcaacccaatggcaattacaaatgggcacacaatatgatgtatgtgtcaccgtgtcccgtaaaactttccgtcattgtccaaccacccatccaaaaccccgaaacccattgcttttccgctgactttagccgccgtgacagtgccggcaacagcggcacctccactgccttcgcttttcccggtggtattgttgctgtttttgtgcatcggncccgtgatcttcggtctcccaaaactttttggtcatcgcttcgtttactanagtatttttaaagagtggcaaaatttaaaaaaaagctttt

SEQ ID NO: 29104 - DNA, 846 bp, Heterodera glycines
caatagaagggttcgaggccgcgaagcggccgagccccccccctgttatcattcataagaatgttgtgccatagggaacttccacaagaaacaagaagagatgatgaaaatgccaagaatgttgtgccatagggaaatgccacaagaaacaagaagagatgatgaaaatgccaagaatgttgtgccatagggaaatgccacaagaaacaagaagatatgatgaaaatgacaagaatgttgtgccatagggaaatgccacaagaaacaagaagagatgatgaaaatgccaagaatgttgtgccatagggaaatgccacaagaaacaagaagagatgatgaaaatgacaagaatgttctgccataaagaaatgccaatagaagggtgcgaggccgcgaagcggccgagccatagtcaattttatcattcataattctacattacaaccttactgcctagcggttgcgatgcgccgaaggcgcattcaaccgctagttatatgaaaaagtaaaggggggacccttttgttttgcaaaatttttttatgataaaaccccatgaaaatttgttatccggggttttagaggtcgctccacccctccttttgtttttacaatggtaactttttaactagcgcaagacttattctttttgaatggattgacattttgtttattacgccagctatttttttccgcttttttgcttttttttaccgtccttggtatgtattagggatggtgcggaattccggcttccgacatttttggggtcggaattccgacttccgaaaatttttggtgcctcggaattccaacttccgaaaaatttttggccctcgaaattcc

SEQ ID NO: 29105 - DNA, 1348 bp, Heterodera glycines
cagtgattagtagaggtgcaacagtgattagaagaggtccaacagtgattaaaagaggtacacagggaaatagaagaggtacaacagtgattaaaagaggtacaacaggaaatagaagaggtacaacagcgtttagaagagacagtgattagaagtggtacaacagcgattagaagaggtacaacaggaaatagaagaggtacaacagcgtttagaagagtgattagaagaggttcaacagtgattagaagtggtacaacagcgattagaagaggtacaacaggaaatagaagaggtacaacagtgattaaaagaggtacaaaagtctaactttttatgagatgtacaaaaataatttcataattttaaatataattttatagaattaggtttatttaaaaatttaaaaaaaactaaataataaaaaatgtaaaagtttattttttaattaataaacggaataatttattttactttattttgaaatgaattattatgcatccaaatttttaaatctaattttgcttaaaaataaatctattcatcaaaagaaaaattaaatttaattattacatatttttggaagatttttgtgagaaaaaattttccactcaaaaatcctatgctcacccctttggtcccgaatcccaaaatcacttttatttttgtaacatctctcaaaaaagtgataaaaatgccaaataaaatttatataatagagcataaaattgcggatttttgtagtattttacttttacagaatgacttttcagaagcgagttctgaatttttttctgaaaaatcgaaaatttccagaatttctggaataactttttttgtttttgtggtataaatttcaaataaacctcataaaattctcccgattttttgctatttttaaagcttaattgcatgaaaatcgtcccacttcaaaatgagctacgaattttcaaaatttaccccaaaatcccgagggtcaaaaaaattgaaaaaaatttcgaatttttaaaaaattctaaaaattatgaaacgaaaaacaaaggtcatattcgtaatcagcatctcaaaataccccagaaaaaaatttttcaccctctttttcaacccaaaaaaaatttccgaaaatttctagggggcctagctcgaaaatttttgaaaatttccgaacatttagtacaccattcgatagaactttaaaagctctacaattttgccctaaggcaatttttggctagaaccaacccccgacgagttatgggcccgggactcaaatgtcccgcttaggccaaaaaatttttctatttcctagaaaaaatcgaaaattttctaaaaacatcactaatcgata

SEQ ID NO: 29106 - DNA, 1117 bp, Heterodera glycines
ccgaagtgttcgattgtttgagcctcgccgcggttctacacccctgcattttctgtgttcacggcggtctttctccgtacattcgaaaccattgaccaaatcagaacaatcgacagaaagcaggaggtccctcacgaaggtgggcaaagggtcccttttcaaaacaccacaaaaatttctcaatccaaaggtgcaatgtgcgatatgctttggtctgatcccgaagtacggcatttttgtaccaagattttatgttattcttatttaattttttgaattattgtttttttctgtaaggagtgcgtcggcttcgctatcagtcctcgtggtgccggctatctgttcggttctgatgttgtgaaattgttttgtgaaaagaatggcgtagaaatgattgcccgtgcccaccaattggtcatggaaggatacaaatggcactttgacaacaccgtaagtaaaacgcaatgtttaacagagaaacagcgaaagatatttcccatctttcataggttctcaccatttggtcggcacccaattattgttaccgttgtggcaatgtggcggccattctcgagatggacgatgtactgaaaaaggaatttttgattttcgaggcggcaccgcaagtggtcggaacaatatttaaaaaagaatattttgaatgttttggtttttcaagggacgaaacacaccaatgaaggggcctatgcctgaatatttcctttgattcagagttaaaatgatgaccatttcgatgtttgcaacattcatttctaatttgtttattttttgcatttatgtggggatttgttgccattgttttcttttatattttaaaataaaaagtgctggagacagagattttcaaatcattcgactcgagaagaaaaaattaaaccgactgacaatgaggcacaaaagccaaattttggttatagcgctaattcttggtatcaatcgaaggcaaaggtaaagaacattggtcccgaaaaaaaaacttaaattttttaaaatgatttttaggggtaatcataggcgctgagcacgaatctgaccttctttttgctcaatttcgaaccccggaaccggattcgaacattaaaaaaaaaatcaattt

SEQ ID NO: 29107 - DNA, 1055 bp, Heterodera glycines
gcataatttggaatatattaagaagacttcccaggcccatcctcgcttcaccggataacattccttacattttattaaaaattgtgctaacaaataagccaattacaaaaatattagctgacatatttcgacttgctttggattccggtcaaattccggaagcgaacatcattagtggtaccaattttcaaaaaaggcgaaaaaactgatccattaaattacaggccggtgtcattaaccagcactgtctgtagagtttttgaacgaattttaagtagcgaaattttagaatttctgaacggtataagattttttgataaagaacaatttgggtttttaaaaaataggtcgactacaacccaaatattaaaaatgatggacgatatatataattctatacaaatgaatcagcaaattgacattatctatattgattttgtcaaggcgtttgattcagttccaattgatttattacttcaaaaaatcaaaaagattggaattgaaggaaaaatttataaatttttaactaactttttaaaaaatcggagttttaaggttaaaatcggcgaagtattgtcagaaagtttcagcatattttcgggagtgccccagggaagtaagtgtcttagggccattactctttttaatttttataaatgatctgccgtcctttattgcaaatgaagcatcatcagttggcataaaaatgtatgccgatgatgttaaattatattatgcctatgaaaatgatgataaaacaaatcatttagataaagcaattgaagctttggaaaaatggtcaaaaataaatgggttagaaatttcaactgggaaatgttttgttctttatttagggaaaaataatatgaaaaaaagatattttattaactcacaaaggatttcagaatcggataatggtcgtggactaagcattataattgactcgaaactgcatttttccagacatattaacaaaattggacgaaaatgcttatctttaaagttttcccgattttaaaaagcttaaaaaaccaaggaaataaagaacctaacaa

SEQ ID NO: 29108 - DNA, 1332 bp, Heterodera glycines
aaaatctgctcgacacgtccgtctgacacgtccattcttcttcgccattcaacgttttgcatttgagttggagtggcgatcgcttccattttgcgatgcgaagtccacaaatccgggccttcatatttggccggtaaatactcctccaaattgttcgctacattccttttcccaaaaaacggcgcgtggatccgtcgtgaaggatgaaggatggccttttccttgcaatgagccaatttcggacttccaatttgtcggtggggttctcggcacaaaactgtgacttctgttcacatgtccatccctaactccacatcttttccacttacttcaatcggcgcctgaattggcattttgatgttgccttggttggagccactttgtctttcctttgggtcggtccgttgccttggccttgtgtgaatggcgttgttggcagttggcgggttgaccagtgatatggcgctttatttcacaagctgaattgccctaagttcgccctcaattttcttgaacaaaatgtatgtgccgttttctacgcatcctccaatagtttcaatgccttttgtcgcaaatttgattttcatcgttgagcacggtgaccaaaataatgcacttgagctgcagctgctcctttgtcgacccagttcggcattcttagcgatgggcgaacagtgagctggtttcagcaaaaagctttttgagatgtgaaacagtttcatccaattcacttggtccggctgtgttgggttgatcgtatcctgatgtttgttgtactcctcctctcctagtttgcccagaagaagtcgtaacttcgaagcctcagtcagaatgcttccgtcctcttcgatcaattttccataccgtttaagccaggtctcaaatgtgttgccaacgtcagggttgtaataaaataatgccgaaggcgagcattgaaaaaaatatataaatcatcaaaaaataaagcttaaaaaaaattataataaatttaaaaaaattgcttaccaaatttgcattgctcaaatttgctggcgcggcgttttgcggttcagccttgatgaccacttattggagagcatttagcaattctcgaagctgttgcgggtccagggttcacttgaagttaactgcacacggaaaattttatctcacacggagagaaaaattttaagaactgcgaaaattcgaaatcaacacggcatttcttaattagaagcaaaacctattcttacaagcattgttttttgggccatcattaaagcatctgacaatgaacagacaaaaagatataatggcaatacgacaggggtgaggaatttaataaaattctaa

SEQ ID NO: 29109 - DNA, 980 bp, Heterodera glycines
aagcattattgattgcgatatccaataaagaaaacgcgtataaaaaatatgtgaaatacataaaaataaattaaataatttcagctgacagtattttaaaacaccctttttaattatattgcatattatatcttacttacctattacggggtttgccaaaatattacatatgctactaatatttataatatattgcattttaattaccaaaaatagtcttttaaaaataaacagtaaatttacatcaaaacacaaacttaaaaaactttattatttgattttctagattgaatttttgcatttctaaaatttctgttaaattgtaagcaatttacgacaaacgacaaatatactgtgaaaggtccaaaaaggccgtaatttggcgtaatacgtaattttcaaaaaattaattttttatataaaaaatccaatctaaaaattggttaagagtaatttatgatctgaataaagatttgcttaaattgctaaattattttacaaattttaaataattagaatttcaaatatcattatataataagtttttaaaataaaattataaattattagaaaaacaattctaaagattaaatcaggtattaaaatgttaggaaaattaatttcaataattaaattgaataataattatatgaaaaagcatataaatttgtgaacaaaaatccgatcaacgcgagaaaaataaaatagaaaaaactagtaaaatttttaatgcttattattccataaaaataaaataaaatataaaacttatttctacaaaatattaatgaagaaaagctctagatttgttttaaaataatttattcattataaattatttattgtattttctattgaaagatttgatagaaacttgaaaagatataatagaatggtgtcaacctggtctttaattaatcattttagttactaataaaaaagactgataaataaaataaaaatttattaatagacattca

SEQ ID NO: 29110 - DNA, 1115 bp, Heterodera glycines
  misc_feature (1044)..(1044): n is a, c, g, or t
ttgttttttaacttagctcatcaagagctttcaaatgataccaaatttgtgtgattttgacccttttaaaagcttaggtgcctcccttttcactcaaatttttaagttttaaaccggttcaaaaaccggtttaaacgctttgccgcgcagtttttttgatggtttaggcgttttcagcacctaagaaaacctataaaagtatttttatgcaattttgagtttgggacctatgatgaatattttaccttttaaattttttagtaaattaaatctcggttttttgtttaagtcagggttcgagtttcgaatttggccaaaatgcatgtcataatcgttttcagcgacctctaaaacccctacaaatatgttttccttgtaatttatgaatttagaatttttgttcgaattcgggttagggattcggaattttgaaaaataaatgtcatattcgtgatcagcgccccaaattaccctagaaatgactttttatttgaaaatttcagggggggtcacaaaaccgaaaagaaccgtcttttggatcaccatgatcagaacactccttttttggtgaaaatctattaaaaacggataaatccaaaattatatttccctaaaaacggcagctctggataaaataatgacgaaaaagctgaaagaattgatttgtttggattccagcaattcgacttttcccgaagtaattaatgtctcccccaaactcactttctttctttctttttcttatctcatcatcacacctaatcaacaacaaaatccaatcggcctcatttgcgacctctcacaatcggcggaatgacttttctttccctccccccccccttaactcagttcaaaatgcgtctctgggattctctcattcattgctacgagaagaagcaattcaaagtccaaagacataatcggaacccaaatttagcatttagaacaaattatgaaatgttgtcgtcgttttttcaccatttcatcagccgccgctttgcttctcccgcgccctttctcttattctatcatttgcattgcctncgccattcgcccgttcattcccttccctttccccccccccgtctctgctcactcgtttttctctaaatttc

SEQ ID NO: 29111 - DNA, 1328 bp, Heterodera glycines
tattttttgatgttcccggtttttctttggatttagcttgttttggtcaattttggaacaaaagcgataattttgaaatttttaatttttgactttttgttcgaattcgggtccgggattcgaaattagtcaaaatgaatgccagattcgtaatcagcgaccctgaaaaccccaaggaaaagtgttttacacggcttttttaaaaattttaattttttttgaaaaatgggggggataaacttcagtattaccaacgaatttctcgagtcgaaagtctcaaaaaagcacaataaatttatgcaattcaattcattcaccaaacgatcatgatgcattcaaatccaacgacaccattcggcagcggcgtttgtgggattggaaattggagcacaaacgtcgttgttccatttttcaatttgcggtgttgcgatcgtcgcctcgccacggacgggcaattctcagccggccaagtgaccattttcggctgttgaagtgcgtgtccaccaaacagtcgaatcagtcggagacgaacgccaaagccaagccgactttggcatgtgccagcagaaggaacacatcgaagcagatacacaaatgaaactgaaaaattaataaaaaggatatcaaaatggtaagtttgagagtcaaaatttgctgattgtgagacgcgagaattgatgaaaagagtcgagaaacaaaacccagaaaagtggaatttattgaatcgagaatttcgatttctaaaagcatccaaattaaacattcttggtatcattcgatagtcaatcctctattaggctaggctgcaaaattccaaagaatttcatcatgtttcaaaaaattgcttttctgaatttgggtgattctatcgtgtctctttttttatgtcgtgtaaataaagtgcaatagaacaaaaggtaatagtaccgatggtatcacaccttttgaaatttttttaaaaaatttcaaaagtcatattactatttattacaccgaatacgtgaaaaattttctacagaaattgatttatttattttcttgatacaattaaaagaattttcttttgagattcgggaccaagagccaaaaagccgagattttgttataatttttctgggcagcggaggcgattagacggactgaaagaattataagtttttgccaactcttttttgaccaggaacaattccgtaattacggaattatttttccaattacggaataatccgtaaatactttattgcctcacagccctcccataataaattgtataaaaatttaaaaaattggtaaaacacaaaaattctgggggggggggtgggaaattg

SEQ ID NO: 29112 - DNA, 433 bp, Heterodera glycines
caaaaagtgaggcaatttggaatttgtgatttaaaaagtacaccatgcgggattggagaatccgggaccgtttcaggttgtccagggtcgaatttaaagcattgcgaggcttgaaataaaaaagaaaataaatattccagaaaatttttaaaaatttctccatccaacccattttagcaaagatctcaaatagacagaagcaagcaaagcaaatttttaatgtcattgcattgtcattagactcatcattctcataaaatattatctttctcccccctttcaatttgacttttgcgatttccctttaataaatacaaaatgaatgcttctctgaatgagaaggctcattaaaaagctactttaactttgtcgttttgtgacgccagcaaaaggaagcggagtgtgggagaaaatgggataaataatatgggaa

SEQ ID NO: 29113 - DNA, 1891 bp, Heterodera glycines
catttgaaaaactctatcaacctgcaaattttcaaaaaattttattgatgtacaaaaaaatcagggcaaaaggtgttcgaaaaactaggtttttgagttccttctgaccataactttttgaaacttaacgaaactttttgaaattttgcaaaataaaaacgaaacacatagagctatcgaacatcatcaagagtgcttaatttgattgacaaagtctcccggcgacagtttcggccggtgatgggatgcacccggtgaagagacagtcgggatggatcgatggatgaaaaggaagggggggggagagacaaagcatccacgagagaaacgagaggaggaccgagagagaaagggagaggagagacaaagcatccacgagagaaacgagaggaggaccgagagagaaagggagaggagagacaaagcatccacgagagaaacgagaggaggaccgagagagaaagggagaggagagacaaagcatccacgagagaaacgagaggaggaccgagagagaaagggagaggagagacaaagcatccacgagagaaacgagaggaggaccgagagagaaagggagaggagagacaaagcatccacgagagaaacgagaggaggaccgagagagaaagggagaggagagacaaagcatccacgagagaaacgagaggaggaccgagagagaaagggagaggagagacaaagcatccacgagagaaacgagaggaggaccgagagagaaagggagaggagagacaaagcatccacgagagaaacgagaggaggaccgagagagaaagggagaggagagacaaagcatccacgagagaaacgagaggaggaccgagagagaaagggagaggagagacaaagcatccacgagagaaacgagaggaggaccgagagagaaagggagaggagagacaaagcatccacgagagaaacgagaggaggaccgagagagaaagggagaggagagagaaggaatggggtcaatatttgcttagtcatcggccataataaatttggcagcagaaattgcaaatggagggaacccataactcttgcccttttcttttttacaatttgtgatttggaaatgaacatttggtacattatagtgttgcttgagaccccgaaactttgcataaaattataaaaaaagggaaaacaaattttgaattaacgaaccgaaattgaaattcttcaggaagaatttcaacaaaaaaatgaaaaaatgtatgaaaattcaaaagaaaatgccaaggaagaaaagaagaaattggaaaaagcattgaccaaaagcaaaagaaaatcggcaaagaccaactctgtttaatgaagattatgccaaatttggcactttcaatgcgtcgccattttcatgaaattttttcgtgtccacgaaaaatttggcactttcattcgtcaccatttcataaaaaaatttcctttttttaattaaattttttgcttttcttttcaattttttcaattaattttccctttttttattcatcacaatgtttctgtcatttttccattttatgcatttttatactttttcttttttatcttttttacttgcgtaaatattggaataaatttttgcttttttggattataaaattattgggtttaataattggctagataatacaccttctgaattttcggcatcatgtggagagattccgcaaaaaaattttcactgcgcgagtttttttttgaaaattggaaaaattcaaaattgaatgggacctgtgagtgggagctcaaccacctcggcaacaaaatattttagagcaaaaatttttcacgttaatatattaaattaattacattttcatttattgtttttcccaattaaaatttaggatatttcttttct

SEQ ID NO: 29114 - DNA, 1009 bp, Heterodera glycines
gcagtcttgaagaaagcgcgcatgtctctcagccattttttgtatttgttttgtttctcctttttgtcactttcttcccttttgtgattctttttgccagcaaacgaatcgaaatgaatgcccattttcaaaaaggcattcagtgccgaaaagccgcgcattgcgagtcgccaattggacatgtctctgtaaggctggacttggtgccattcaatgcccaaatgatgtgccatccgattgaataattgttgcgagatgcatttcaaccctttgcccgacggaatgcccgtctttttgaattggcttaaattttccataatttggcgaaccgttcggtttgtctcttcaatggcagaaagctgctttttccttgcttcttctacatcattcccgcttttcaatgcttcatcattgtccaatttgtccatcatttcttgtacatttattcggttcaaaaatttttccaccaaattttttgctttcgcttttttttgcgtttcgttgccaaactttgcgcattcctccatcaattgttcatattctatggttgtgtccaaattggcctcaaccatcaaattggccaactcattttttaagctatgtcaatcaaattctgattcaaattttgcaatttttctttggcattttgtttcctttttattttcaaattttccttcaaatacaataaatttgcataattttccgctgaaaatttcgtttttccatttttaatacaaaatttatgcaacgttttgatggtcatttcggcattggcaatgtctttcaacggatttaaaactccatcttccactgtttcatctgcttcattagtcacctaattaatttgttaattagactaattaaaataactattaatgctaggattgattttatgtgctataccctctgaaaatgtacataattttgagatagtaattttctatattttaaattcaataacataaagaaagtaccaatattttgccttaaatgcttaattaaattttat

SEQ ID NO: 29115 - DNA, 540 bp, Heterodera glycines
actattttgggatttttactcactattttagttaactatttcgagatttttcgtcactaaaagttgcggccctagtgatcagcgacccagaaaaccccaaggaaatgtgttttacacgcttttttttaaatttttattttcgaaaaatgcggggaataaacttcagtattacccgtaaagtacctatttttgtatgttaatgatagaatagcctgaaagacggagaatgtcaattttatttcttgtttaattcagacttaaaaagtgcatttgcgccatttgattttaaatattttgctgccaacaatgtcaaagtaatgtcactaaataataagacgttctcgtcttttaaatatatcttatttgattttagcattcatactctcggcggtgacgacgataacaaatctcgacaaaggtccaactcaagtgacgatgaaaacagcgatgaggggaggcagggcttttttgttggcggaagtgatcacaggtaaaccaattaaagttgaaatttaaaatcttattcccttttaatagagt

SEQ ID NO: 29116 - DNA, 876 bp, Heterodera glycines
  misc_feature (5)..(5): n is a, c, g, or t
ttacntctttttcttaaaataaaatttcaaaccctaataattttgtcaaaccttggacattaagtctgaataaatattcgaatattatgtccaaatatttattatatttttggcattctgtctgttcatatccttcaaatttctcccctttttgtcacattgccaattctcatacaaagatcactttcatcttggtaaaatgctgccgcttggtactcttttagtcgcttaaggaatttgttaaacttcacatttcctttcacaaagaccgaaagtaaggcttcatctaactaaatttaattttaattaaaaataataatataatttttgcttacccatgtatatgagtcattgaattttgaacccaaaagtattttatttatgtcatcatttatctcattggctctccgtggattatctttttttgccttttcttctgcctttttaaacaaatccttcaaaatgttttcaaatttatctcgaattattccgtctaaagtttcctttttcggatattcattcgctgtgtcaattgccaattgagaagacgagtgagagaagagagagagggaacgagagagagagagaaaacggtacttgtgtgggtcacctgactaattgcaaaaaaatattccaaacgtctataaacggattccctccgaagtggccacaaggatagatggagctcggtaaaaggtatactcggtgaagagaacgattaaaggacttggggacgaactgtccttaacctattcacaaactctaaatgggaatgaagccagggttgcttgactcagaacccgggcgctgaatgtttgagctccaagtgggccagttttgggaagcagaactggcgatgggggatgaaccaaacgt

SEQ ID NO: 29117 - DNA, 833 bp, Heterodera glycines
gttgggtcagatttactaaaaaattaccgaatcggatggcctttgtttttgaaggtcctccgtttggtcggtgctcctctgctgttccccggccttttgttcgtggactgtgcccactttcagtacaatcactgctccctcggcctctttctgtgggcgatctcttttctcgagaagggccgtctccgcgccggtgcttttttctttgtgttggcccttaaccacaagcaaatggaactttaccacgctttgcccattgccgtttttctgttcgcccgttcattcgttcacacaaatcgaattcgttcattgttttcggcaattggacaaaggcaggacattcgatgaaattcccctcattttctattcatatttgacttttttcagtgtctttaatttgtttcaattggctctggtggtgctgctcacttttgtcattctttggtctccattcctttggcctgagccttcattggccctccaattgcttcgacggattttccctttccatcgtggccttttcgaggttttaattgtcttagtttctaataattattaaattgtccaaggataaggtggccaatttctggtgttgtgcttctgtgctggtcaaattcaaacaaatgttctccataaatgtcctcgtcaaggccaggcaaaatgctcattttctttttctttgcaatttcttatgattttacctttttccgttcttttcagtgcctttttggtgttttttcgcttgcgttccttcgctcttttgccttttttattcgcccaaactcttccaatttgcgcgccgtattaactggccaacgcattggccttttttc

SEQ ID NO: 29118 - DNA, 596 bp, Heterodera glycines
ttgaaaaattcactgcgaaaaaattcttgatttttgatcccgatgcagtttacgatgttctaatttccttaaaattgttaaaaatgataataggaggcgaaaatacagaaattgacattaattgattaaattgtaaaaaaaaatatttaaagctatgttgttaaatgttctagtttttgaccctacagtctgactttttgggcatgatattctaaattttgaaaaaatttttttataaaaacctaatataattaccatccctatttttcacaatcgaattgatcaattataaatattagataaaaatttgaacaaaacttagcacaaaactaaaaattaaaaagccaataaataaataaaaaattgggttttagcaaatcccgataatcccgcgggatcccgaaaaaaaatcttcgggattgatcgggatcgggattcggtcgggatcccgactcgggatccgtcccgatcgtttttccaaaatgttcgggattgatcgggatcgggattcagtcgggatcccgactcgggatccgtcccgatcgtttttccaaaatgttcgggattgatcgggatcgggattcggtcggtatccc

SEQ ID NO: 29119 - DNA, 951 bp, Heterodera glycines
gatgctttcactatcaaaaagggagatgaataaaaatctaaaaatttttaattgctttttaaacgagcgaaaaactttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaattgctttttaaatatgcgaaaaattttaggcttaactttttttttataaactgatcagaagcgaaccagattttgagagagctctcaaaacagtacaaggaaaagcactgctatgatgaaaaaatccagtaattctgtttttaaaatttttcaaaattctgactttttcattacttatttattttttgcaaaattaattcataagtattttttcagaaagtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattattttgcaaaattaattcataaatattttttagagacgtgctctgaaacgcaccaaatgtaataaaag

SEQ ID NO: 29120 - DNA, 986 bp, Heterodera glycines
cccccccccccctctcccctaaattccctcctgccttaaattgtcccctccccttgtgtttcccccatttaccatccattatttgttcagcattctcttgaatttcggcttcatttgcggcacgagtttctgatgttgggcatcctccaggtggtggagcaacttcgctccgcttcgcctgagggcgacggctcttcgcttggggaccatttggatttgtttgagatgatgcgccaggaggacgaacaggaaatacgaaggtgagaagataaacaaactgttgagggattgacgaagatcagccgacgcggcgcaattgacagacaatccaaacaaaagtgaaagcaattggcacattgtcaaaaagacaaaaggatgccgtccatttccaaacgccgaagtttccctttgcttttttgtcgacctcaccctcgcccaacttatgtttttcaaatggcacagtttgtccgattcgggctcaacctcaccaattgacttcgaaagtccttctggcatggccgaagtgctcacccagcgattggacaacactttggcactgccccatctgatctcactgttccagcaccttctgatggttccttccgatgaaaagaatttgcccctttggcgactgttcgatttggtcctccaacaattgacacttcaaagtgccatgggcggattggtctgtttttggcgtcacaattaatacaccattccaatttggttcggttttgttttaggcatctgtctgtgccgacccccaatttggccaatttcccatccgattggacatggacgaactgttgacgaggtgggccgatcactttctctcgtgttcgtcgaacttttggatttggcagactgaagacgcaggaagactgtgaacaattggagggcaaactgagagagacggagcaggaattggagatggagcggagaagccagggcaggttggagaacgcgattgagcgacttgcaagacg

SEQ ID NO: 29121 - DNA, 1356 bp, Heterodera glycines
  misc_feature (27)..(27): n is a, c, g, or t
tttttagtccatataaatccatatttntgggggttttcgccgtttaaatccatatttcgccatttttgggtttttagtccatattttggccattttttggaaattttcacaagaaaaatgaaaaaaaacgaaaaatacacccctaaagatcaactttttggaaatttttaaaaattacaccccacaaaacacgaaaaatttgagttttcgtcgtcattttggcattttcaataaatattttcgtcatttttttgcgaacatttctttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctttttagtccatatttcgggcttttttagtccatatttaatgtccatatttcgcgttttttagtccatataatttacaaccctacatattacatatgcatatattttttcgtatatattttgcaatttttgagaatttttaaggaattttttattaaatgcccaaaaaaaatccaaaattacacaattttttcaaaaattttgagaatttatagaaatttcttgtgaaaatttaaaattttttcttgaaaatgttcaccaaaaattaatttttaaaataataaatgttgatttctacgcctatttaggtcatttttatggcattttgagcctattttacttatcattttcgcagaaaaaatttaatggaaattgttaaggatggcgctaaaaactgacaaaatagttagttttaggtctaaaaataacccaaaatgggtgctaaaaatgggaaaataggtgccaaaaaatttcaaatttaggggtgtaaaacagggatgtgcctaggtttcgcttttcgcatttcgcctttcgcattattcgcattttttggcgtttcgcatttcgcttttcgcatttcgcctttcgcattttttggcgtttcgcatttcgctttttggcgcgaaacgcgacttttacacccttaagaattggattaaattcccataaaatttttcaaaattttacctataaattggctaattttcagtgaaaacctgtttataaatgatcaaaatttccaattttttcccaggcggcgcctatcggcaccgccgcgcccccaaaactcctattttttcttataaaatggcccaaaatcgcaaaatttggtaatttgatgaaaaact

SEQ ID NO: 29122 - DNA, 966 bp, Heterodera glycines
ccgtggcactgtgcgcactgctggaacgtcgtcttccctttctggcgcttcgacacatccgaaacaccaacatcgtggacatggatctcaaacaaccggcacggcatctgcttctaagcgtatgtttgatgtaccaaatttctatttgatcattcaccattcgtttttaagaacgccgtggcactgtgcgcactgctggaacgtcgtcttccattgctggcgcttcgacacatccgaaacaccaacatcgtggacatggatctcaaacaaccggcacggcatctgcttctaagcgtatgtttgatgtaccaaatttctatttgatcattcaccattcgtttttaaggacgccgtggcactgtgcgcactgctggaacgtcgtcttccattgctggcgcttcgacacatccgaaacaccaacatcgtggacatggatctcaaacaaccggcacggcatctgcttctaagcgtatgtttgatgtaccaaatctctatttgatcattcaccattcgtttttaaggacgccgtggcactgtgcgcactgctggaacggcgtcttccattgctggcacttcgacacatccgaaacaccaacatcgtggacatggatctcaaacaaccggcacggcatctgcttctaagcgtatgtttgatgtaccaaatttctatttgatcattcaccattcgtttttaaggacgccgtggcactgtgcgcactgctggaacgtcgtcttccattgctggcacttcgacacatccgaaacaccaacatcgtggacatggatctcaaacaactggcacagcatctgcttctaagcgtatgtttgatgtaccaaatctctatttgatcattcaccattcgtttttaaaggacgcgtggcactgtgcgcactgctggaacgtcgtcttccattgcaagcacttcgacacatccgaaacaccaacatcgtggacatggatctcaa

SEQ ID NO: 29123 - DNA, 938 bp, Heterodera glycines
  misc_feature (911)..(911): n is a, c, g, or t
cgggccaggacgttttcgtaccgccgttttcgtacgagttgatttgcaaaaaaaaaaattgcattcaaataatttttttaatctttaagtaattacttttaatgttttgacaatttaagcttctattaactacaaaatgaaccagtagcaagtaattaaaacaaaccgaaataatgataagttggtgcattctactctatgtgttccacaaattcagtaacgatggacttaacaatattgtccctcaaaatgatcacaattatgccaatgccgatgtcaatcccgaaaaccttaacaattttctccgtgtatttcccgaaactttgagatgcgaccttattttgtcccggaattttgttagttttgttagatttatgaattttctacattatattttatgaatgggaaataaaaatgataaattttggttctattagtttccaatgtcaaacgctttgcttgggactgtgttttcaaattgacaaaggtgctgggaactcaagaatatttgaaaatttttaattacgacgaatttttttatatattttttaggttttattgtggtcggaaaaaacaaaaaactgaagtgtatactttgtcagtggactaagaaattaactaattgccaaattaattaattaatgacaaaattaagggttacaccgccaatgtgttttaataccccaacattttctccagttttttccctttgctggaggtctgacttttctacttttctgcttctccaatccaacttttacccatttgacctcatttcatcttttccaaatgtcaatcgtcttctatcaccttcatcaactttttaaatctaacgtgtaagtagacaccccttcgttagatattttatttcttaataaataaaataaaataaaattcactatatttgccanaattgaagtaatacacccaaaattgcc

SEQ ID NO: 29124 - DNA, 1008 bp, Heterodera glycines
attttgtggcaacatccgccatgccaccagagagtatccaccggaagatacaataagggcacacatatgtgatttacgacgaaaacgtaacgacgacaaatccgccgaatttcccccggccctcgaaattgatgacgaaatcggagggttttgattgagaagaatgaattgctggtcctcttctccggctttgcattccattatcgttcgctgatcattcattcacatatcactcactcactcatcaaatcatcgaaaattttcctcaattgtctctctcctcatttcattcattttttatgtacaattgtcgtcaaatacatatgtatgttcaaattctttctttgtacacatcatcatagggatggaattccgaggccccctaaaaaatttcagaagtcggtacagatttgcgttaaaaattattcaattatatcgatcaaaaatgtattctattattatatttttcataaatttcagtgcattcgggatcactaaatcagatttttaacattttttgcggcaaatttccaaaaacttggtgaatgtgcgaggggagaggtccgatggtgccgattctttatatgaattttgttagaaattagccaaattttttagaaatttcccttttttagatgaaaataaggtactaccccaaaatcagaacatttcttagaaataacaacatagaaaaaccctgtattatttggagaaaaaaataaaatcaaaagaaaacgtcaaccggtgtcgaactcataacaaaaagtattgttaatgttgaagcactaaccactaaaccacaaatatgttaaaaatttaagcaaatttactttatttcataaaaatttgtaaaagatggttaaaaaattcaaaattgtataaatttttgcctttaattcgacgaatatgccattcttaggggtgtgtttttcacccccgcgccccgcgggggtgaaggtcgcgggggcggggacgggggtgagccccaaaaacctgtcccgcccccgg

SEQ ID NO: 29125 - DNA, 1731 bp, Heterodera glycines
  misc_feature (17)..(17): n is a, c, g, or t
  misc_feature (1593)..(1593): n is a, c, g, or t
  misc_feature (1652)..(1652): n is a, c, g, or t
  misc_feature (1658)..(1658): n is a, c, g, or t
  misc_feature (1702)..(1702): n is a, c, g, or t
acaattccagacccacnatgatcagatccatctcaggcttttttcaaaataccaaactcaattatgaataaataaaacttgctttattttcagagaaaaaaaactgttaacaaattgcactcaaattttgaaaaatttttcctgcggtgtctaccggcgccgtaagcctcctgttctcaaaagttttttggaaaaatcgcgccgcaattttattatttttattcattttgaataaaattttccaaaatgctgatttttgacatcaaatgaaatggttaattgttagataaacgaaatttctcgaggaattttgctaaaaaattaaaaggacaaatttaaagtgaaaaatccaaacttttgcataaataaaaggctccacaaatcgagcagcaattatttaaactgttttgtgccaaagacaatccattaccattcaccaaaaaaaaaagtcttaaaaatcagttcctttcgaaaaaatcagtttgcaaaacagtaaagagtttttaacgttaaattgagattcttgatatttatttttaattaaaattagatatttcattagaatctgacgcgaattgggtaaatcgatcagcagatagctttttattttctaaaaaaaaattttctttttaattttttaaattccgtttaaatttttgtagtggtgtaattatctgtcaaatgtcttctccttcgtccaaatcgagcaatttgaaggagcggatgaagtatttgttgagtacgggtgagaaagcggatatgtactttttagccaaaagttcattggttttccagccaaattatttgtccatttttgcccctctggcgagtgattaattagcgattgacaatttttgcttctcaatttcatccattttcctatcacttcatcccattttgtttatgtgtaatttgtctcacttttcccttttttcgtggccatttctttccctaaccgccgatttgccattccccccccccctcccctaaatttctcttcattctctttttgactccattttttaccctcgtcatgttcgcccctaatttggccaatttctgtccaaatgaacgctattcccgagtcccactcaaagcccataaaatttcactccaactttcaaagtccacaatttacaagtacggtatgaatttcaacaaaagtttgccaattgctgataatcatccccaaattatcgtgaattttttaaattattcatttataagcattacaatccgaaatttcgaaaaaagcctggaaattaaccttgtttccatgttggacctggacaaaagtccagtccaggaaaaacccaggctcgtcgaggcctggattcagcactctggacctgcatttttttgaaagtaaaaacaaacaaaaatttaaaaaatcattaattgacgaggaatatcaaaaatgtctaattgacaataataacaaaaatatattttaaaatctattttatcattatttaaatattggtaaagcctatcgagaagttcatttctcaaaaaaatcaccttgatttaaaagttccggtagttgaggtgtcttcaagggggtacacaattagtgatgctcgagagtatcgngtcgcgggtttttcaaaacgagactttttttacattccctaatgattggctattattanacttanaaatagtctttttttatatgttttgggcaacctaaaatttatanattttcattttcgaaaaaaatttatttgc

SEQ ID NO: 29126 - DNA, 1162 bp, Heterodera glycines
ttgattcattttcaacaaaatgttttcccaatttttgttcttcttttcaaaataattttgctgacttttgtccattttttgaagctcaaataaatttatgtacaaattgtcaattgctttgttaattttttctaaaaaaattgaataattatgaataaaaattaataaattaatttcatttccaatttaccaatttcacacgaaaaggaaacttgaaataattgagcagcaattaataaaatggagcaaacagcaaactcaaatgcattaattagcttcatttaattgagaagtaagctaaacataaatatttatattttcatatatttcttgaaaataaaaatatataatttataaaagaaataaataatgaaaattacttatttttatgaattcatggcgaattttattatgaataaacgtggcaaagcttcaatagtcaaaacaaaattttgatgcgattcaatgggatgagggagaccccaagaaaatcatatgaataaaaaattatttgcaattttattttaattgattttttaaaataatttataatagtttcaaattaagtttaaaagatttaagatttttttttaattaacaaatatgggcataaaaattgatgaaaaagccggaaaatgccaaatgcatatcaattgtttaggcacatttcaattttttattaaaaaataccaaaattaatacaaaatatttaaatttttgcaaattttataaaaaatgatgtcttcctcatcagctttcctttgttcactaatgaccaatttttttttgatagaaattttaggttggctgtttaattatctcatatgcttgcaaacccggcaaaaaaaccggcggagttgggaaaaaactagtgactaaaaaaaaggtaggaaatttttaatttatttaaatgttttgtaaagcattattatttcaaattataacaaataagtttgtgtctgttttgctttctatttcatttaataaaatataaagttcattttttaattaagcctattttaatactccttaataggtccatagataaaatgaatgtcatagggtaggaattttgatcagtctgatgagagtcaaatttttctttatttgaatcaggacgaatttttcaataaacttcttttttcatcgctcattatgcatt

SEQ ID NO: 29127 - DNA, 367 bp, Heterodera glycines
agcatactgtaaaaatgatacggtttttagctgtgacaatgagacacagaaaatgaccatgccaatcgacattttggaggtgaaccaagtgatttccatccgactgttgactgataaaatgctggataacacaatcacgctgaaactttggcactcaattcaaggaaaggaaggtaggtagaaaaaaatcgtaaatcttttaggaaattcaatttttttttaagaccctttattttgagatttcaaatttacaattttctggcttccgagtgttccggtttcagaatttatctgagcctcgctaacccaacctcagtaactgaaaattttttgaagccacaaaagctagcgcaagtacattgttgtg

SEQ ID NO: 29128 - DNA, 1280 bp, Heterodera glycines
aaggagtggcactaacgcctaaggcgcacatcagcagagggaccgaaggcagcagcgactgaattgggatgatcaggaatcagtgagctttccaagtaatcaatctgctgatccgaatgaccattcagcagatcatcagctgatcagtctgttgttcgaataatcaaactgatcagaatagttggtaaatccataccaacctgaatcagcaatgttttggtaatttggccgttcaattccgaccatttgctaagtttatattccacaaattgacgtctcaaataagcgtgaattttcaatgcgcaagtaataattgtcgcgtaaaggaaaatatcggagaataacagaaaaaggaaacttccggcgacgaaaaggtcactctaaagagaaggaaattcgaaatttacacctaaaaagcctaattaaggcgtttagtaacaaaaaatttacgggatcgcatcgtaatgccaatgccaatgccaatttgtgccgtcctcctccgtccctttgctcccccggcgtcaatgccaacacagaattttttgggtagccaaagcgttggagttgagcatcggttgacggatagcaacttattgaaagagcagctgcaacggaaaattcaaaaagaagcgccacggagagaaggccaaaatatttggggatgtccatcggaacctttctgaactgattaaatgagtcgggggggggggggggacaaagggggttcgtttaggccgaagccaaaaagattttctaaaaatatttagtattaattacttttttttaaatttttttaaaatttcgctacttatgtttgtgtgtttatgtgcttttcacctgcaaatggtcaaatagcggtagatgaattggacggcgattccttcgatggaaaagtaaaaaaggccaaaccaaagcataaacacaaagtgattggcgggatttggtaatgattggagaggccctgccatgacgtcgaatccgatgccattctccacgaagaacacctgccaaaggcaagggccaaatcattaggacaaatgattgggccaggaaggcgcaacattaggcggacaacccaccggaaggacgagggcggcgaggatcagcacaaacaaatcgacgacgcaagtctggacgagaagctgactgaagacacgcatttcgttggaagtgcggcggaggagaagccaaagcaaaagcgaattcaaagggacaccgaataaaaggcaaaacagcgaattgagctgatggagccacaaaacgaaagacatttggagggg

SEQ ID NO: 29129 - DNA, 2130 bp, Heterodera glycines
  misc_feature (1236)..(1237): n is a, c, g, or t
  misc_feature (1262)..(1262): n is a, c, g, or t
  misc_feature (1336)..(1336): n is a, c, g, or t
catttattaggggttatttttggacatttgtgggctagccatatatttgattttggattaaattggttataaaaagctgatttggtagcgcaaatgtccggactgcaatgtccgatttgcttaagccgcaaatataaggaaagtttttttcttaaaagaacaaaaaaaacttccggttcctacttcccaaatgatactgagaaaagggttaattagaaaatctgtgcacctttttcgactgtgccctttgccagtcgattgctgcggttgtttgtccagcgatatttgattcggttggatgatgaatggttgtgcgaccaaagtgcgcaaattggccagccaatcatcaaaggtgtcaacggttgccctctcatcgttgccggagtccatggaaaagccccacacgtcgccaagcgaatgggccggcgggggaaagacgggcaaagcacctaacaatatggaaaaccataatactggtaaaaaacaaaacaaaaaaaacgaacaattgctcatgcgtttgcacaacggacacagatactcgttggcctccacgttgagcattcgcgcgtttaacatgtgcggacgtcggagacgttcacgcgtattgttcgcatcgatgaatctgcaaaataatcggagtaacaattgaattaatgataaaaaatgactgaaatagttacttttgattaaaattaaaaaaaaaacagaactgtttatagcatgaaaagtgcatcaaatgtgagcaggttgacacgtgaagctcttgcggaaggccaatgggcgcaaaaatgttcagcatttcatctccaacaacacttgctaattggccatgtggcaactgcgaagcgatcattggcacacattgacgggcaaagagtgtcgagctatatgaaagaaatggaaaattaatgaaagaggtattcgaaaaacggatattgataccagaaattgggtcggatagttcaaccgacatccgcgtgtcagcccaccccccccccacgggttcaaacttacatagaggtctaaacagcattaaatttacgaaaacttgttcttttggtttattaggaataataattacgatgaatgaaagattaattattttttgaaaaattttattgacgatcaaattatcgcaaacaatcattttttcgcttatttaaagcagtttagtccatctacgattgaaaactttaagttttaacccgattttggacatagggcgcaatgtctggnngcgcaatatccgaggaaacactggntgggttaacgacacaaattcttaaaaaaaaaattcaaactcattttttaaaatttttcagctatttttttcagnttcatttatttggaaactcactttttgaacaaagggcgagcaaaacatttccgttgccggcaaaaaaaatgatttcctccctcctggaccaaaaggccactccctggagggcaaaagggggcaatttcaaggcggagattttgcggggccccaaaaaaaaggggaaaacggggggaggtcggggcgccaaaaccctaaaaaaaaaggttaaatttttggaaaaaaaaaaaaaaaaaattttcccccaaaggttttcaaaatttttttttttaccccgggtttccccccttttaaaaggggccccccccctttttttgtgtccccccggggggggtttggtggcccccccttttttgggggggcccccccccccccccccgggggggggaaaaaaaaacccctcctcccccccacagggggggggggaaataaaaaacaaaaaccccccctttttttttttttttccttttaaaaaaaaaaaaaaaaaaaggggtggtaataatattttttttttttttttttttttttaccaaaaaaaaaaaaaaaaaaggggggggagaggggaggggagagagagagctctccccccccccccccccccccgcccacaaaaaaaaaaattatattttttttttttcttcctcttttttttttataaaaaaaaaggggagggtttttttttttttttttaaaaaaaaaaaaaaaagagagggggggggggggggggggggtggggggggggggggggggggggggggggggggggttttgttttttttttatttatttttttt

SEQ ID NO: 29130 - DNA, 1593 bp, Heterodera glycines
  misc_feature (1549)..(1549): n is a, c, g, or t
agagaagcaaataaacgaagacggaagaaaggcaaaaaaaggcaaaaaaggcggagggaatgaagaaaaatttaaatttattaattgacaggggattttggaaatattattaacttaggaaaatctcagattcccaaaaaatgccaatttcctctttcaaacatttaattttcattccgtagaggggcaagcccttcctccttccccccccccccccccgggtaataatggccttttcggcgtttgatgaatcaccgattccaaaactcctcacgtccattatttctccttcatccattcattgtcagcttccatatttcagttttgcttgatcatttgtcagcacacataagtcaatgacaaacagtcgatttgccctttattatctcaaataaatgcattttattcctttccaaatttatgggaaacatttagcaaattgtcaaaaacggctggcgcaaaaagcgacccatggcaaagggacaattttgaagataaaattaaagaaatgaaattaattgaacagaggaattgaagtgggactaaaatgagcgacgtcgtagtaataaaaatcctttcgagtgggagagacggaccgacgaataaaaagcggactacgaaaggggggggggggggacatttggccgaatttaaaaagcgcaacaaaattagccacgcagaatggaaacacttatttgtagggattttttagctctgaaccaattgattgaaaattaaatgcgccaaaaagttcgcttttttgacaatgaatggtttactcttttctctattaacatttgtttttcaacaaaagtctccgtgggaacgaaaacgaaaaaaaagttattatgaggcggtaggggtcaactgcatcttattgttagataataatgggccaataagtcaaaattaacattctacagatcggaactaccgggaccgggccccgatcttagataattgaccgggcccgggcaatccggttcaaaaaagcccgtttaaccgggcccggcccaaaattttggacaagtcgccagacgggcccggtttattagggacaatctttttgtgatttaacattagagtttccatttttttaagaaagggaatttatgatttagatataattaaagttcgtaggtgtttttttcaaattcagggcaaacagagttaatgaattttgacccaaattttgggctatcgtttcatttcccgggttcttctcaacaatagcggattttaattgccttgcaccggtcgcagcgtttatgtttatttttcagcattttcttcgctgaaattcgatttttgccttaaaaatgataaaaaaaatcaaatattggggcgaactttggggcaaaagcgagttcgatcaaaagagttgatttttaccgggggcattaatggtgaaaatggcattaatagttgggtcggcttttgttatgttccgtaacaatggcttcttctgttcgacttggccttctcttttcccctttattgatttgtctcttaattgccaaatcttcccgtgtctgaacggaattgtcanattcgttgggtgaagcaattggtccgattatggtcatcaaaagt

SEQ ID NO: 29131 - DNA, 927 bp, Heterodera glycines
ccggcgctcagttggccctcggatcaaaatgcctatagttttcctggatgcgccgtcaaaagatgcccccaaggtcaaaatctcgaacccctcccgccagtggttcccgagatttttgttttagcaatgaaactcgatgttgctttagttatatataaactagcgtgtgggaattgacgggggcggcgtaggccgttgggttttggatgaagataaaatggacatgctcatttgttattttaaacagacaaacattaattgcattagtgtgaagttttaaagcgctatcgcgctatgggacgcggcttcgccgcgtcgctagaaagtgatgtaatttagcaattcatcgcagcctcaggacgggcgattcgcgcccgtcttttaaatttgttgagaacattcggccgcttcgcggcctcaggacgggcgcttcgcgcccgttttttaattttttggggggcatttggccgcttcgcggcctcaggaagggcgcttcgcgcccgtcttttaattttgttgagaacatttggccgcttcgtggcctcaggacgggcgcttcgcgccatttttaatttttttggggaaattcggccgcttcgcggcctcaggacgggcgcttcgcgcccgttttttaatttttttggggacattcggccgcttcgcggcctcaggacgggcgcttcgcgcccgtttattaattttgttgggaacattcggccgctacgcggcctcaggacgggcgcttcgcgcccgttttttaattttttgggggacattcggccgctttgcggcctcaggacgggcgcttcgcgcccgtcttttaattttttaggggacattcggccgcttcgcggcctcaggacgggcgctttgcgcccgttttttaataaattaaaaaataataaacacggcctgggtccgaacatg

SEQ ID NO: 29132 - DNA, 717 bp, Heterodera glycines
ttccccctccccttctccccccccggcgaataataaaaaagttccccaaaattgtccaaatggactcctcaccccccaaattagtccgccatctcaaaagcctccgatgtgcccataaaaaggaagagatagccatccctaagaaaagggtgcaattgcgcaacgctttggatttggattttgatcggcggcggcagaagtgcgcagaagaaaggggggggggggaagcaaagggagggacggtgggaagatgaagcgcaaaaggggacagcacggggagaggacgacgaccagttcctgccccaggggatggacacggacggagacgaaagggccacgacaagcaaatgggggggggagagggggagaggacggacacgggggggggggacacggaccagttgaggggggggggggctgaaaaaatccattttttttgttttcggggcagtccccccgaaccgatgcgcccagatttatggggagaccgaatccttcgggaataggttccctatagcctgtactttaattctgcgttgcatttttgctccccataaatgtttgagtacccccatacggacacttgaaaaaatcgattttttttgtttcataaatattattctcaaaaagtgctctaaagcgcaccaaatttgatttacaacttaattcagctctctgatgctttcgaatcaaaaaggaagatggagaataaatttt

SEQ ID NO: 29133 - DNA, 920 bp, Heterodera glycines
  misc_feature (872)..(872): n is a, c, g, or t
ggtaggcagattaaaattttcaaaagcctcatttggcaggcaaaaaagcctcatttttacaaaatttattcaaaacacgtttaaaatgctcaaatgttatatttttgattttccatgatcaatttgagcaatttttgttagaaataagcatttgggaaattctgagcacgaaaaatcgaagttgattttttgcggcacttttttcaaaaacaaaaatggctgattcgcgctaacaaattatttttttcacactataaatgcatctttattagttaatacataatcaaacgagagaaagtggatattattagtcattaataactttggccttttttatccggcactccggctgattgtgagccaattttcttgactgacaaatttattcaaaagctcctcatgtcttaagtaccaaaatttttattaattaataaaattcaggaattccgtgaaaagtttgcaaaaatggaaatggaattgaaattggccaaattggaactcgaaattgtgaggagttttgccataaaaattcgactaaaattaagaaatttttaaaattatttttagaaggtacttgaacaaaagttaaagcatcaggaaatgatggtcgaacagaaggcattgaaggaaaaagtgatcaaaattgaacagaaaaatgaaaaaaaatgaaagaaattgaaaaaattttatggaattcttattgaataattcgataaaattaatgacaacaaattcaaaagctgaaaaatgagtttatggttttaattggtattttattcaaaaatttaattaagctacttcggatcaactctcaaaaatagaaaatgatcagaagactctatttgaaaaagtcagtgaattggagaagcagncaaaacagcagcacgaaaacacgaccaaagggcggggaaatttaagcg

SEQ ID NO: 29134 - DNA, 898 bp, Heterodera glycines
ctctccttccctctttctcctctctctctctctctctacctcaatcaatgctatctctctcttttctctctatcttctctctctccccactctctttctctccgtatccctctctctttcctctctttcttctctctctctatatttccctctctctctctgtctctcccctcccttcctttctctctctctcttttctttctttctttttccttatccatatctctctcttctctcttcgtgtctctcttcccccctctctctcccttagtctttctctctttacctctctatctctccccctccctctctctctctccccactctctttctctgcttgtctctctctccctctctgtctctctccctcttctcgcctccctcttactctctctctttcttgtctctatctctcccctccctctctctcctctctcttccttatttctctcaatgtctcccccaccctctcactctctctctttctctctcttccctcccactcacttctttctctcttttctcttgtttctctttctctctccgctctctctctctccctctctgtctctctctccctctctctctctctctccactccccctctctctctctcctttctccctctctctccctttgtctctctctctctccactctccctctctatctttctccctctatatccttattctttctatatctttcttttctctctctctatcattattccttctattctctttcttctcttgactctcattctctctctctctccccccatcctctttctctccttgtcccctctctgtctcctctccctcccctccctctctttctttctttttttctttctctctttttacttttctcccctctctcactccccttttttccct

SEQ ID NO: 29135 - DNA, 969 bp, Heterodera glycines
  misc_feature (959)..(959): n is a, c, g, or t
caggggtattattttgtaaagtcttttttcccccaataaacttttcataccccatttttcgcaccatgaatgttatttttattgaattctgaaccggtttgagtagattagactacaaaaaattgaaaatttcgaaatcatgtttcccactcccttctcccaggggtcatgtttcccactcccttctcccaggggtcatgtttcccactcccttctcccaggggtattattttgtaaagtctttttttccccaataaacttttcataccccattttcgcaccgtgaatgttatttttattgaattctgaaccggtttgagtagattagactacaaaaaatttaaaatttcgaaatcatgtttcccactcccttctcccaggggtattattttgtaaagtcttttttcccccaataaacttttcataccccatttttcgcaccgtgaatgttatttttattgaattctgaaccggtttgagttgcttagagtacaaaaaattgaaaattttgaaatcatgtttcccactcccttctcccaggggtattattttgtaaaaagtcttttttcccccaataaacttttcataccccatttttcgcaccgtgaatgttatttttattgaattctgaaccggtttgagtagattagactacaaaaaattgaaaatttcgaaatcatgtttcccactcccttctcccaggggtattattttgtaaagtcttttttcccccaataaacttttcataccccatttttcgcaccgtgaatgttatttttattgaattctgaaccggtttgagtagattagagtacaaaaaatttaaaatttcgaaatcatgtttcccactcccttctcccaggggtattattttgtaaaaagtctttttttcccccaataaacttttcataccccatttttcgcaccatgaatgttatttttattgaattctgaaccgngtttgagtag

SEQ ID NO: 29136 - DNA, 703 bp, Heterodera glycines
tttgatgatcataaattacggatcaagacatctcttaaaactaataaaacacagtgatcttgctattattcgataactctttgtttcctctattaacctgcaaaattccaaaaaattccttaggtttctaaaaaattatgaccaaaactattcaaaaaatttggcctcttgtgtacttttgaccataactttgctcaaacttgaccaaattttttgaaacttaggtgagctaatagagaactcttagtgctatcggatgataccaagaatgtttaatttgattgacattgacaaaagttatggccaattctttgttgaaaatttccattgatggttttttatataacgcccctttttatagttatacttttacgacatagcaccagcccactccacccacataagaggtggcatattgctaacaaaggaaggtccccaggtgtttacgtaagagggattcgaacttgtgggggcaaaaagtgaaagcgagcgcacaacctttgcgccaccgaacagcataaagtgatgcaattgattattcaatttattgggataaaaaaaagtttggcacgtcataactcggcacccgtacttatttggcagaaattgaaaccatttttcttaagaacccatgggtgctctatgcacccaccaagtttcattcggaaatcccacggacacctggggaccttcctttgtaagt

SEQ ID NO: 29137 - DNA, 1036 bp, Heterodera glycines
catgttgaggtgacgaagcatccttccatcagccgctgtactcgatcgacaagttcttgcggctcaccatcccgtctccctggaacccctcgaccttgaccgcggtggcggctgggttcggcgcgttggtccactccacggtcactcggtcgcccttggtgtcctcgctgccggggtcgaaggcgtcgcaggagccgtccaccttgccggattcctttgggccgagccctccgttcggcgggttcatgttgatgcacttcggttagcgcgtcttgaagatgtagtccgatgtcatttctaatccctaacccgaactcgaataaaaatcgaaattttgaatttttcaaattatgattttttgttcaaatttagattaggaaatcggaattgatcaaaataattgaaggattcgtgatcggggaccccaaaagccccagagaataaatttttatgactatcacaaaaaaattttgcaaaacaaaagggtccccccttttgaaaaaattttcaaaaaggccaactttccatatagcgccgaaaaattcatataaaagttcatttgataaattctcttccttttcctgattttacttaggtaacattcattttcttcaaaatgactaatgctgagtaaacaaaatcaatttaatgaaaatggaagaacggcaaaaagaaatgaaagaatcgatcgatgaattgcattagaaagagagaaaaaattcatttggcggtagtggagggaagattggcaaagggtaaaacttggtaatttacaaaagaaagcaaaaacggcatgacatctcccattcgctgtgctcgttataaatattttaaaatcaaaaattcttgtcaaaaattacaaaaaataaattttaagatagattttttgagaaatttttcatttcttagggtgtatttttctgaaaaattgtggggtcaattcttaggggtgtatgtagagcccggaaatttcaaatttgcggatcctgcattgggggagggaattcaaaaatttttgcaggaccggatccggccg

SEQ ID NO: 29138 - DNA, 1251 bp, Heterodera glycines
aaaatttcaattttttgggcttttaaaaaaaatttttttattttttttcgcgcaggcccttcctttgacaattttttttttttattaaaaaaaaaaaatttttttttttttctttttgattttttaattttatcccccccagaaattttttaataaatattttcaacctcccccttattaatttaaggagaattttgcctttttaaataatttcttttgagaaaagacaaaaaaataggcttttaaaaaatatgcttatataaatcactttattttttctcacttaaaaatttatataaattttcaatttttttgccttttgccaaaaatttttgtttattttttggccagcccctccttctgccaatgttttttattttttaagaaaaataaattttttttttttcttttgaattattttaattgtatttcatcctgaaattttttaataaacattttcaaactttcaccttattaatttaaggcgaattttgccttttttaataaattctcttgtgaaaaggcaaaaaatagtctcttttaaatatgcctatttaaattactttaattgctgtcctttcgcttacgaccataccacgttgaaagcacgccatcccgtccgatctggcaagttaagcaacgttgggccttcttagtacttggaacggagacgtcctgggaatcgaaggtgttgtaagcttttttacttttttcacttataaatttatttaaattttcaattttttttggcttttttcaaaaaattttgtctattttttcggcaggcactgcctctgacaatgttttttatttatttagaaaaaaaaatttatttttttttctttttgattattttaattgtatttcatcctgaaattttttaataaacattttcaaactttcaccttattaatttaaggcgaattttgccttttttaataaattctcttgtgaaaaggcaaaaaaataggcttttttaaaatatgcctatttaaattactttaatttttttcacttttaaatttatttaaattttcaattttttttggctttttgaaaaaattttgtctattttttcggcaggcactgcctctgataatgttttttatttatttagaaaaattaattttttttttctttttgattattttaattgtatttcatcctgaaattttttaataaacattttcaaaactttcaccttattaatttaaggcgaattttgccttttttaataaattctcttgtgaa

SEQ ID NO: 29139 - DNA, 1235 bp, Heterodera glycines
tagagacgggaaattaagcacttaatcggattgagtttgatcaaaacacaggctacacgggttttagttaatcagggtcaagattttttgttttttgaggtttggtctctacttagctgggtttgatcagatcacaatcacacagaacttagctgataagagagattttttgagatttagatcaagactagaggtttgatcaaaagcccatccaattccatggtggcttacacgaatcattgtcgagacttgcagtaaagattggtcccattgaaggtcaattgtaatgaatgctttatgcccaccgggggcatgctgccataattacaatccaaaaaaaagagaataatttggctagaatggcttagactgagaccattttaaaataggcaacgaataaaaatgccagaaatggaagatgcactaagcattgtgatgcgatgcgggggaggggggacgtggcactccacgcacaaaacccagccaaaatgccaaaaaattttcagcccccgccaccgccccctccccgtaaagggcacgcgacgactaaaaatgtaaatgcaatgtaatgtaatacaatattaaagcacccagccaaaaatggccaagagccccgggggatgaagcaggtacggccaaaagggttgtggctgatggcattgggttttggcactgtttggccaaatcacgagtgccatcatcattgccccccggggaggcatcctttagcgccaggacggcactttcgggatccgagagctttgatcgttcgcaaattttcaccggaaatgtcctgattttcggatgttttgacaaattgaatattccatggcatgggaattgcataaaaaaaattgaggtgccataccaaaacttgtgccaaagttacacatggctctctctataccaggatttgttagaaactcggctttagtgtctgtcgagagtctcgaccggacccaaagatggaaaaatatttgtccaattttcacacccaaaattttgaggggaattgatgaacagacagaagagctaaagccgtatatatacaggattcatcatttatcattgtttgaaatttcaaaaaattttcccctccgccaattgagcgtttgtcgagagtctcgacacgctcaaaacaaacaaacaaaacaaattcaaataaaatagtcagtctaggcctttcgccccaaatgttttgttttgtttgtttgacgacctaccataatctattg

SEQ ID NO: 29140 - DNA, 1016 bp, Heterodera glycines
taatgaattttgttaagaaaatggccagctgatttttcataaaaatcggtcgattgtttcagttttttgattatttcggtcggtcggtttcggttaaaaaccgaaaaactcaaaaatgtctcggtcggttttttcggtcaaaaaccgaaagagctgaccggtccgatctctactcaaaatgttgtttgccaaattggcatagtgttggctcgaaagtcacaatttgacccttcgagacaagggcataggctttagcctcccccgtggctaagcctttgcttcaaaagtatcttgaatgatcatcacaattaatttttttggtattgcagatggagtctagctcgctggagtacgaagtgcagcagaattgtaatctgacacaaattggcggtgtgctcggctcaaagggttacggtattgcactgcaaaaaagtacggtgcaaaaattttcaaattttaatctttccttgctgtcttctctctactcacagattccgaatggactgatcgaatctctcgccaaattttgctttaccaaaaacgcggaattatcgcaatgaaaaaagtggagaataaatacgattttttaattaaaatttcagacaaaatggtggcgctcaaagtaatgcggcggcgaggagaatctcgcccaaaaattccaaaattttaggggtgcctcatgccatggcgttggttcgtcggttaagcagcagcgcatttcactgaatttgcacaacgtttccggcctgttcgtcattctctcaatgggcctacttttttcggtgaatttttaaaattaaattaatattttttaaatcttttattattaaggttttcattgtttgcgttgaattctatgcacgaaagcgtgagaatcagaacaacaaaaggaatggacaaaaatgatttttgggacatgaaattcaagacattttaagattaaagcttttaatccacgccaatttaatggtttgagaaagaaatccaatttatcgaaaaaatatgtaaaagtaaag

SEQ ID NO: 29141 - DNA, 802 bp, Heterodera glycines
tgaaatttttaaaataacaccggagataagttttttggcccgaagagcaaaaaaaggtcttaaggttcgcccctccgaaatttttttctggatacgggcttggaaccgtccatcaatggtctcaactttcagtccctcttgtgcctttcttgagactatcgagcggtcacacctaatcaggtcgctgtctccaaaagtgcagactccgcttgcgtcaaacgtttcgccaccactaagaagatgccgttgtgtctgttgccatttgccatcggtccgttcactgcagtcgaggtgcgcacttgtcatcacttcaataatgtggggatggggtaaggcgcggggggcacgctggcacaataattttatcaccaaaaaaagggaattaatccggaagaatctccgaaagaattatgcggccaccgtgtgttcattgtgctcacctcctcctccgttccattaacctttacccttattggcatattggcaagcggacatttcaaatcctgaccctcctctcccccccccccccccctcccttccgccgattggatattaaaaaggagcaaatggggggagggtgaggcggatgatcattttttttgttgttgtcggatgtctgccgaataactgaatcaacaaacacccccaacaggaaccaccgttcttttcctttgtctctcattaaatggggcgacaggggaaaacgcttgttaataaatggtggggcgtggggacggctttggatttttgaaatttaaataagaatttgtgcccagaatctgaattttaaaagtttgtgaag

SEQ ID NO: 29142 - DNA, 1611 bp, Heterodera glycines
  misc_feature (17)..(17): n is a, c, g, or t
aatctccgatggtttgntcggcaatttcgacttccaaaagcggctcaaattcgcaatcagagtcattccgtacgggtttggaagaagaggaggaggaaagggcaaacggaatggaagaagttgttaacgaaacgcctcacttggacatgatggagacgagtgggacagggacggaagttgagaacgcgtcgaattccaaagggaagatcgaacagaggaagtcggccatcgcaccaatctgctcaatcactttgcgtcaacgatcgtccgcaatgaaatttgcaccctccgaaatgaagcggactcacagtgggcactatcacataaaagctgggaaaaaacaagagatcgacctgggaaacctgggtttcatggataatattttgacttgttatttcgagtgaccattccaggcctggattcagctcatgataaacctggattcccagaaatccaggcttttttcaaaatatcaagctctaaaaaattattgcacatcatctttttccttcattggaattttaacttttcctcccattttgtttagttgcaacgcccgctttttttgcccccgctttgccctccgtttcaatttgtgaagcggaagggactccttccttcgccaccgcttcctccatcccctcgacgccgctttctattgataatgtttccgtcactgcttctgggcgcctgaaacgcgcagcggctaagaaagttcggtcatatcaagagccgtcattaagcaagaaaatgcgccgatagaaatgaaaaattgcgaaggaagaaaatatatttatattgatcaattctcagttttgcaaggaaattatttggttttggattcctttttcagcagataaattattttctaatttgaaagtgtgacatttgggtcatttattcttatcaaatggatacgagaaagtattgttagaatcactttttgtttttaccgcatttgtgaatttgttagagcgccgtcatcgcttcgtctgtcgctcccttttcctcgtcgtctctctctcccagcgttttcctcagcaatgggcgcacgtaaatgtgaggcggcgatggtttgctgtcgccctttgcgccgttgttttcatagccattggcactggggatgattttcacttcggccaaataacagctggcgattgcggcactttggggaggggagggcggcgggcgcgcacttcggtcactctgtcaaaaggacacgaacactgaacgcactctcaaccatcgaccaacttttcctagcgaccgaaatctttgacgggacatcgctttgttccgttcggcgccttcctcacagccgctgtcttcgtcttcgccctcctccccaccgttggcgtacaaatgacgcgcacagcgaagcaccaacggacagttgcagggacagtggcacaaatggtggctgtgcatgtgctgctgctggggcgacagccaaacgggcgaatccgtcccgccggaagagtccaacgccctcgtgcagttccgcttctgctgttgtgttgctaaataacttttgtctcttccactcatcaatctgcttttggtttctccttatgcccgctccataaattgagcctttttgggggcagacct

SEQ ID NO: 29143 - DNA, 1262 bp, Heterodera glycines
ttgtttagacatttcgccgtgccaccacttctgtcagttacaatattcaactttttttttgggtggaaccaatgccaattgaaccatttgaattggagaacaaagtgacaaatgaaaagctgacactgaaactgagcgaagaatccatcgaattagaatataattggctgttaaaacgatgcccaattggggagacggcgccagttaggtgggaaaattgcgaaaattcggatgccaatttgaactaaattacagatttgatccgcggtatggcaataatgcgtgtgccaatttgaacattgtccgatttgatttgggtggaaatcattggattgggtgagccaacaaaagcaattttcaattgtcgaaaaatgaaaataattttaggccattgtcgccgccagcagtggtagaagaagaattggattaaagcaatgaaaatcttatttgagaaataatcgacgctctcaccaattggaaactgatttgatggtctacaatttttctccgaaattcttttgttgattctttcgttcgaataaaacatacgtttaataattagggctgtgaattttagtgacggaaaaacccaaaatagttacctaaaaaaatttttgccaagaaagtaaatttttgagaaaattttttttcatttcataggagtatattttgaaaaattttagctcgattattaggggtgtatttttttgaaaatttttaaggtcgatatacagggttggcaactgaaaattttcaaaatcagcatttggggtcaaaaaatcagcatattgtaaaaaaaaatttctaaatgaaatccatattggttgaaatgaatgtcgtattcgtgataagcgaccacgaaaagcccatgataaagcattttatacgcctttttaaaaagtttttcgtaatacaaacagtgtgtccattagaataaggacaccctattcagggacgtatccaggatttgggcttgggggggggggggggtaccgatccgaaaagtcaattcttaggggtgtatttttgaaaattcttcgcccgaacgaccttttttttttgctcataccagcgacgctgggaaaataggggtgtatttgaaacgataaattagcattttttccatcgtttacacaatggattttgaaatttagctattttgacggcttttgctccgccacgtggccgccagcaaaatgtttctttgtaatttggcgtgtgagataaaattaatatgttgctttcgttatgataatttggcg

SEQ ID NO: 29144 - DNA, 1499 bp, Heterodera glycines
ggcacgccgctttatgccagtgacgattttttgtgtgatgacatttgccgcactgtggttgcaattgtggtcgccaattgtcttcagaacgacatcattgagcgctgtgtgaaggcgtcccctgcacttgaattcatcacgctgatgttcacagcgccaaaattttacgtcacggtcggcattgaacatatggaagacatagaggcatccttcatgttcgagttttttgttgttttgtttcgttataatttgattgttttccatttttggggctaaattaaaagattaaaacaaataatatataaaactacgtttacaccagggctggagcgcgcacagaaaaaaccgcggccgcgcaccgcgcattcaaattaccgcgaccgcggatcgcgcaaaaaaaaacgccgcggatcgcgcatcgcggtcgcgctccagccctgatctgaagggctttcgaatgataaaaaattgttagatttggttgacaaagaaaaaaaaagttatagtccaaaacatggctggggccgaaccgtgcggggccgaactgacgtagaccgataatttctgcaaaaatttttataaaatgattagtgtgcaaattgctgagtttattgattgttcgacgagttataccttaaatggctttggcaatcgccaagatcatttggtcccacaaaaaagagggaaaccccaaaaataaagcaattttaagggtaatttgagacgctgactgagtacgaatttgatctttttgcgcagtttcgaacccctaacccgaattcgaacgttttttgaaaaattattttttatttcgtacaaattttaatgggaatgaatggagaaacaaaggaagaggaggaaaatagcattggggaaggaggagagacggaggagaaagagaggaaaaggaaaaattcggcgcaaaaaggaggaggagaaaagagagaggaacagcagcaaatcgacactttaatgttgccggtgctaatattgctaatggctgtcgtaaatcccccgtcaaaatcccgaaaaataattgtcacaacttttcaaggaaaaattcatacatcgatagatagcaaaaattttggcgctagcctacacgaagagacccacgtgctagattctttttgtgttgactacaactgcgtcataattactcgtactatgcacattgatctctttgacgacgatgatgagtcatgagaacaatactaacactattgagacccaagcattgtttattaatttggcattgttctctaccatggagaaatctaacgaagtcggaatgtccatcaacgaatttctgaaagatgggaatgggaagttttaacagaagacagactaaaccaactttacctgaaagggttggaatgtgtgctgaagtgggaaatggtaacggcgtgaatacgtccgatgttgtaaatttcgtgttcccaagccaacctaaagataacatcaaaacagaagttttttttacttaaaatacatctaat

SEQ ID NO: 29145 - DNA, 901 bp, Heterodera glycines
aaagctgtctgatctgttcatggctcataaaataatttatggccgaacagatcttaatccctttgaaatattcaaaccttctgaacgctttaacattcccttttatagacttaactcgaaatataaattaggcaaaaatttataccttttgcggggcgggtaacaaaaatttggaaccaactcgataaaaggctcattgaaataaacgcattaaatcaatttaaaaataaaattaaaactatctctattcccgtaaaatagaccggaaaaattaaagtcgaatttttaatccattcaaactaaaagtgatttggtcgctatttatttatttgtattgatttcatattatattttattttttggcggcgatctcgtttttaattgttttgcgctttcttgaggacattttttaaattaatgttttgtcctcaatgtaagcggatttttcccttttgtggactttttctttattgacattaaacaatacaactgttaaaaattggagtcaaagggaaaaataaaaaataataattaatatattctttaaaagtaacactgcccaagtgtgcaaatggcctaatggctagtctccttgactttcccttcttctttcccctggttcaatccctctacagaaattagattattttcaatttttttttttttatatactcgtgggtttcctataaagaaaatatgattcctcatagttttttttaaattgatacatattttatcattttttaaatgaaaatcctaccaattgagcttaataatcgcaaaaaccaacctttttttgttgaaaatctgttaacaaattgcacccaaatttttaaaatttccccccgggcggcgcctatcgggaaccgcccggaaccccttcttttcccaaaaatttttt

SEQ ID NO: 29146 - DNA, 1634 bp, Heterodera glycines
gaggagaaacggaatcagagacagaagaagcgcttttcagggagggaggtgctaaattgaaaaaacaaaataatgctttgatgtcggtatttgtcttttctttcacatttcgatggtgtttttgagagcgatgctttcgaataattttgtggcgaggagccgcgagaaggaggcgaaacggaggaccgcttctccgacaatgcgtcggtgccaattttctcacgggacaaattgtccatcgccgccgccctttcattgcctttatttctgtcgacaaaattatccgggaaatgcttttccttttccccttcctccctgttggtaatcagagagatgacaccttaatgtacaaatgcatatttattatccaaaaaccaaattttgataaaacattggcaccttttgatggcggagaatcgggtggcgaattgccggcacttcgactggtcaccgccagcggagagggccggaccggcaaattccgagagacggatgacaaaatgccatgctcgaaacgactcgtcacggaatcgtaaatcaaacgattggaggaagagaggggggaagagtaagtgttgaaatggatgttgcgatggtaagaggaggagggactgcgccggcaaacagaagacgacgggtcgtacacagaagacgaattcgacacgagggaaccgccacttaaaattgcaaaacaattcaaaaaccgttttgttggcaaaatgcctgccttggaatgccattggacgctccaccaattgaagttcgctttgttgcccacgtggagtaactgttgtaacgcctttcaccaccaccgccgccgccctctcccaaagacagtcctgcaattttttttcttcttcggcacaaaatgggctaccactttaccagaagtgtaactgacacttcgttttggagtgtatgtcgaagctgaggagggggcgggcgaaacacgcggagacgaactgaacggaacaaaacggggcgaactgctggacagggcagaaacagcagtggaagaaggggacggaaaacggtgcaaacggtcgctgctgccggggtaatggggagaagtggcggaaacgaagcggggggaggccctttcattgtgtagggaaaaagacatgggaccgaacccattgtgatcataacgcgaggccataaatggaaaaacgaagaaaaacaacgcaaacaaaagcctatcaaatctgaactgaattcatttggcaaaacaacaaaaagtcagcaaaaaggagggaagggaaggaatgcgaccacatttatttaaaatcggttgctccaccctcaccaagggaagaagcagcgaaaggatagagatttgagggggaaggaatggacttggggggcgggagacagctgttgcaaaattggagcaaattgttttaaggagcgatcgatccgaagacaacaacaacagcaatgagtctgatcatttagctgtatacaattagcaaagttctcaagaggtttcaagaaatttgaaattttgttcaattaaaaagccaagaaaaaaaatcaaagtttttgccaagcgcaaaggaaaagcagcacattcaatgcggattggatttgacaccacaaatagcagtgacaacgagaataaatttgggaacaaa

SEQ ID NO: 29147 - DNA, 952 bp, Heterodera glycines
cttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactggattctgagagcgcctgaaagcagctttcgaatggtatag

SEQ ID NO: 29148 - DNA, 859 bp, Heterodera glycines
tgaattgggcatttgcgtgatcactttcatttggcagtgttatagtgagttattgaattggcaattgcgtgatcactttcatttggcagtgttatagtgagttattgaattggcaattgcgtgatcactttcatttggcagtgttatagtgagttattgaattggcaattgcgtgatcactttcatttggcagtgttatagtgagttattgaattggcaattgcgtgatcactttcatttggcagtgttatagtgagttattgaattggcaattgcgtgatcactttcatttggcagtgttatagtgagttattgaattggcaattgcgtgatcactttcatttggcagtgttatagtgagttattgaattggcaattgcgtgatcactttcatttggcagtgttatagtgagttattgaattggcaattgcgtgatcactttcatttggcagtgttatagtgagttattgaattggcaattgcgtgatcactttcatttggcagtgttatagtgagttattgaattggcaattgcgtgatcactttcatttggcagtgttatagtgagttattgaattggcaattgcgtgatcactttcatttggcagtgttatagtgagttattgaattggcaattgcgtgatcactttcatttggcagtgttatagtgagttattgaattggcaattgcgtgatcactttcatttggcagtgttatagtgagttattgaattggcaattgcgtgatcactttcatttggcagtgttatagtgagctattgaattggcaattgcgtgatcactttcatttggctgtgttatagtgagttattgaattggcaattgggaggtcacttt

SEQ ID NO: 29149 - DNA, 1487 bp, Heterodera glycines
  misc_feature (35)..(35): n is a, c, g, or t
  misc_feature (53)..(53): n is a, c, g, or t
aaagtgccgactgttatcatcagccggacacgccnggatgatcaacgccgggnattaattgactgatcaagaataaggaatggataattctaaatatttttttattagtttagatcagaaaaacacatttcaaattatcgacttctttttaataaaaaaataaaaaattgacactaattggctgaaaagcataaaaaacaattaagattgaaagtaaaagtaaaaaacaaatgttcagtttttgtgctttttagaagcgattattttagtattaaaaattccttcaccttcttcattaaaactaattaataatgaatcatttgacgacctgctggcacacatacatatgccctccccatatttttttacgatgccctccacttttgatgttggcatcgttggcacttcccatgcatgatccagtgggatgaatgccattctcatcttgataaatacaaatgccttactttgatttcgaaatttgtaaatgctagtgaaaaggaatgcttaagcattggggaaagcaagcaaatttaattgggcagcttctctagtgccttgccggtgccgggtgctgatatctgctcagaagcttattcaatcacactcacttggcattatgccaatcaacgcaatcgttaacaggggataaaaggcatttaatccagagatagaaaggcatttttgccatgaaaaatgccaatatgatacgatgtatatctttagagaatagaggcttttcctattgggtaagcaagcaaattttttttttgaggaggaagatgagcaaatccattcggccgcgcgcgtcaatgcattttgccaacgcttaacctgtggattaatgattatggcgtttaaatattggctgaaaagcccaattaaatcataataatagtaataaaatttaaaactgctgctaatggagctgctgcgaattgccatgaatcactcgatgctattatttctgtgctgtgtgctgctggcaaatgaatgccgtgggcccccagttggagatggtgaaaatgcattcaattctttttatccatttatgctttgggattttaataaatcctgatttataaattttatgcctcaaaattaggttccagattccctcatttttgggcataggaattataatttcagaaattttggagtgttagctgatctcagtttccaaaattttttgaagcttcgaaattccgctatcgaaagccacgtgataaaaaactaatccaattcgaaatatttatctaaattgcctagaaattttcaatttttttaaaaaataattaatatgcgacaaaataaaatttactgatgcttgacttaccttcaacagctggagaagaaggtcttggccacaaatgcgtaaaagcatgtgtgcgctgtcttgcgatgtcctcagtgttaggaggcttaaccaatgtcggaagtgttgaaggcatcagactgtggactatgaacggattgaacccttcttt

SEQ ID NO: 29150 - DNA, 1013 bp, Heterodera glycines
  misc_feature (46)..(46): n is a, c, g, or t
  misc_feature (54)..(55): n is a, c, g, or t
tgctttttgaccctattttcatattttaaataataaattagacttnaatttacnntattcatcagacctaaagttctaaaataaacgaaattaatttcatattgtcgaaaggacactaatttcagcgaattatttcatagttgttgcacaagtctataacgaactattttgcatgctttctaaagaataaaatattactagtttttgctccaagtttctatagggctaattgtatcgcgagcgaatagcctaatggcgaaacctgcataattaaacgaagcaagtagtaacagaaaagcttcgttgattctgagaggcgaattttgccaaagattatcgtcctcttttttgcccttggatcatacggggttgtagtgcagaaagaaacaatttgcgatttaccacctgttaattgctttttgacccttattaataattttaataataaattagaacttaattttacctaattcatcagaacctaaggttctaaaataaacgaaattaatttcatattgtcgaaagaacactaatttcagcgaattatttcatagttgttgcacaagtctataacaaactattttgcatgctttctaaaggataaaatattactagtttttgctccaagattctatagggctaattgtatcgcgagcgaatagcctaatggcgaaacctgcataattaaacgaagcaagtagtaacagaaaagcttcgttgattctgagaggcgaattttgccaaagattatcgtcctcttttttgcccttggaccatacggggttgtagtgcagaaagaaacaatttgcgatttaccacctgttaattgctttttgacccttattcataattttaataataaattagaacttaattttacctaattcatcagaacctaaggttctaaaataaacgaaattaatttcatattgtcgaaaggacactaatttcagcgaattatttcatagttgttgcacaagtctataacaaactattttgcatgctttctaaag

SEQ ID NO: 29151 - DNA, 1295 bp, Heterodera glycines
ttcctcttccttaattcctcctctttcctcttcttttcttcctccactttcctcttcttttcttcctccactttcctcttcgtttcttcctccacttttctcttcctttcttcctcttcacgaatcttttgttcgtccggtgccaaaagggtcttctgttctgtcacgcttagcttctcttggcgcatcggttgtaccaccgctttcttagcaaaatctgtgcgcggtttgctctgtcctgtcagcggacgtgtcgcttcttccgttcggccatccctgagttcttgcacccgaacataagtctcctctcggcaaatctgtaaacattcgtaaatgcattgttaattaccctctaatagtagctaattagccacctctttgctcccatcaatgctttgctcctcttcgatctgttccaattcttccatgttcatctcttctccgtccaattcttcgaccgtcgcgtgtccttccaacatttgttctgactcttccgccatttggacaaacattggagaaggacttttctttgcaatgggagaagtctcttccgtcgcaacgggcttttcctcatcctccacgatggctttcagctccgtctcttccgccggcttctgctgctcttcttcgctacacatactttcggcactttctccggacgaagaagtcgatgaaacggaccgactccgatgagagggcgaaactgcgcgagaagagggtctgctgccgtgttcatcgcctgagacttcttcctcctccacctcctcatcttcctcctcctcttcttcgtcctcgtcgattgacgaggatgaagtataagtgcccgaagtgtaggaaccggacgaagtgctgctgctgctggtgaactcctcgtccgacccgcgcatcgcacactgttggaccaacgtgaagccaacttccacctcatccgcggagggctcagtgtacgaagtggagtttgttgtgcctaaacaggggaaagccaaatcagaatgccaacagcagagaggtgcagttgctgctgctcctccctcaccttcgtctgaataactgcgccctccccacgagtcgctcatcccatcgtaactaattgaggcggtgaaaatgggcggaggtgccaacacattggaaatgtctttgtccacagcggacggacccaaggcgaacggaaattcgaagtccgattcgtggcccgacaattgcagagtccgactgacggtggcctcgtcccactccccttcgtccgactcccattatgcggatggattgctcttttagcatataaataaggatgg

SEQ ID NO: 29152 - DNA, 1472 bp, Heterodera glycines
tgatgagagaacagacagtcagagaggcgaggagagagcggttggcatccatttagaaaatggacagagttttacaagttgaaaatttggtcgaattggggttcggtaaaaaaaaagagagtgcgagagagaaagagaaaataatttagaaaaattcctaaaaaatttacattttgggcgcaacaacacgcttgtggacaccaaagaacaggaagaggaccatcagaacagtcacacatgcagtgaacaacggatgttttgccaacgattcgcgaaatgaaatctgaaaaatttgggggaaagaaattaggggtaaaatttgatgaaaaatttttttacaaaaaaaaaaaaaaaaaaattccacggttggggcaaaaaattgttaaatttttgtgtcgccaagaggagacaatataagcgagccaaaaaaaacgggaacaaaaatcgtaatggaaaccccaaaaattttttggaatttcgaagctttagggaaaacggagatcggcaagcctaacccaacccgaaaaagaaaaccgaaaattgaaatcctgacaatgagcttaaaaaacggaagcgacatgccgagtcacacaccaaaaattttcagaaatttccctgtcattccaaaaaactaattaggtaaatcccatttttacgttgaaattttttttataaattttcattacataatcatttaaagtttaaaatgaactcacagactccaaatccggatcagaaatccaatgataagctgtgtaagcagtggacaacaacagcagaaataaaataactgaataaagtgtttaacattttctaattttttcccaatttaatcatacattacacaaggggtgtctcgacaccccccccccctcgttcgtcgtaagggggcggctgtaaaaaggggagggggtcgtcgtggaggggagtcgtaacgaaggggaaaaaatttttaaatttgcacaatttccttggtgaaatgaatacaaaattcaaaaaattttcccgacggtttttggaaaaacgcgtattgcgccaaaaccgagtgctttttgaacctttttgtttgttgcgctgcgtcggttgccaaagggtctgtcgtccaatgttaacacttcgtatccctccgacgttttaatttcgtcctcttcactgtcaagaacaatttcggaactcgatgagttcagagattctcgcctgttaaatcattttacaaaaagatcaaaacattgacaaaaccttttaagctgccttccggttgcttttttctcgccgtcactttccgacttaattgacttccgatcactttgtccattctcttcatcctcttcctcgtcgtcgtcctcaatcattgcacggtttgcttggcggaaaagctttttgatctccttaatttaaatacgccattagttgaacaataaaatgacatggaattaccaagtttttctggtgctgggcctcgtcattttcgg

SEQ ID NO: 29153 - DNA, 1096 bp, Heterodera glycines
ccccatgtgcttccaatattcgttgacagtctgttcaggattgagcatgaatggctggtgcaacagctgagtttcttctccgtccattctcgtcagcttaaatgggattggtgccttctctaagaaattgccatcccacctcggattggtcaacttgtgaagcgttcaaatcctcctcttctccggtgtcactttcatcaacgatttccatttgagttgctcgtttagctccctttttccttggttcacccaaactttccggcgccattccaatgatgtgctgacaaatcacttggccaagttgtgctgttggaaagtcagaaacactctcatccgatttgtgacccaaagacaccaacgaaataaaacgtcccaattgaacgccgttaaattcctctaaaaacaaagattatttcactcataaaaaccatacgacgaccttttggatgggtttgaccaaaaagtttgttcgctggtgaagaagaaatgacagatgctcgggcgagttgaatattctcgccaactttactcacagtggcaacgatcgcctcatcggcggttcgtccatccatcatgcggaatttatcatgttcttaacacaaattggaaatgttggtttttgcatcaaaccatagaatccacccaccaatattcttcagcgttagtttctgtgcttcatcaggcaaaggcagcaactccgaagcgcagttccgcaaggcattcaccaattctgtgacctgattattttgcctattgataaatagcagaattaaataaataccaaattcttgaattctgcactacggaatttcgatggcacattccttcagcgaatgccaatagggagcaggacaaagaagaaagatgcctttaaaatcaaacggaaaatcagccaaaaaagacaagaatggccgaccatttgtctcgggtcaaaagcttccaaccaatcgccatgcctctgtttgttgtcatatacatggagactaagaaagtcaatagaaatatttgaaaaaatctaattataaaaaggaagaaaatattcagagaccggttaaaatagttttggtacattcatattcaacttttttgttgtttg

SEQ ID NO: 29154 - DNA, 1229 bp, Heterodera glycines
caaccactaatgttttttcaaaaaccatgaccacataaattgtgtcgcactaaagtcatagaacaaacactaatgttttatcaaaaacatgacacacataattgtgtcgcactaaagtcatagaacaaacactaatgttttatcaaaaacatgacacacataattgtgtcgcactaaactcaaataacgaacactaatgtttatcaaaaacatgacacacataattgtgtcacactaaactcaaataacgaacactaatgttttatcaaagacatgacacacataattgtgtcacactaaactcaaataacgaacactaatgtttatcaaaaacatgacacacataattgtgtcacactaaactcaaataacgaacactaatgtttatcaaaaacatgacacacataattgtgtcacactaaattcatagaacaaacacaaatgttttatcagatatttggctatttggcaaatttaccacaactcttcccaacccacttacaaaaggggccgccaaagttgaagtagtgaatttctcgaaagtgagcaaaaagttgagtggccgaccgacatgttcaacacttcagagatgaaatcacaaccaattgtaagccaacagcatttcttcaatatgatggttctcatttctaaattttacataataattaacataacaaagcaaaatgtaattcgaaacaaattaatcccaataaactttgatgaggcacttaagctcaatctgggcaagctgttgaatgatggccacggcagatttcaaacttgtgaatgaattcacaacgaatacaaaaccatgagcgatcataaaactttagttcttcatgtcatatctaaattttataaacataattttgcataaaaaccaaacaaaacaaacttcaactaaaatcacacatcaaaagtattgggtaagacatggatggccgaccggccgttgatgaaaaaaaaaatgccgaagcggcagagagaaagtcaatatatcaaacctgtagaaaattcaaattaagtaaacaattcatttttggctaaatcataaaaaatagacaaagactaaagcacaataatagactaactataagcatagacataaaatactatgcaaatgcattaattaatcagaacaaattgaaaaagcaaaaccaaacatttccatttttcaaatcattttttaaaggaaaacaaaacaaaaacattttcattttcaaatcatt

SEQ ID NO: 29155 - DNA, 1117 bp, Heterodera glycines
  misc_feature (927)..(928): n is a, c, g, or t
  misc_feature (931)..(931): n is a, c, g, or t
  misc_feature (956)..(956): n is a, c, g, or t
  misc_feature (982)..(982): n is a, c, g, or t
  misc_feature (992)..(992): n is a, c, g, or t
attaggcgttcgcccaggctggcatcatttggcagtgacagtgcaaatttggtcagtgtgccgcaaccatttgtgccacaatcggttgtcccgcttttgttgaatggattcgtttcgtctccatcggtgccaccatctgtttggcaaaatttaaaatcaaaaattccaatttccgacatttcgaaatgccatttttgagaatgtttgaagccaagcccgggaattccggttgcggattccaaaaattgaaaaacgaaaatttacggcgtttcatagatagagatatgccaattttcggattttttttggagtctcagaccagaaattttctgaggttcgagttttcggtcgtgatatttttcagggttatgctttctttaccttcaccggcggaggctggcacaatgacaatggactgacgattcatcaccagagatggagagacgccagaagaagacagacagacagtggaacggtgatgtgatcggagctgatcagagctataaaattatgtaatttttttaagggaaaattggaaattttaatggaatatgttaataaaaatttgcccattttctctttgaaaatttttaatttttcatttcgaggagggcataatcatcactgaactgcttggatttgtcctgctgcaacttgcgccgcattctgggcggtgatgtacacccagcagccgtcggcgggttggcaatcgatgaatgatgcgatttggcaaatgccagcaacgaatgccgatcagacacatcacttttggacatagaaattggccgatcacttttttgcaaaaaatttctccgttattttaattactgtataaaattacgatcccaaatctaccgtagggcaacccgttggacggcagcagtgggcccatggtttcggcatatttggtgccaccgccgctgccgnntgntggtggcggcaccgatttggcatanagcaccgacatggtctccagctcggncctccatttncagccccggagccattggcccaacttttgggtccaacaatgactcatcccgacgacgatgaatttgtggcatgcttttgcgcatgctgcttcatcttctcatcatcgctttgcccggaggagtag

SEQ ID NO: 29156 - DNA, 1505 bp, Heterodera glycines
  misc_feature (1328)..(1328): n is a, c, g, or t
tataattattattattgcatttaacatttttgttttgaaaaaagcggtgatttgtcaatttaattcgtttatttcaatatttgtcttattttttggattaatggacgaaagaatcaaattgcaattttcatcagagacgacggagtcgagaatgggtgaacaataattatttttatttattttttgaagatttctcgacgattttttgtccgggaagagtggtgggatcaacaacagtaaaaaaatgaattaattgcttgattgatgcgattatgagatcaattgtcgggcgttgttatgtatttaaatgttgtatttgatctttgttcattcacaaattaattaattaattaattagggctttttaccgatattttcatacatgaaaaatagagggtgggtttcagcgttttttttttgaaatccctccttagggtgcccaaatttctgctggtggggttacttgtaggttttgtcaccccctctcccctgaaaaaaaatttttttaaattttttctagcctcattttttgcgttaataacgcgaatttaacatttattttttaaccataaagtttgtcagtgatttacgtgaaaacgtgaaaaaaatttgaaaatgaaaaaaaattcaaaatttaaaaaagattattctataattattaaaacgcgcaaacagtgctaattacaacaaaaaaatgaacagacggtaaggaattttaattaccgcatttactcgattagaacccccctctcgaatagaacccccccctctcgaataaggctccctttatgaggggggttgaacaatagaggccccgggggctctaatcgagtaaatacgtaaatatatatatatatttttcattttcccaattttttcccccacaatttcagttggatttgcaacgacgtgtggatggacattctgccatcttttgaccgtgttcaacttggcctcaaaattgcattgctttcgccacgttttgatgcgctggtggacaaacattttgatggcaaaatgacggaattgacaatttggagagcaatcgaatttgcaaggacaatggacaaaaaccaatgttattagtcgactgggagtctgtggcatttcaactgccggaccgtccgctgcccaacaaaattcgcttttgtttccttcacattgcgtaattttaacacatttgggtacttccgtgttttgctacgccctcccctctcgaaacattttaaaatacatattttggtgggttttcaaagtcactgatcatgcatatggtgtgcctgtttcgacatttgatcacaacatcatattcgtgatcagtgactttngaaacataaaaataaagatttttaaaatttttcgaggggggagaggtagcaataaaataaagcatttttttaaatatttcttttcagctacattgaccatgccgtgatcacatttctccatgccaacaagagaatctttgacagaattggcaccaatttgggattgggtatttgggg

SEQ ID NO: 29157 - DNA, 1659 bp, Heterodera glycines
  misc_feature (1648)..(1648): n is a, c, g, or t
tgaaaagtgaaggattgagtcccagtgattggaatgctggtgggattgagtcccgggaataggaatgatggagaattgagtcccggtgattggaatatcgcagaattgagtctcgatgattgcgatgccgaaggaccaggtgaggttaggtcccagtgattggaatgcaggagaatgagtcacggtgattggaatgcataaaaactgagtccgggtgattgaaacgcaggagaatagagtcccagtgattgaagtcctggagatttgagtccctgtgattgaaatgcaggagaatgagtcacggtgattggaatgcataaaaactgagtccgggtgattgaaacgcaggagaatagagtcccagtgattgaagtcctggagatttgagtccctgtgattgaaatgcaagagaattgagtcccagtgattggaatgcaggggaattgagtctcggtggttgcgataccgaagaatcaggtgaggttcggtcccagcgattggaatgatggtgagttgagtcccggtgattggaatgctggagaattgagtcccagtgactggaatgttggagagctgagtcccggtgattggaatgcaggagaacagagtcccagtgactggaatgctggtgggattgagtcccgggaattggaatgatggagaattgagtcccagtgattggaatgtcgcagaattgagttccggtgattggaatttcgcagaattgagtctcgatgattgcgatgccgaaggaccaggtgaggttaggtcccagtgattggaatgcaagagaattgaccagtgattgaaatgcaggagaatgagtcccggtgattggaatgctggtgtcttgagtccctgtgattgaaatgcataaaaactgagtccgggtgattgaaacgcaggagaatagagtcccagtgattgaagtcctggagaattgagtcccggtgattgaaatgctggtgtcttgagtccctgtgattgaaatgcataaaaactgagtcccagtgattgaagtcctggagaattgagtcccggtgattgaaatgctggtgtgttgagtcccagtgattgaaatgcaagagaattgagtcccagtgattgaaatgctggagggttgagtcccagtgattgaaatgcaggagaattgagtcccagtgattggaatgccgaaggaccaggtgaggttaggtcccagtgattggaatgcaagagaattgagtcccagtgattgaaatgctggagggttgagtcccagtgattgaaatgcaggagaattgagtcccagtgattggaatgccgaaggaccaggtgaggttaggtcccagtgattggaatgcaagagaattgagtaccagtgattgaaatgctggtgtgttgagtcccagtgattgaaatgcaagagaattgagtcccagtgattgaaatgctggagggttgagtcccagtgattgaaatgcaggagaattgagtcccagtgattggaatgccgaaggaccaggtgaggttaggtcccagtgattggaatgcaagagaattgagtaccagtgattgaaatgctggagggttgagtcccagtgattggaatgcaagacaattgagtcccagtgattgaaatgctggagggttgagtcccggtgattgnaaatgctggag

SEQ ID NO: 29158 - DNA, 1645 bp, Heterodera glycines
atttttaatatttaatttttttcaaaatgtttttcagatcgaaaaaatcaattcagggacattgattcgatgtgattggatgttattatttgattaatgatgatgtcaatcattccatcgctaaagaaacacagaagcaatctttgccgctttagaaattatctcaaaaattatattttattttgtcaatggcttttcacttattctctaatttaataaaagttggccaacaattagagttgcccgcaattaattattttgaaattacgcgtagattatggcaccgagctgatcaaattgatttaactatatttttccctaacaaagaagaggtacccaagtgaccgtgggacttccacgaaaaaacatctgttcttttggcgaaaagataatctttctgatctgtatatttaaaagttatatctttcatcgttatctcagagatagctctacttgtatcttctaatctcggaagatctgtatttaactgcaactcctctagattaaaaaagttttcaattcttttttgtttcctttttgctatagaatatcatttacaaagaatgcaaagccgatgtgagcgtctctgggcctagtggtctttcctttccgttcattttttcttcaagttcaattcccccaccctgcaaataattgattttgtttttttttttgcacaatattttttaagctttttaacattaataattacagaagcagaaatatcatattcaaggtcaacacctcgaaaacaccccaagtactgttttgggcttcttaaaacatattttttattattgttaattttaattaaaaaagagaaccgaaaagccatatatattctgaccgagagataatgcttcctccaatttaattggttccactttcactgtagagagactgtcgtccatttccattgctcctttctctttatatagagtcagagcagagaccaaaaatatagaaaataataattgaaaaatgataatcgcaaggcgtgtccattaaagtccgttttgagaaagaggtcattcgggtaataaattggaataattggttgggttcgaattcacacatccttcttaatccccttaagaggactctgatgagactaatcaaacatcggaaacgcaaaaaaaagcgttcccaacacaaaagtaatggattatttaaatgatatggagagtcagaatgtttctgtcttcccctcagtggtaacttttgtgtccggcatttttatgaattcaaattaatccgcccaagttgtgccaaaaattgataatgggagtagcggttcagccattatggaatttgttggcagtggccagtcattttctttcccggaggcgttgtgttggtgtctgtcttcactgtatcgctttcctatcgctgtctgtctgtacagtctgctgacatgcaaaaacaaataaaagatatttcaattcaaaaaatgacttttgttgagactttaccgatacacaggactggatagtcaaagatccagcggtacacctcagtttggccgcaagtttgtgtctcagcatgctttcacactatatccaaatcaaatgtttttggtatcatttgaaagcttaacatatttataagatttttctaagcgttttctaagctatgcttcgcgatg

SEQ ID NO: 29159 - DNA, 1449 bp, Heterodera glycines
agcaatcgtttcatatatgccattgaaattgtgccgaaatgttccaacattttgcacattttgttcattgagcaatgcctttttctcaatttcatttatagcattgctcaaaacagctggtagaacatttgtgaaaatattcagaatatttgccaagaaaacttcaaaattttggccatcacttttcaattgtttacacaaatcattgcgcaattttccaaaatggtccatttttaattcaaatatggcatcattgcacataacgccaaccgatgcttttttcatcccatcaatggccaaatcgtcgctaattaccccttcatttgcctcattgaccaagtccgatgctgcgtccactaaatcctctcccgacttgaatgaatctaaatagtggtttgttacgaatttttatttatttatatgtaataactaattaattacataaatgggcagccgaattgaacccaaaaataatcaataataaaaaaaattacaccgaaaaaaagaaaggtggagttatactcaaatgtcagaattgtactcaaatacggtgttatattcaaatgtcggggtatccttaaatatcggaagtatatttcgaagcccaaaaaatttcttgtctctatatgaaaaagactaaaattatcggaatctttaagttttgcagcgatttttttggaaaatttttgaaaaacatacaaattctccataaaattcggaacgggccaactccgtctggccaactccgtctgagccaactttgagtcaatataactcttgaagttattgaccgaatcaaacaatcttgatatcattcgaaagctcttcacaggctctattggcctactaaaaattacagaaaatttcgaactataaaaaaagatagaaataaaagctttgaaaattctgccttttttgcggttttcaactgacaacttttttgagagctgattaatcactgagaaatagcttataaatatcttctaaacatctaggtctttcgaatgataccatgattgtgaagtttggccaacaaagaaaaaagttatagctttttgaacattgctgagacggagttggccagacggagttgacccctaccgataaaattcgaaaaattgctgaaaattttttcaaaaatttcatttattttttcttgaaattggataacacttcctttacctccaactccggttgatccatgcgacaattccggcgtttgatcgctttggcataacgaatgcgtaaatatgatggataacgatgagcatttggcgaattcgaataaaaggatttctattgcttatataggagggtctaatcacactttgtagatttttaccgagactcaaaaaaggtcaatacttttgttgaaatttgcgaagttctgatactcaagcttacattaggataaaaaaattcggcaatatgtacccctccccacccccc

SEQ ID NO: 29160 - DNA, 897 bp, Heterodera glycines
acaaaaataaatcgattttttcaagtgtccgtttcggggtactcaaacaattatgggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaaattttttaaaatttaaataattttccctgcaccgaaggtactcactcgg

SEQ ID NO: 29161 - DNA, 1371 bp, Heterodera glycines
agactgctcgttgaggcgctcaatcgccgccgccaatgctgcagcgttgttctgctccggtgggcggagtcggatgacgtacggtcgattaatcaataaaataagaaactaaaataaaaacttttttactgcaaaatgatttatacataaaatacagaaattatcatggtaaaaaattaaacaatggataaaattactccatttttacctcatatttaaattttgtggagaataaattcaattaggcaaaagaaaaggaaaataatcaaaaattaaattataaagttaaaaattctgccatttcagctgtaaaaggtggaatcagagtctcaggataccatcaggttttttatcaaggtcatttaattgaaaacattgtaacaagctttaagtttgtgagtcaagttgacctaatgaattccgaaaatttgcagaacaaattctttttatgaacccgaaatattttgtggtttaaattacaaaagaggaaaaggtttatcagcattagttttaggaccgggaaagtggtaattaccggtgccaaaaacggcggaaataaatgaaatgtttcatcatattctcctctatttgaaaatgtctaaaaagaagtacaatccgttccaaaattttgtgttcaatttttttttatcattaagaagttcacaaaaaaattggaaagtgtaaaataaaaaatttttttatgaatttttccccaaaattaccctaaatttgctgttccaaaattatgagttcaataattgaaggcatgtaactttttttatagagcaccaaaaatctgaaaaaattcatttcagtacaactttttatgctgatcataaaggtccattgcaccacagtgatcagatcactctcatgtctctatgagttctctacattgcgaaacataggtcgaaaagtaatccaagggaaagtggcgtaaaatttgtcattttttggatagtcgaattttaggcttacctccctcggtgaagacgaatcgtcgagccaggtattttcaaatcaaaatggttgtagaatgtctgttcatgatattcatgttaattggatgctgttttactattcaagaaaattgttagagaaggtcaaagtcccctgagggatagaaattctgatcactgtggtgcaatggacttttttatgagcataaaaagttatactgaaattaattttttcagattttttttgtgctcgataaaaaagttaaatgtcttcagtacaattaaataaaataatcaaaaaacttaaagatagtaaaacatgtcactgttcaaaaggatagaaataatttaaaaagcttatggaggtccgggttcgaacccaacataaaaaagagagaaataattaattgag

SEQ ID NO: 29162 - DNA, 1034 bp, Heterodera glycines
caggggtattatttgtaagtcttttttccccaataaacttttcgtaccccattttcgcaccgtgaatgttattttattgaattctgaaccggtttgagtagcttagactacaaaaaatttaaaatttcgaaatcatgtttcccactcccttctcccaggggtattattttgtaaagtctttttttccccaataaacttttcataccccatttttcgcaccgtgaatgttatttttattgaattgtgaaccggtttgagtagattagactacaaaaaattgaaaatttcgaaatcatgtttcccactcccttctcccaggggtattattttgtaaagtcttttttccccaataaacttttcataccccatttttcgcaccgtgaatgttatttttattgaattctgaaccggtttgagtagattagactacaaaaaatttaaaatttcgaaatcatgtttcccactcccttctcccaggggtattattttgtaaagtcttttttccccaataaacttttcataccccatttttcgcaccgtgaatgttatttttattgaattctgaaccggtttgagtagattagagtacaaaaaatttaaaatttcgaaatcatgtttcccactcccttctcccaggggtattattttgtaaagtctttttttccccaataaacttttcataccccatttttcgcaccgtgaatgttatttttattgaattctgaaccggtttgagtagcttagactacaaaaaatttaaaatttcgaaatcatgtttcccactcccttctcccaggggtattattttgtaaagtctttgtttccccaataaacttttcataccccatttttcgcaccgtgaatgttatttttattgaattctgaaccggtttgagtagattagagtacaaaaaatttaaaatttcgaaatcatgtttcccactcccttctcccagggtattattttgtaaagtcttttttcccccataaacttttcataccccatttttcgaccgggaatgttattttattga

SEQ ID NO: 29163 - DNA, 965 bp, Heterodera glycines
ccaaatttttcccaaccaaacgcaccgagaaacaaattccagcacattcagtatcggcgtaattttctgagaatgcggtgtaattcctattactgtgagcagaaaaagagatacccaattttccaaattttcccaatcaaacgcgccgagaaacaaattccagaacaattagtatcggcgtaattattctgagaatgcggttgattcctattactgttgagcagaaaaagagatagccaattttccaaatttttcccaaacaaacgcgccgagaaacaaattccagaacaattagtatcggcgtaattattctgagaatgcggttgtaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcagttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaagcaaattccagaacaattagtatcggcgtaattattctgagaatgcggttggaattcctattact

SEQ ID NO: 29164 - DNA, 1240 bp, Heterodera glycines
ccaaaaaaatatccaaatttttaaaaatctataaaaatctccccataaatctgggcgcatcgtttcggggggactgcccgaaaaacaaaaaaatcgattttttcaagtgtccgtttggggtactcaaacaattatggggagcaaaaatccaacgcagaattaaagtacaggctatagggaagctattcccgaaggattcgttctccccataaatctgggcgcatcgtttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggtttggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggaggatccctgcaaagtttggtacgcttctgctcaatttctaaaggatatgagtgatcgaattttcactaaaaaagttaagccgactctagaggtgccccggtcc

SEQ ID NO: 29165 - DNA, 1633 bp, Heterodera glycines
ccaattttctgaaaggtcaactcacgttgagacagcgcggaagtgagtttatacttgtccactttcaagataaattttctgtctacctcaataggaccatccgaacgctcttcgtcagctcgtgaaagcgtgtcgccagcgcaatcggttcagtcggaagaaccactgcaagcgccgcaggaactggaagctgctggtgatccaactggcgacagcgagcttacaagtgctgctgtacgactgaaggaactggatgagggcttcggtaaaagtgtaacatattcacttatctttattcccattatagacattactcattcatcaacacgtactcgaagctcgagggggcaatttggcaagtcaaggaagtgcgttttctacacaatccctttgaacgatgctgatggctatgcaatgttgaattgcggacattcatgccactttgaccagccctttgccgaatggtatttaaactattacctttattaaatcacacgattcataggtatgccggagcgcctttcaagaactgcaaaattgcgcggtgcaaaaagtctttgaaatgtaaatgcattgtatgttgtcaatcaattggcatgggcatttacgaaaccggctgttattgcgcggaaacctccgcttcagtttatcatgcggatgaattggaagcgaggtgctctttcataatgcaaatttgttattttagttttattataggctcaaagaaagcggtggcaaatgcccagattgcggcacgcaacaccccggcttttgcatgttgtgtcagcggctgttcaagctgcaggcaaatgggcttcgtcagagcaaggtgttcctgccttgctgtgactcttacactcacttcgaatgctggtagtgtttaatcattttggatttttaccccttttccttttggcaaattaggtattcgcccgcaccgaagcagagctgcccagcaaagtgcacaaagccgtggcaaggccttcaggacatgcattacgagtaagcgacgactcatacatttctttcactagtatttgcatttgtattttagtcaaatttgtggtgtcgaaaatgctgctccgttgtgtgcagttccgaagccaagaggcatcattggtggacgcccgctgaagaatgccaaggctgcgtcgccaacagagtccattccatcgactgttgacacgacgacggccgcggcttcggatgttcccgccaatgaatcccaagcgctgacggattcgcatcttatgcctccaccgtcgttggctcctcgccgtagcacacagatcagccgacaagcgtccatcgcaagcaatcggcccagtcctgtggcgccaaagcccattgctccagtgacgcactgttgcggaaccattcggtccgctcactttggatatggctgcggttcgaaaaaggcaaaccatctgccttcatactacaactcgcttcgggatcaagtcagttccaaatatgaattcagtagtcatgttctttctttataggcacaacacaattgccctcactgcaatgctttgcttttgccttccgaagcgattggaccaaccgcctattcaaagtgctgcgcaaaagaacgtgtcaacttggcggaccgctacaaaagcgcttcgtg

SEQ ID NO: 29166 - DNA, 1028 bp, Heterodera glycines
ttttttcttactgcgcgactttttttactgcgcgactttatttaaattattttaaattaattttaaattaaattttaaacatcttaaagttaaagacgttgaatttaaattcatttaaaattcattaaaaattcaccgcaccaagcggattcgaaccccagggggggcggccagactgacgcactaaccactcggccacattggcaatggatgataaacattaatttgctctcataaagggaaaaaatgacgtcaccagcagggaaaggggggcgagagcaggcaacagcgagttgcagtgggggcgagagtaggcagcagcgattggcaggggggcgagagtgtggcgagagtacattgcaacgagaaaaatggcgagaaattgctcggcagcgagagtggcgaggaagggttgcagcgagggatacgggaaatggcgagttcgggtggcgggaagggaaggggggtcaaataaacaaatcaattaacggaatttcccaatttttgacttaaagcgaaaaagaaatgggggaccgtataattaaataatatttatttataaattttaaaaaatgttctaattaattaattagttaattattatttaaaataataacaaatatttttttaaatttcaaacaattaaaatttcaatgaaattttatactttgatgcaaatttattttttctaactctttggctttgaatgtttttttatctaaatttaatttatgagcccaatattttatttatttatttttttgcataattattttaactaaaccaaattaattacaggaccccttaagatgaacaaaataaacaaatcaatgaagaaggggaagagtgctgcaataaggcctaataaacaaatcaattaacggaattttcccaatttttgacttaaagcgaaaaagaaatggggggccgtataattaaataatatttatttattaaattttaaaaaatgttctaattaattaattattatttaaaaaaagaaaaataatttttaatttgcaaataat

SEQ ID NO: 29167 - DNA, 793 bp, Heterodera glycines
taaatgtcaaaaaaatggtaggacaattaaaaagtgacaaatgaaggaaaatggacagaagaaaagaatgaatttgatgaatccgaaccaaaaaatggacaaaaaaaaagttcaaatttctgtatgactgagaaaaaatggcatttttctccgtatttaagcggtgaattccccatcaaaatcatccattcattcaattgctgcactcacttccattcttttcccccatcggtcgaatcttcatcctgctgctgctgtacaataaagataattcccgtcagtttttttttgttttgtttatttcggttttcaaaatgtattaaattttgtgcccttttttcaggatggtcagagcaacaacggccaggacaagggcatcagcagcgcgagcacggaccatcaaaatcaatcgtcgaaatgccaagaaggcgcgtgccgcaattggacgagccggacatgtgagtgacgcgcgagggggagaaggggcaattaatacactaatcgattcaaggacggcaatttttaaatgtgccaatttttctttcagacacgcaatgcgatcgcacgagagaagtgcatgatgtgtctgggcaaagtgagctccatgacgcgtgtgaccatgggctgtgtgcacgaatttcaccgcaggtggaggaggggcttaatgaatgtcaatcaatttagaatcccctgagttcgacaagtctaaaagccgaggagttttcctggcccaaatttcggaagtttttctttttgctgatcaccgaattcaaaatccgttccgatcaatttt

SEQ ID NO: 29168 - DNA, 896 bp, Heterodera glycines
tgcaaattagagaccggacgggatcgggatcccgcgaggtttcttcgggatcccgcgggattaaattcgggatcccgacctcgggatccgtcccgaacgattttttaaattcatcgggattgattgggatcgggatttcatcgggatcccgaaccgggatccctcccgaccattttgggattggaatcacgataattttaggaaaaatctccatttttaattaaggtattgaattttaaattaaaaataatgtcatttgctaattttctttaaaaaatcccttaaaaaatcccaaaaaattttcacgggtctccagaattttcaaaatttgacgcaaaaattggccatttttgactttcatttcttccaaaaaagaatatcataaattatcttttaaattcctaaaacattattctaaatcttattaggtagctttaaggcacaacgaatgtaagaattacagtttttgtttaaattctgttaacaaattaaattgaaattttcaaaattttcccgtcggcgcctatcggcaccgccggcctcccccttgttcccctaaagtttttgaaaaaattcgctgcgaaaaaaattcttaaaaatctgatttttgatttcgatgcagtttacgattttttaatttccttaaaattattagaaatgataataggagccgaaaatacaaaaattgacattaattgattaaattgtaaataagatatttaagactatgttgttaaatgttctaatttttgaccctaaagtctgactctttaagcatgatattctaattttgcaaaaaaaattctataaaaacctgatataattaccattccctatatttcacatagaattgatcaattataaatattagataagcattgaacaaaacttagcac

SEQ ID NO: 29169 - DNA, 855 bp, Heterodera glycines
gttcctcttacactttctctttccacgttctgtttctcttccacgttctgttcctcttccactttctcttccactttctgttcatcttccactttctcttcgcctttctgttcctcttccactttctgtttctcttccactttctcttccgcttactgttcctcttccactttctcttccgctttctgttcctcttccacgttctgttcctcttccactttctcttccgctttctgttcctcttccacgttctgttcctcttccactttctcttccactttctgttcctcttccactttctcttccgctttctgttcctcttacactttctcttccactttctgttcctcttccactttctcttccgctttctgttcctcttccactttctcttccgctttctgttcctcttccacgttctgttcctcttccactttctcttccgctttctgttcctcttccacgttctgttcctcttccactttctcttccactttctgttcctcttccactttctcttccactttctgttcctctcacactttcggttcctcttacactttctcttccacgttctgtttctcttccacgttctgttcctcttccactttctcttccactttctgttcctcttccactttctcttccgctttctgttcctcttccacgttctgtttctcttccactttctcttccactttctgttcctctcacactttcggttcctcttacagtttctcttccacgttctgtttctcttccacgttctgttcctcttccactttctcttccactttctgttcctctcacactttcggttcctcttccactttctcttctactttcttgatcctc

SEQ ID NO: 29170 - DNA, 2093 bp, Heterodera glycines
  misc_feature (113)..(113): n is a, c, g, or t
tagtttaaatattttttggactgagcgcgcaagcaatgaatgtgggtagaattttcgcgaatgaatgggagaaatgcacttttaggtggaaatggacggctatttatactctntaaagtgggcggggctaaggtaaaaatggtctttggcaggttgccaactaaattgttcatgctatgccacactacactaaaatgagtcgccttctgatcaacattttatgccatccacggtcagtcattagcggttaaatgaccaccagcgggcgctcagatagcctctgcggcgcttaggtgacacgtgcgagcgctcaaaaaaataacgaaaaattaaagtttccgcgccaaattcaaaattttgaccccggttattatttggtaagacttggactcagcccacccgaaaaaatgacatgaatttgttataaaactgtttaatattgaatattattcacaaaaatgtatgaaaaagtggcgatatatagtgaaaatttttttatcaacatttgaaatttttcaaaaaacgtcatttttgagtgaatttatcaagaaatatgctgttacacatctatttaatactgtatttttagcaataatggatgataatattcaaattaatgcaatttggaatagacgcaagctcttacattttttttggagatgagcaaaaagttataaattggagccttgaaaacggcttgttaacaaatgtgcgttactgctatggaaaacggccgacacggcactacaaaaaggaaatgcgttttgacaaaaacagaggcagggccggctcattcatatgcagtacttgtagagcagaaaaagctctttttgttgattccggtttggtcaaaaattttaaggtctttttttgttgtttttaactatattttttatattttatgaataattattatttagtattatgtactcatttgcgcatcaagagaaatacaaaaaatgtatttcccttttgcgaagttcaaatttttttaagggatgattgagaatgacagtgaagactttcgtgtcgttgtgtgtccggacaatgtcagaagtcccgatgctctacttccgatcatccaaaacacgttgcagttggtactgaaatacacattgacatgtggagggcttattctcgattaaatgagcatgggtttctccataaaattgtcaaccactcggaccccgaacaccgtttcattggttttttaaagtcaagtaaaatttgctaaattttaaagtttagccgaggatgggacgcacacacaacgtgttgaggctcagtggcgtcctgcaaaggattggttccgcaacggcgcgtcccaggtttccggtttgctgacacgttggtagagtatcaatggcgcagagaggtcaaaaagaatggttttgatgcgtttgaccaattattgtctgctgttaagagatattacactcaaaaatgacgtttttttgaaaaatttcaaatgttgataaaaaaattttcactatatatcgccactttttcatacattttgtgaataatattcaatattaagcagttttataacaaattcatgtcattttttcgggtgggctgagtccaagtctagcctattaattttttttataatttatcaatttcttaaatttttcatttatttttaaatttttatctattattttaaatttatttattattattattatttatatttttgtgtggtattagagagagagagaaagagaaaagagagagagtgagagaagagagaatgagagagagagaaagaaaaaagagagagagtgagagagagagataagagagagaaagaaaaaagagagagtgagagagagaaagaaaagaaagagagtgagagagagagagagaagagagaatgagatagagagaaagaaaaaagagagagtgagagagagagagaaaagagagagataagagagagaaagaaaaaagagagagagtgagagagagataagagagagagtgagagagagaaagaaaaaaaagatagtgagagagagagaagagagagagagaatgaatgttagcttttttattcaattatttttttaaattataaaaaatttttt

SEQ ID NO: 29171 - DNA, 777 bp, Heterodera glycines
tgataataaattaaggttttcaaatcattatactaacattactaaagctgtttatttaaggattcgcaatattgccaaaattttaaaatcccgctctatacgtttggaccaaagtttataagacatatattcgtcctcttttagaatatgcgcctgaaatttggaatccaacatacaaaaaagatataaataaattagaaagatgccaaaaatatttcactaaaatagtgcttttcaagtgtaaccttccaccaattccatacctgaagcgattagaatacctacaactaccaacacttgagaataggcgaaagctatttgatctgttcatggcgcataaaattgttggcgctactttgaaagtggccctttttgaaacaaaaggggggacccttttgttttgcaaaatttttttaagataaaaaacgatgataattttttatccggggttttaaaggtcgctaatcacgaatctgacatgtattttgactaatttctaatccctaacccgaactcgaataaaaatcgaaattttgaatttttcaaattatgatttcttgttcaaatttagattaggaaatcggaattgatcaaaataattgaaggatggccactttcaaagtagcgccaaattgtttatggccgaacagatctagatttatttaaaattttcaaaccttctaaacgctttaatgtccccttttataggtttaacacaaaatataaattaggcaaaaaatttattccctttgcggggagggctacaaaattgtggaa

SEQ ID NO: 29172 - DNA, 1609 bp, Heterodera glycines
  misc_feature (1576)..(1576): n is a, c, g, or t
cgtgggttttttactcttttggacatttcgtggcttggacactttgtgggggcgccatttttggacccggacctatgtaccgggtcggtacgggaaccgcccacttcggcgccggccttttcggcgccgttgctaacaacttttttactgatcaaccaaattaaaaatttttgttatcattcgatagctcttgagattctctattagcctgtaaaatttcaaaaaatttcgtcagtttacaaaaaagttatggccaaaaaacctcaaaaattaactttttcttggctttttcggcgccgcgtggcataacttttttatttttgaatcattcatttctatttttacatgcaaatatagagcacacatagagctttcaaattttaatctggttcgacccgaaattcgaaaaattaaaattttcgttcgagttctgatcaggggttcgaaattggaaaaaatggatgctgtattcgtgaaaaaattgccgaatacggtataaactcaaaatagcctaaaaacacgcttggggatggcgcgacggcggtggagaatgacgagtgctgcgctgatgctctgttgtgttgctgctctgctcgaacttcttcaccatcataacccaaccaaataatgccatcaatttgcagcactaacaacacagaggcgagtgccggccgaaaagaaagttgatgaacgcaaccaataaccaccgtttccaatttttaccacacattttgaacaatctcacacattcgcatatactcgctgtgcttcccttccctcacacatttcattcattcccatgcccaaaccaacaaatggatctgaaccgtatgagacgaacgaacgaacttaatccccctccgtttcactctttgctcgcaaatgttttttttttgttttttaatttaggatttgtgtacaaatgacgatgatgatgcgattttcattttttctgatcagatgtgcaaataaaatatgccaatcatcatgtgctaagaaagtggacattctcccgtagccctttgaaaaaacttttttgaatctgttgagaattctctcggagtttcaaacgtatcaatttatgataaaacaaaataaatatgtcgtaacatcgcaaaaaagaatagaaggaaagaaaaaacaatcaacaatccgagagctaatttaatgagtgttttgtgtgtattccaatttaagggaaaagtgcaaaaaatctgcattccagagacttgtgctccacaaacatttttgaaaatttttagatcagcaaaatatcagccatcctaacacgacggttctgccgactgcgcggaatcggtgcccgtggccgaccgcgtcgcctttttgaaatcaatgataatgacctgaaatcaaaagatttttggaaatatttaaattaaaattgtccaatgtgaagttccgcaccgtttcgttgtcgcctaaaaacaaaagtattaattagtgcggtgatttattagtaattgccaaagggcacgtacatccggagccatcgcctgaaaagatgtgaagtgattaatttatttgtcggtaattattagggctaattttacccgtntgtgtcctttgcacagcagtgatcgcaaatctg

SEQ ID NO: 29173 - DNA, 1272 bp, Heterodera glycines
tcacaccattcgatagcattttaaaagctctacaatttagctctaaggcattttttcgattaaatcaacccctaacgagttatgggcccgggactcaaatgtcccgctcaggccaaaaaatttttctatttccgggaaaaaactgaaatttttccgaaaaaaataccattcgatagagctcgaaaaactatgtgttggaagtggcctccgttttcccgggaaaaatcgttaaaaaatcctaaaattcaaaaaccccaaaacatacttttaggcctaactcgaaaaattttgaaaattttcgaaattttgaaatttcaaaaaatcgagctttccaagctctacaataagtctgctgggcacatttccctcagataaaagcccggcgtgttattcacctggtactgaagtgtactttttgagcacgcttcagttgctcacaactgcagaccaaggggtggctctaataaaaaaataaaaaatacaagcatgtagaggaccctttgggggggtgccctcaaagcgggtactttttgattagggttttagaaaaaaagttacgggtcctaaactgcaagcaaaagtgacaaatcgctccctgggactcagttggccgtcggatcaaaaaacctatagttttcccggatgcacctcaaaaagttgtaagacccttccactactttcagggcgctcccggccttcggccgggagattttgtttttggcaacgaaacccctagtcaatataacatatatagtaactagcgggtgtgtgcatgcgagggtggcgcttgggaaagcgctgcgcgcttcttgagcttcgctacctaggcgcgttttagtctgttagggtctttgcgtcagccgacatgcacttggtttcctccaataattggagttgacacatcgcataatgcaatggaaaccggaagtgccctaacgttgcacatcatggccctcctccctcccttagtccaggcgttggcacgttattgggttgagcgctaaatggcaattcacctgtaggccctaaagagggctgaccggtccatgtcccggatccaagcttctcaccattttcgcacccaacatagtgcagatgggaatgggattggcatctctccaaaaaccatgtgcccaactgctctagactaagccatttattgtaacttgagcatattagtagctacaatattcagcactttggctcggccttgggcatcaatttcccggttgggagcatgaacacggacattgtttccgtctgttgcccgag

SEQ ID NO: 29174 - DNA, 1349 bp, Heterodera glycines
atgcccattcggcaagcccttggggttccaactgctcacgggcgccatgcatgcccattcgccaagccctcgggttccaactgagcacgggtgccacgcatgcccattcgccaagcctcgggttccaactgttcacgggtgccacgcatgcccattcgccaagccctcgggttccaactgagcacgggtgccacgcatgcccattccaactgagcacgggtgccacgcatgcccattccaactgctcacgagtgccacgcatgctcattccaactgctcacgggtgccacgcatgcccattcgccaagcccttgggttccaactgctcacgggcgccatgcatgcccattcgccaagccctcgggttccaactgagcacgggtgccacgcatgcccattccaactgagcacgggtgccacgcatgcccattccaactgctcacgggtgccacgcatgcccattccaactgctcacgggtgccacgcatgcccattcgccaagccctcgggttccaactgctcacgggcgccacgcatgcccattcgccaagccctcgggttccaactgagcacgggtgccacgcatgcccattccaactgagcacgggtgccacgcatgcctattccaactgctcacgggtgccacgcatgcccataagccaagccctcgggttccaactgctcacgggtgccacgcatgcccattccaactgctcacgggtgccacgcatgcccattcgccaagccctcgggttccaactgagcacgggtgccacgcatgcccattccaactgagcacgggtgccacgcatgcccattcgccaagccctcgctttccgactgctcacgggtgccacgcatacccattccaactgctcacgggtgccacgcatgcccattcgccaagccctcgggttccaactgttcacgggtgccacgcatgcccattcgccaagccctcgggttccaactgttcacgggtgcacgcatgcccattccaactgctcacgggtgccacgcatgcccattcgccaagcctcgggttccaactgttcacgggtgccacgcatgcccattcgccaagccctcgggttccaactgttcacgggtgcacgcatgcccattccaactgagcacgggtgccacgcatgcccattccaactgctcacgggtgccacgcatgcccattccaactgctcacgggtgccacgcatgcccattcaccaagcccttggattccaactgctcacgggcgccatgcatgcccattcgccaagccctcgggttccaactgagcacggctgcccacgcatgccccattcaaactgagcaccgaagccacgcatgcc

SEQ ID NO: 29175 - DNA, 916 bp, Heterodera glycines
  misc_feature (856)..(856): n is a, c, g, or t
ttcataagtatttttacagaaactgctctgaaacgcaccaaattttatttacatgctagtttaggcactctgatgccttttctatcaaaaagggagatgaataaaatttttaaaaatttttaattcctttttaaacaggccaaaaagtttaggcttaacttttttttcagaaacttatcagaagcgcaccaaactttgcagggatactgaaaggaagagaaataacttttaaagttttttagaaattctgagtttttcactgtttattattttttgcaaaattaattcataaatattttttcagaaagtgctctgaaacgcatcaaatttatgtacaagttaaataaggctctctgatgcttttactatcaaaaagggagatgaataaaatttttaattgctttttaaacatgccaaaaagtttaggcttaaattaaaaagattttcttcggttctagctctttcaataatcaataaaatcgtaccaaattttataggcatactccccggtacaggactaacttaacctgaaaaaatgacaattgtaattggttttaaatttttttagaaattctgagtttttaactgtttatttattttttgcaaaattaattcataaatattttttcagaaagtgctctgaaacgcatcaaattttatgtacaagttaaataaggctctctgatgcttttactatcaaaaagggagatgaataaaatttttaattgctttttaaacatgctcaaaagtttagtttttaagtgcaaaagtggtggtgtctgcaaaaaatttcacccggtttaaaaatctaggaaattagtagcattgtagtgtgcgatacgtatcctgcaaattnggtgagccctgatcaatacaaatattatggacgatcaatttttagaattttatttatttt

SEQ ID NO: 29176 - DNA, 1448 bp, Heterodera glycines
  misc_feature (101)..(102): n is a, c, g, or t
  misc_feature (121)..(121): n is a, c, g, or t
  misc_feature (128)..(128): n is a, c, g, or t
  misc_feature (186)..(186): n is a, c, g, or t
gcatttgaataagctgaaagctcatgcacaggtgcttcgccgtctcgcccgcacacgctgctctcgctcagccaaaaagtttttgctacagcacgagatgnncctcccagctattgtgggnctcatgncgtcaattgctcttccgcttattgcggatgtcattgaaaattataaataaggtgcacncaagtaaaaaaaaaaaagaagtaaaatgcagcaatacaaagcgctatttgctagtccccgaagagatttatcagagtttggcatcaccgccaccgtctgacggaacaccaattgggctggtacgtaacagaattaaacaaatcaaaaacgatgatggcataaatgaggcggaacgggcaatcaaatatgagcaggaacttaagcgtctcaacaagctcacaagggacgaggatgagtgtcccgtcggtgttaaattagaaaatttgagtgacgtggttgacgccatgcccaaatcagtcaacgtcagaagaccaattgttgtcgctacgcgtcgccatctcaaggttgggcgtgcgcgaaaagaaaatgttgaacaactagaagatgatgatgatgctgatgatcatgctgatcatgaccatgaaactccaaagccatcgagttcaaataaacgacaacccacacaaacggaaatcttaaaattaatttataaaaacgcccaatctcttggagtgtctgaggaaggacaggtcttgagagcgggtgggcggccgtttataaccagcagtgtttatgacattgttagtcacctgctgaacaaggacaaacgtgctcaaaacaaagagccaactgcattcaaagaatttgttgaaagggcaagacagatcccgctcttgagtaggcatttatttcccgaaggccaatcgggcaaaggcatttataaaaacaccacactgaaatttaagccatcattatggatttgaaaaagcttcgcttgctcgagtttttgtacaaggacctaagttcgcctgtcgcattcacgagcgttgaatcgctgctgagagaggcgcagaaaagtcaacgaaaaattagtcgaaaagatgtccaaaattatttagccagccagcgtacatacacactgcatcgtcaggccaagcggcgctaccgtcgattgccaacattggcacctggcttacacactgaatggcaggccgatttggctatatttgaccgaatcgctaaacaaaatcatggcttcaagtacttgttagtctgtattgatacccttagtcgacaggtgtttgccgagcccgtaaagaccaagacgagcgctaacatgatcattgcctttgatcgtatattcaaaagatcaaaatatatcccgtggaaggtgttaacagatcagggaaaggaattcactgctcgcgcagtacagcatttcttccgagctaaagacgttgaacacttttgtatgctcactt

SEQ ID NO: 29177 - DNA, 540 bp, Heterodera glycines
tcagaagcaaattcaataagttatttattaataaatgcattatttaccacatgaattatgattaaactttggcatttagaatacattgtggcattaagaaaaatggaagttgataatcattcgatcatttttagggcaatgatagcaccatcgttagggagctcagttccacaaattaattccagcccagcaaatattatgggcaggacacgagcaaatagggggggggcacaagggacgcagggggaaacaagttttcttcccttttgcgccgcgaaagtccgtgccggagggcaagggcctctaaggctaacgacgacacagcgacaaagaccaaaagggagcatttggctgcttctccccccgcctctccacctgtgtgcttttcgtcgtggtaaggacccttcttccttcgcgcgaggcgcggacccccgtgggcagggacagcagaactcctttttcgcccttttgtccgtccgtcgctccccgtcgttgtgtctgctgatcgcccccccccccctccctctctctctctctctc

SEQ ID NO: 29178 - DNA, 986 bp, Heterodera glycines
ggggaatttgcaaatcaattagacgcctcggatgaagtaagagggaagggggtcaaagaacggcagcaaaagaagtgtgaaggaggggggggggggtgtcgggggaaccaatgacgaatccattaaaaggggaacggaaatttagtcgggggtcaaatggtgaagcgaatgagtgggcagggggtcagagaaagaaaaagcgggaaatggcggaggggggagggggttagcactggataaatatggggctaaaaatggattaaaattaagttcgctaaataaaattaataacaaaggttttaagaaagcctttaaatttaagtacattattcgttcatggaaatctctttgcgcaatcattgcgcagcagcgtggggaagggggggggggtggaaaattggcaaatcgattaaacacaaatgaaagggaagggagggatcaaataaaggcagctaaagagcggggatattatcaacaatcacatttcggagctgtaaatttaggaaaatgcattagaattgtgatcaatatttgataaatttaagtgaatagccaacaaaaaaataaataagaaacagtaaatttatttgaaagagaaacccctaccctcaaaaataattaatatttatttaaaaatttttcagattaaataaaaatatatagtaatactcatataaaataaaaggaacattttgtaaatgctttttttagtcatcattttttggtattttcatgcagcaaaaaaaaggctaagagaaaggagtcaaaattagtgaaacaattaactcccgagtggtcaaaaaagaaaacaaaggaacgggatggcaagggatattcataaaatggagttcgaattggacgggagggggggattaaaatttatctttataaaaatgtaaaagacacataattatcgtatcaaatgttttcgcgcagtttccaccttcttcaatgaatgtacaaatgaaggcttttcagtgagacta

SEQ ID NO: 29179 - DNA, 1395 bp, Heterodera glycines
taaataaataattagcttatttcctctgggagttcataattgaatcgccgtgttaaatgaaataatatcaagcagtcttttttcttttactattcatgaaattttttacactagacaattcccattaattattagttaaaacaaaaaacggaagtaaaattttaaaaaatattcaaatagaaataatttctgtctaaaaaacaaaatgatgaaaaattttatgagcaaaatgtcatcatgcaattgttcagcataaagattatcattgggaaacgactattaaaatatgaaaagaatatattttgttacatttttagcattggcattggcattgaaagcggagagtggagaatggcattgtgttgtacttccgtgacattagtgtatttccgcactccatttgcggcacgaaaatgctcatattacggcgagggaattacacgaattgcatttttatgaattcattgggcaggaattgacacaaatcggaataataaataagaaattcattgaattaataaatatgtaaattgacaaatcgctgaatttggaaaggaataaacagagaaccctaattgaaaagcttcataaattataaatgaatgcaaacgtaacaatttttgagatttttaaggtccgaaagtcaaatttggggatcggtcacgggattggaagtcaaattcactgcaaaagtcatcaatttgaaaaagttggattggtaccataatagaaaaacagactgaccccggaataaattatttttatttggaattccgcggacactgaattccgttgcttccttggaacaaagccttttcgtttgtaaaaaaaattccttaaaaaagtttctaaaatttttggataattttaattgaaaaaaaccatttctcttattttatttggtctcacaaaattcaggaattttcaaaattcttaacatttttaatgcaaaattttatttttacaaaatacgcatttgtttggatgcaaatttcaattcatttgatttgtttgaaatatttatataattaactcataaaaacacatccatgttttacaatactttatagagaaaaaatgaatgtaatttaaagatggcaaaaaaaaaagattattgttttcaaaaaaaaaacccatttgttcataaaataaaagatataaatataatgacaaaacttagtttataataaatgcacatttttaaaacgaattattatggggtgtttttattattgtggaaagtgtgccgaacaaattcaaatttgctccaaatgtggcactttcactgcttaataaatgtccggatgcgattccggttccttttccataagatatgttttgtaattatcgtagtccatcggcctcattttgcacaaattcttcggctcacattca

SEQ ID NO: 29180 - DNA, 919 bp, Heterodera glycines
  misc_feature (18)..(18): n is a, c, g, or t
  misc_feature (25)..(25): n is a, c, g, or t
  misc_feature (29)..(29): n is a, c, g, or t
  misc_feature (55)..(55): n is a, c, g, or t
  misc_feature (92)..(92): n is a, c, g, or t
  misc_feature (129)..(129): n is a, c, g, or t
aaagtcaaggagactagnccgtagnccanttgcacaattgtcagtgttactttanaagaatattaattattattttttaaattttttcttgnactccaattttcatcactaatttttcacccagacacnccattattaccagtgcttgtttttcccggttcccggttgccctaccgggaccgggacctgagcctttcaaaacccgggaccgggacctcggatgaccgggaattcccggcccggtcccggtcccgctgcactctactgatgagcaacggaaattgacttcaaatcaaattggtaaactgagaaatagagaagtgggaagatgggtagacagagaaagtaagatgtgcaaattgatatgggcttcgaaatcaaagataccaaggatatttggattattattaccttcatatacccaaaaacggaaattcctttttaattcgattttccctaaattaataaattttgtaaattgatcacagaaaatgccattgcttcctcctcaaatgccgcccatttcctcactgataatttggacaaaagttggcattggcttgcgaatgtgcgggaggaggacgagctgaaacagttgtgcacacagaagaaattgggcggcgattattgcgcatcaaagcattctgatcagcagcacgtcgactttgatcggatgctgaattggtggttgcccgacggttggttggtgctcgcccatttgcacaatttgttggattttgttggtctgtgcctccgtcacacacttcggcacgtacggcccaatgatcaccaccatctccgcttttggcgtgcgcttcaatcgttgtcttcaacgccaatggacaacaatttcgactctgattacattgcccacttggaatgcattttcaacaatgtcgaaaaaagctcggcattgcag

SEQ ID NO: 29181 - DNA, 1006 bp, Heterodera glycines
  misc_feature (6)..(6): n is a, c, g, or t
cgcgcnggagaactaaaaaagggaattgggagggggggggggagtcggcgagaaagcgaaaggaaacttacgccgtcaaattggcaccgatgacgagacgacaatcggcacacgccattttggcgatggaacgaagaaagtgcggcatatggcgatgggaataactgacagtcacatggcccagctgagcgttgaaaatgtgccagaagaaagtgttggggacgtactcgctcagaatcaggccgagcatctgcaagtgcagcatcgtctccttcaccccttctgttccctccgattctgacctggtccctgacttcgatgtcctcaaactttggccgttccattgactccaatggctgttttccgttgtacaaaaggcctccgtcaatgccaaaaatgaggtcgcgttttgaaaaggtcggtggatagcgaagcgtcaggtcgggcatccaagtgccgttgagcacttccaagtcgacttccggcgcatcctccgcttgcattgcttcttcgccttgcctccgtatggccgagggcgaacaaagatgctcaaacacggagggatcatcatcatcattagcggaagtggatgatgatgaatcatcggcggaaaaaggggccgaatcggatggaggaggtcgcgaaactaattgaatctgttgttcgcaatcattggatggaagtcggaatgattcaagctgactttttcatggacgaattcgcggataagcggtggcaaaatgcaaattttgtcccgaattgccgcgtcaatgcccgatctgatcaggtcactgatcgcataaaattggctcgcctcgggcccaaagaaattgatgacgaagttgcctgggtcgacagcgcattcagtgaccttttaaagcaatgcgagagacaatggggaaaatactttatgaaagaaaacaaatctaccgtaaccgaggtggaggaagcggtcagattacggtggatatcacacgcatattaaccgtaaaattcccaataatgg

SEQ ID NO: 29182 - DNA, 731 bp, Heterodera glycines
atttttgacttttgttggtgttcaatttcttttctcctcccctaatttttcttttttttcgattaacaattttctcttataatcaacagataaataaaaattctttgcgctttccgtccgtgtctttttgatcactttaattgattgttaaaatgtccgtttttgtttttcttccgtcgatcaaagcttcggtctgtccgtgtcggcaattcgtcgatccaaccgaaatgagcttacgtcaatgtgtggcggagtgtcctctccattgacccattgcgccagaacattgccaatagtcagcgcaaatttgaaaccggtgcccgagaagccgccggcgatgaacacattttggtgtcgggggtggcgatcgacgatgaattgaaggtcgtcagtcatctgaaaccgagtttgttgatcatattggcattaagagagtgaaagtcttaagagacagggacatttcgccaaaataaaaacgaaaagctcatgaaatttaagtgtaaaaaactattaccgtgtaaatgcacgtgtcctttatcaatggtgccgtgcagtccacgtccgggaaatgcttggccaagtgttgtgccaccagtgagtggtccattccggcgcttccattcggcccttcgctttaatcggcaatttcattccatgtggacggcaaactgaaagtcaggctattgtacatccgtcaatcgctcggcagaatatccactcattcattgtgc

SEQ ID NO: 29183 - DNA, 1155 bp, Heterodera glycines
  misc_feature (1060)..(1060): n is a, c, g, or t
  misc_feature (1092)..(1092): n is a, c, g, or t
cctcaggacgggcgcttcgcgtccgtcttttaatttttttggggatattcggccgcttcgcggcctcaggacgggcgcttcgcgtccgttctttaattttttgggagacgttcggccgcttcgcggcctcgggacgggcgcttcgcacccgttttttaattttttggggggaattcggccgcttcgcgggctcaggacggaagatatatggcattattccaaagctttgcatatttatttaatttttaagattgaacagcattaaacaacacaaaaaaagtgaattgaaaacatttttaataaattttcaaacactcccaaaaattaaaaaatatttattagtgttcaagttatgacggttatccggtgctaacatccaatcgtttgtatggctctttattgtcggattataatgcgcgaaatatgtgaataattaaatgaattaataaataattaatttgtattttgatcgctccaacgtccgactatcatctcctccgactcgactgactgattggtgggggaaaaaattgaacggaaaaggggcggagatttgcggggatttgtgagagttagagaaaagagaaatagtgaatgaaatgatgaacgggggaatatcgaaaagatgaataacatcgattggccaaaaagggaaatgtgtgaagggttcggttcgtcttcgctcatgggtaataatttgaatatgttacaatttctaataaattttcaaacactcccaaaaattaaaaaatatttatattttcttttgttcttttgttcttttaatttaattttatttgaaatttattttttgtacgtaaatttttcattgaaattttttgtcttcaatagattttgacacggattttataaaggcacaaaattataaataattaaatgaatataaatacttatttacaattggaaaaattaaacaaaaagacttctccccacgcattaattaaatttttaattgtttatatacattttaatcaaaatttgtcttttttttgtgtctttcgtgcctggtctctcgcccgccggtgggtctcgtctcctngcctccagcgttaaaagccgtgctcttctcgnctgagctccgggcgctccctttaagggatatccacatgtcctttatcccactttctcccacac

SEQ ID NO: 29184 - DNA, 1108 bp, Heterodera glycines
  misc_feature (29)..(29): n is a, c, g, or t
  misc_feature (46)..(47): n is a, c, g, or t
  misc_feature (88)..(88): n is a, c, g, or t
ggagaagcaaggggctgtgctggggggcntaaaatttgggcacatnnggaggattaattctgatttctgaaaaagtcccagaaatacntatttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagttaagtccagaaaggaatattttataacgatttcgttttgttttggcattatgataccgaataactttcggaaattatggaaacaaaattggagaaattcgaataattttttgactgcaaatttttttccttttttgaattgggttcataaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttataacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtctagaatttatttgacaaatccaagacttaaaactgggagaagaaaggggctgtggctgggggcctaaaattgggccacat

SEQ ID NO: 29185 - DNA, 1256 bp, Heterodera glycines
ttttattaaaaatagaaagaattaagttcaaaattaatttctttttaaaaatttgatcatccactactcatttttaattgatcagaagctcaccaaattttgcagagatacgtaatggaacagtacaaatgtttacaaattttcctaggaatttttcatccgaggaaaattttttgcattcacaaaatttgcatttttttttaatttgtccacctggaaatattttcaggaaatgggatgaattagtttaaaataggttaattctcttccttttagaatccctgcaaagtttggtgcgcttctgaacacttttcgaaaaaaatatgagggactaaatgctcattaaaaaataataggcagttaaaaatttaaatttttattcactgagttttgattctcgagacttgagaccaatttccaagcctcgagactgaatttaattcacgagacctgatgccgagactgatgtaaagacctgcgcgactctcgaatggcactcatttgttgctggcttggcttaccacttggccaggcccacaggtgggccttagcgttttgcagccggccccatcagtgccttgtgtctcggtgggccgtgttgtgccgattgcttgtgccatcccggcagcaatcgcttcttgggtggtcagcgttcttaagctggtcggcgaacatgcggtgccacacccgggcccatcaacagcacgcggatcaacgattgttgccggagcatgagctgaaaccggcaaaatttatccataaaagagatctctgatggcttatgctggactagtcaatgagctgaggacaacttttttgggaaaaaaatttaataatttaattttttaaataaaattgacaaataggctccgtacttcctcaaatagagccccaggggttatattgttaacctccaccccttcaaaatgaggctatattcgaaggtggggtctattcgagggggggggggggggaagttgtcgtaatttgcgcgagagagagtgaacatcatccgttacagcaaatgcatttacataaaaggattgccgtggaaaatttgggcacaaataaatacgaataaagacagcacggagaaattcataatttaattaatataaaataaaaaatgatgttcatttttcgatgccatggtttctcttaataaaaatgttaatgtgattattggcatttatttaaataaataatgcgtttttgtacatattaatatttgcgtaaatatttaaaagatatttgcg

SEQ ID NO: 29186 - DNA, 871 bp, Heterodera glycines
ccgtcccaccaccacccaacagccctcgcccagcagccccacaaaattgttggtcggataggacggggtcggactgtgcaaatagtctcgacaaatcgtcgtcctcgtcttttcagttgggcggtggcggcgagaggctgtgatgactgactgacgcggacacactgacaaacaaccagccgccccgcccgaagccgtcggagtcgcccagtgtgtggcggggccggccggggctgggacggatcggcggatcaacaaccagcagcagcagaatgaatggaatgaatgaatgtttcgaagcgaaaaaaatttatttttgggcgcaagagtgtggtggtgctggtggacacaaagatgttgcgatcagcagcagcagcagagtccaaaattcagagcaaaatttgatttttggccggccgatttcgcctttttttatttgctgcgacgaagttatttggtgttaatgcgtcgtttttgatctggtgaattcgggttttttgtgtatgtttctgatcagtcaagcctaaatgatgcctgatcagtagattctccacttttaggcaaatgccatttttttgcacatttttttcgtagagaccagcacgaaaaatatgtttgtcttcgtttgaagtttcaagggttagttttaaaatgcctatattgcctatttggcatttttgatgattattaaagattttgagttaatttcaacaaaaatgcaataaaaaaaataactcttaagtaaggatgtaaaagttttcaaaagataaaaccaaaaagttgaagcttttttcaaaaattaagctaaaatatattttatttttagcttttatatttatgcatttttgtacatttgactctagagatcccc

SEQ ID NO: 29187 - DNA, 1094 bp, Heterodera glycines
agactttcatgggactaggtatgtttgtacatttacaaacttcctgggagtgaggtttgttcctttcgcggggcgcatgtttctccgaaacatttctttatatttaaataaaaaaacaacggcactagaagtatgccaaaaataattgacgggccgattcagtccgcccatttaaagccggttcggttggtttttctcgtgttatttaagctagggttaagtaagccgtgtaagacacagtttgatgaaatttacaaattgcacttagttatcaaatttctcaagccggcaaccctttttcccgaattttaaggttgtcgatttacatggcttgacccccttcgtaaatttgcggccccgacatttgggcctttgtccaaaatcgggttcaaaattggttttttttcaatccctgatcgcctaaacaagctttaaataagcgattgaaagtgattgtatcagatcatttgatcgtcaattaatttttgaaaaataataaaattttcaaacagaattaatgctcctaataaactagaagactaccggtatgttttcttaatttaatgctgtttagtctatcagagcttgaaaaaattcaacttagaatccgatttttgacataggcgcaaatgtcggggacaaaagtgggccgcaaattttggagctccgtcataagcgaaaaaaatattttgttccaatgagttcgagcgaggatgttttgctcagaatttagagtccgaaaaaagtagaggattttcagaatcgggtttttgtcagttccagaaaaatgcattaagattaatttagttaatgcataaaacagggcaatcatggagtttactggtcccgttttttttttgttttttaaaatgtttaaaaaatattcttaaagttgtttcataggttttcagggtaggagaacacgattatgacacctatttcgagaaatttcgaacctcttacccggattcgaacaaaaattctaaaattcaattttcaaaaaattcaaaaaatgaaaaaaaccagttcaaatacacggaatactatatcttgcctgatgagtcgattttccatttaatttcttgcattgtttt

SEQ ID NO: 29188 - DNA, 1162 bp, Heterodera glycines
ggggaaaaaatcggcgataagagtaaataggtcaacagaaggcaaaattggggatcaacaaaaaatggacgcagaaaaagagaaggagaagaaggaaaaaggagggggcgccgtgattaaatagcccccgagcagaatatgcaaaaacacgtgaataaggagaaaagtgggcatttttgagagacaaagggaaaaaggcatcgctgaatatgttggggggaatcagagtacagaaaatggatgaaaagaggggatggagggcaaaaagataatggtaaacattttgagaaaaggatgtccaatcgggccggacaaaaggaatttgaaaatgagaatgaatgtgaaaatgaaaatggagcgacgaaagatggagaaaatgcagatgtgaaatggtggacaaattggataatgagaaatgaaattgaaaatgatgatttaaataaaaaggagaaaaatgggaagaaaaggagaaaaggccagattggcggggatttcgtcatctctccgatcttctgctccgtccgaccgaccaacgggaatgttcccgatcatcaatggtaccacggcttcttcttcttcgggcccgagactcgtggaggtgcagtaaaccatgcgcctggggtggcccatcggttctcctcctcctcatcgattttacgggcattgtagtgcccgcccgagccccgggtaaaggacaattggcccgatccttcaccccaactctcgtcgcggtttcgcgacaattattgttatggcttttgcgaatggaaatgaaaaaagttctggaatattgcgattctgccttttttcccaatgtcaaaaaactcatattggttttagcaagcattctaataacttctggtaaaagtaaaataaataaattaaaaactaaaattatttattaactgcgaaagatcattttcttcacttcgtcttctaaaaaattatctccggaatcgaacaaaaacagaacgattaacctctttagcactcgcgtatattaaccgtgaaatcgattattcggtggatgaagtcataactgaatttgcgaaaaggtgaggtagttcttggagggggtaccagtaaggaaaatcgaaatttttcaccaaaaaatataattttttccttaaaaatttcgggtgtggagtggctgggggggggg

SEQ ID NO: 29189 - DNA, 1708 bp, Heterodera glycines
  misc_feature (70)..(71): n is a, c, g, or t
ggttccaagttcgtacgctgtgcatttaaatattttttgtaattaatatttatttaaatataaaatattnnaagttgatattcttcattattattgctttgttttgttgctaacactaaaatctttctgttaatttatttttaatctttttaatgtttaaagtaagccttgggttaatttcaattatttaaaattatttcttttatttctggtaaatttattgttttgcttgccctttccatctcatttcgtaatgttcttatttgttagggggtttttcaggttggttttttattaattcttcaataaaaaggtcaataagagtattatatattttttaaatgaattgccttttgttttctattaatttttatgttggtattttatctcatgtttcgttttacactcttttgttttcaggcttgggtctttgttccgtacattaattacataatatatttctgcgtaataaatatttttataaaataaaagtttataaattaaataaaattcgaaatttcattaaaacaattgtcatttcccttttaaataattttttaatatttttaaattcatataattttagaaacacaataaatatctttttgttaatttatttttcaagaactttttaaaataattttttcttaacaaattaaacaaataataataatataatcagttttttattgcttatttttttgcatttattatttttttttaatttttaaatttattattgttcgataattgagtacaaatatttattttttacattattgtataataaaataattgcacacaatctttggaagaaattgtcactggcatatgctatttaaatgattgtaggtaatataatcatttaatttttaatttgttcataatctttaaaatttttattcttatttatttttatctgcttgatttatctcgaagacgtcaataaaaaattttattattttttacttgataattttatgtaataattttttattaattttttttgataaatttaaattttaattttgcatctaacgttaataattttgttgtaattttattcaatcaaatttcataaaaataaatttatgggcttctttttaatattattctttttttcggttgttgttaagctagttttcatgttactagcaactattttctttttttagtgcctaaaaccctaaaaaagtttaaaaaaaaattattttcacctattctggcatttagcctaaaattattaacaaaactgcaacaaaaaaaagcgaaaaatacatctataaaaatggacccgaaatttttcaaaaattcaccactaagaaatgaaaaacttctcaaaatgcatcttcaaaatttattttaattttctttatttccccctaaatttgaaagtttttagaactattttcccatttttagcaaatattttggggtttaaacctacaaaactgactattttgtagtttttagaacctaaaaattggagccctaatgttaaatataaatctaattatttaatattattaaataataattctagtttcatgcctttttttaaatttttgaatttttagccattagcttaactgaaatataactgcgttttttaattatataaatcaaaataatcaggtaacgaatggttttcagcgaaaagaaattttgtcagcgagatagaaaaaaaacaaggcgcggtgagttgggc

SEQ ID NO: 29190 - DNA, 902 bp, Heterodera glycines
aaatgaaatagaaaaagcagggaatcattcaaaattttatccattgaacaaaaaataaatacgtatatgtaggtatattctgctgggttagctagttgacaaaaaaaggacaagttgacctgcttaggtactttgtacagcaaaattttcgtaaaaataaaataaacccgtttaggtaataccttttagaatgttaaaataataaataaatctaaattttttttaaacaatcagcctttctaaagctacaattatttgtccttgtcttcgctcggatgaccaaccccaatgaaataatataattttgtacatctaacaaattatatgacattccaaccatcacaatcagaatatcgtttttgtttgtttaatgctttcaattgagtcatttcttcctcactaagattaacgttgaggaaatcaatatttgaagaaatccgtctcgggtcctaaatttgttcttcaaactttctaatcagacttataatcaaattggattcagttgcttgaacgaagtatacatttttttgatatcagaaagtgcgaaatattgatttttggctctattgcagttcacacgaccataaatttttttacaactttagtgcatcataacttttcaatattttgggtttttgttttcagagattcgttgtctgcggccactaaacctggtaggcattagaagcaagccccatctctcattaaaaccactcacttttgattttggaataattccaattccttgctgataagaaaaagccaacagaatttgctaaaatatttgttaattttcaactgcactcgaatttttttctctgtacttgaattgttgcattgtgctttttggccgatagaaactaaagagagcgtcttggtagagagatgatgaattagcgcca

SEQ ID NO: 29191 - DNA, 888 bp, Heterodera glycines
  misc_feature (834)..(835): n is a, c, g, or t
  misc_feature (837)..(837): n is a, c, g, or t
aattttgaatttcgtttcataacccaccccatcttcctccttgttcatgatcggcttgatcatatttgccaccaaatttggaatcaaaaagtcatttccattgcgttatgctctccggtgaggagaattgaacagcagatgtttgcatggtgatgacagagaaagatgctcctcggcacttatccggcggacggattatttccataaatccttggtgggatgtgccatttccttcccctgccctcctcggaaaggtcccccaatttgtgccaaaatcgccaaaatcattccccgcttcattgctttccccacccgcccaaattccgactataaaaagcacctgccactgcgcagaacagtgtggggattggaagccaacccatcctcctcctcttttgtacatctttgcataatttgcccacccatcccagttggcatttttatttgtgcctttggcctgggtggacagatgagtcccagcgtcaaaatgccaaaatcgtttttttttgtgccacaaatttgaatgtatttggctcccttttgtacaatgcattggtatttacaactataagcaaattgccagacaatctctggcattcaaatttgttttttttaatgaatttttgacacttatgcagtaataattttaaaaaaccatagggagggacccttttattttcacaaaatttcaagccataataagtaaatcgcctataaaactgcaaaagtgccgaattttcggcatcattccttttgccattattatctcattacgaaaataggagtggggggggacgagaatgggaaagggtgtggcctctgttgttttgttgnngntgggcgccctctaaggctgggggggggggggttgaagatggcacccctccc

SEQ ID NO: 29192 - DNA, 1142 bp, Heterodera glycines
  misc_feature (142)..(142): n is a, c, g, or t
catgatttcaatattttcattttttctagtctaatctactcaaaacggtttcagaattcaataaaaataacattcacggtgcgaaaaatggggtttgaaaagtttattgggaaaaaaagactttacaaaataataccctggngagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaaagactttacaaaataatacccctgggagaagggagtgggaaaatggattcaaaaattttcaatttttttaaggttaatctactcaaaacggttcaaaattcaataaaaaaaaatttcccggggcaaaaaagggggttgaaaaagtttagtggggaaaaaaaaactttacaaaaaaaaaccccggggaaaagggggggggaaaaatgatttaaaaatttcaaatttt

SEQ ID NO: 29193 - DNA, 1026 bp, Heterodera glycines
gggaatagcttccctatagccttactttattctgcgtggattttgctccccataatttttgagtacccaaacgggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccctgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgagttttttggtttccggggcagtccccccggaccgatgcgcccagatttatggggagaccgatccttcgggagtagctccctatagcctgtactttaatctgcagtggatttttg

SEQ ID NO: 29194 - DNA, 1017 bp, Heterodera glycines
  misc_feature (23)..(24): n is a, c, g, or t
cctaaattaatgccatctttcannctttgatcggtacaaaattgggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtactaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtactaaattggccgaaaaagagatagccattttctgaggcccgaaggaaaatttgagagggctaatttatatgtaatatttgaaagtgccaagctaattagcgattcaggcgcacattggggcctgaattaagccattttccctttgatcggtactaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaagagatagccattttctgaggcccgaagaaaatttgagagggctaattatatg

SEQ ID NO: 29195 - DNA, 849 bp, Heterodera glycines
atcattcaaaaatttatgcaaaaatgacaaataaaaaagctttcagtcattgaaaatggtaaacaaaaagcagtgagcaaaaaagggaaaaagcagtaaataaacaccctcggggagaagaatggaagggaaaagaaatcgcgtcgaaaaattctttgttttgaacggtgggcggggttaactgccgattaatataatagattatttggttttttatttaataaattaaattaatgaaaattttcaaacaaattttcttcaattatttcaaacaattaatcatttttggactaaatcatcgaatattaatagaaattcagatttgattttcacatcactttttttcggagcgctttttcaaaaaacttttgggaaagaaggggtccggcggtgccgataggcgccgccgggggaaattttgaaaatttgattgtaatttgttaacagattttcaacaaaaaaggttggtttttgggattattaagctcaattggtaggattttcatttaaaaaaatgataaaaatgtatcaattttaaaaaaaactatgaggaatcatattttctttataggaaacccacgagtatacaaaacaaaaaattgaaaataatctaatttctgtagagggattgaaccaggggaaagaagaagggaaagtcaaggagactagccattaggccatttgcacccttgggcagtgttacttttaaagaatatattaattattattttttatttttccctttgactccaattttcttcactaatttttcactcagaccccattcttaccagtgcttgtttttcccggttcccggttgccctaccgggaccgggacctgagcttttc

SEQ ID NO: 29196 - DNA, 1721 bp, Heterodera glycines
  misc_feature (1666)..(1666): n is a, c, g, or t
  misc_feature (1700)..(1700): n is a, c, g, or t
aaaaatatgatccttaaattataacaaacacataaaaatttttgcgcattaaattgagtcaacaaaatgttcagcaaataaatccatctctgcattagcccataaaaatgcgcgacaataaaagtttgaaaaagatgattgattcgattcattggattaaaagtgataatagcactatttttatattatatattccatttaattattttttttataagtttgatgaaaaaactaaaataaaaagaattaaaaaattatatgtaaattgtggaaaaaaaatttcatgagcaaaattcgtttaaataattttttgctaaaattactaattctgcattttctaaatccatgttttgcaataaatagtaaataaggggtctcaactataaaatttttatattcatgtattacaatgatttttttctactaatttttatttgtttacaataaatttccgaaattttttgtccatattttggcattttttgctctcacattttagtgtttttgtccatattttgttcatattgtgattttttcgtccatataattccagtctctaatgataacatataaactgcgatttgcatagttattgtattaactttaacgttaatccattttaacaaagacattaatcccctcacattcacacacttttcgaaaaaaaaaagtttttttttagtgtttttaaagcgaagaacaaatattgtcattttcgcaaatcagtgagcacaaaatgaatcaatgaaaatactttttaattaatcttctttttttcaattttcaatttgttattttatttatttttatattattgtgtgtctttaaacaataaaaccatttaaatgtttaattgcattttgaaaaagcagtttttagtttcgttcgattttttctcatctttttttttgctaaaatgtcaacagacatcagaaattatcactattttaagtaattttttccgttataagcttaaaataaacaaaccttaaatttgtaatattcaaaaatttgtttgtttattcttttttgaaccaatcaaaaaatgctcaaactttaaaaatgacaaaaatttatttttaaatgatattttttagaatttcaaatttttctacgaaatggaaaatcgtcagcagcagagacgaaagagtgaaatgatcaggagaacattgtctgaagattatcccggccttgactatcttggctttcataatgtgctgaatgccaaatatttttggtaccgtgttctttggttttccgtggttaccgtatgcctgctgattggcctttttactatattcaggcattaaaacaaaaataataataataataatatttttaattcaataaaattttaagaatcattgctgaatacgtgcataatccgagcgcaactcttatcaatgttaagtcggtaaaaaactattaaaaattattatcaaaattaaaaaaaataaacaaatcgccactaaattaaacaattttttttaatattattattaaaatcttttaaaatttttttttttaataaaataaggtggaaaaattgctgcttcctcaattgactgtttgtccaacgcatgccgcgacattaaatattggaaaaatggaacaaaatttgttcaaaaataattcttattttggtgacaattatgcactcggaggnatgtgcttgattttgcatattttatgcttgctgnctcaggatttcaagtattttt

SEQ ID NO: 29197 - DNA, 1557 bp, Heterodera glycines
  misc_feature (1474)..(1474): n is a, c, g, or t
atcttcagccttggcttctcacttcccactttgttttttgattttgtaatgatgtgtaaatgcttcgttaattttatttcccaatcccccggcggttttaaaattcatgtccggtaaataaacttgaatggggacactgctgtcattttcccatacttttataaactcttgaccatttataccgagagcggtgaatgagtaggggtaaataattgatgagagagctactgactaattcctggttataaaatatgccttttattaaatttccttccaaatcttcgatcctgtatgaatcgggtgtcgttgaattaacaataacgattttaaataattcttcggtaaagtttgggagatacccctttgcaaattttcctttttccttggtaattcgaacgatatcgccaattttaaatttgttctttttcgaaattttaaattccttcgccttatataatttttcccagagcgcccgtgcattttcaaaagtaacggatactggcttggcccccaatttcctattcacactgttgttaatgtttattattattctgtctattacatcgacccatcgtagagtgtccatctttgtaaaatatctatacaagcgctcctttattgtccgatttgccctttcaacgactccggcgtgaaggtcaggactatacatcacatttttgatgataaatttttcctcaaaatattttttcatttttccagcctggaactcgagtccgctgtcgctatattttcatcgggataattttcgacttttcgaatacccgatcaaaagcctcaatcatgtcctcattcttctttgacttggccggtgcactgaagatcattcgactcagcatgtggatatgcatagcaacagatatttgtaaccgtcgttatgctttttcaactggtcaaatatgcacaaatcgcactcaggagttcgctctttaagtcttttcctaggaataattattttccgtggttcttcagtctcctgtggtttggattggttattgaggcccagatatggtgcaacatttggaccgggtacatgattctcaatcacgaccttctgtggtctattttcaagtatcccctttaccgtacgcctttctttatagagccaatcgtgtctcttcgccttaaggtcctcgcttatgccggggtcttgtaaattctgaaaaatttttgcgtctaaaatcgctttttcattttggagataatcaccactattcatcgcactccgtagagccaaatattgcgcctcgggaatcattaacattttctttgcaaattcatgatgttattttttctaataaatgttgagctaaaacactcagtaccgggaccaagacagctcccagggctataccactcccctgttgtatcctttttcttgccgttttctctgaacgagatttggcaatttctctataaaaatcggcgtattgtgccaaccttcttttttgtttgntcgttagtttaaaactaaaactcaatatatttgcacaattttcacgattgccaaaatttggtcagctgtagcgttttcgatta

SEQ ID NO: 29198 - DNA, 1218 bp, Heterodera glycines
atttggcgctactgtaaaagtttttgtgatagtcataaaaatttattctctggggtttttggggtctccgatcacgaatctttcaattattttgatcaattccgatttcctaatctaaatttgaacaaaaaatcataatatgaaaaattcaaaatttcgatgtttattcgagttcgggttagggattagaaattagtcaaaatacatgtcagattcgtgattagcgacctttaaaaccccggataacaaattatcatggttttttatcttaaaaaaattttgcaaaacaaaagggtccccccttttatttcaaaatcggtaacttttacagcagcgcccttgattttttccaaaatttttaaaattttcttaacaagaatttgtcgtgaaaaaatgttctaatcacgaatatgaactcagattttgcaaaagccatcattttgtctatgatttttcttcaattctcacaaaaaaataaactgctgccaagcgggctcgaaccccagaccccgtctcacgtgacccgtaagggccagtaattaaatttcaaaaaaacgaaaaacttaacttctccaaacattcaatagcatattcaaagctatttttgaactctacaaattctgtgtatgagttttttacgcccgattaattttcttaaagttttcggaaaaataaagtacttgatgaaaaatcaaagacaaaatcagtgattttacaaaatctgaactcaggttcgtaatcagcacattttttcaccccaggaaaaacaaagttaaaatttttaagtttatttcccgtcgggaccgcaattctacacctttgccggattttttgaaacaatgaatttaaaattttgtatgttagtaaatgatactgagaaagccaacctaaaagccagcaatcaactcgctctctccaaatttcttcatactgtatgtaccaaagattatcaaaaaatcaaatacggactacgcatgcaaaatcggaacagcaaaaccggaatttagaaaaatcccaatgttaacaccacaagtgtgataaactaaacaacaaaagtttggaatccaattctttcaaagaaacaaagcgaagtataaatataacatccgcaaaagatcatcgtcagagaaagaaacacggagaaatgttcacaatcttcattattcctccacaatgataggctccgagctgttcttggtacacctaaacaattaatga

SEQ ID NO: 29199 - DNA, 1159 bp, Heterodera glycines
gggaagctatcccgaaggattcggtctccccattaactgggcgcatcggttcggggggactcccccgaaaacaaaaaaatcgagtttttcgagtgtccgtttggggtactcgaacaactatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaaaaattttttcaagtgtccgtttggggtactcaaacaattatggggagcaaaaatccaacgcagactagataatatttaaaataggttatttctct

SEQ ID NO: 29200 - DNA, 1539 bp, Heterodera glycines
actcactgatctggttcatttttcgtcttgatcaaaattcttttccttcattatacactttttcgttccatgacgcctgatcaggttcactctcctcactgatcaatttgtccatttcctccctaaacacagcatccatttcccctgatcagaatgtccttatactcaatgatcagattcattatttcgccctgatcaatatgtcctttgtcttcatgataaacaaacgtcccgccgttccctgatcaggtttactttcctcactgatccctaatcactttgtgcatttacttttgatcagaatgtcattatactcattcatttacctcactgatcactccttttccttttctgttgttttcctctgatcagtgcatacttttgtattttctttattattttgtttcatttttttcttgattatttcgcccgttttcctgtgattaattatcattttctttgttcagaagttctttttttcagaacatttgacgatttattttcttacaaccaatacatatttcgaagatgtcgacgcgtcaagacttggtccgtttatttgtttaaaataaaaataagaattcttataaatttcacaaatttttatgtattttgcctgaggcatatcttttttattcccttttatttttgccgctaatactctcctcccatgagattagataagagccgcatggaattttcttaaatagtacctaaatatttttccaacaattttcccttccaaaaatgtttttggcccccaaaaaactgcccactgaattggtctttgagctgagccgtttcatcaaatttgatttaaaatgggcgaggaaaaaccgagtgtcattttcatttgaccattttttgttggcaaaaaacagctattggctgaaactgatcaaaaaattggttttcctttctttttgcctgatcagcaaccatttatattatcaattttcagataagcgagtgcattttgtcattcgaaaagctgcgcgactatgtcgtgaacgaactgcaccatttgccggcactgcaaaagtcagctgctcgagccacttacggatgtaaatttgaagaatttatttaaatatcacaatttaaataacattcaaaaattcattctaacggtcacggtcacaattcacggggctattcacgggttttcttcgtaattgtcgcatttttataaaataaataattaaattaattattaaaagcttggaattattgccgtcccacttaagcattggtcgatttcaccagggacttccagtcgttgccgactttccgcgaattggctttgctcaacatcaatgaacacaataaccaggaatacgtaagcaaaatttaattacattttatttattaattactgattatttcttgactacaggtgagtcaggtgatgatcaaggctaatgaattggtgcgcacttgtgcttttcgtgaggaggcttccatggatatgcttggacactttgatactggtaattaatgattaatgttattagtgatgctactcgagtcgagaccagg

SEQ ID NO: 29201 - DNA, 1556 bp, Heterodera glycines
aagtcatgttaaaagtatcatgtaaaggaaataagtaccaaatttattattgtacgcgttgccattgaccccccccccccccatgtgcctcttcgtcctcccttccattcgctgccattgtgcgcttgtccaaaatgataaatgtgagtttgtccccgtcctccctccacgccctttgcatttgctgctcttcctccaatgtcaatgcctctgaaaaggtttctcgtcggagttcctcgctggccatccatccgtggtacttttccacatgtttggggcaatagggcacgagaacgcaatggtggccaataacggaatcattggcatttattcgcatcagaaattggcagagaaaggaaaagcacgaaaacggacaacaaccaacaacagaaagatattcaaatgacaattatgcaatgattggaaaaaatgcgataatttaagcgatgtttaacaatcaaagaaagaaagttgatttttatgcctttaaattaacaaaaaggagaaacaatcacatgttggaaaggtaccacaagcagaagcaaaggaaaagataatgcaaaaggaaatgaatgaattatgactgaataatggaagaaattttaaaaataaaaaagtaattaaaacgaaaaaggaacaaattggaaaaatgactatggacggaggtaatgaatgcactgacaacggacacacagctctgctgggttttgcttattgtttgttagccaattcaaacacggcgaaacattccatggctttggcaacgttcggacacacttaaacattgccaactgtgagttgtttgtaagttctggggtaaacgatgaacagagacaactgcatggtcgagatgaacgtcccgattccgttgggaaccgtaaaaaggaagaagggataaacattttactttttaaaattcaacgaactttcatgtagaaatcgtcgaccaaaactccgtacaacaaccattggacacagacctggaaaagaactggagtactaaggcacttaaaaacggaggggaaatcgacaaccgccaaatttgccaagcaaagcaaaaagggcaaagattcggtgcttttggtccgcaaaacttggccaacatccaaaagaggggaggcaatagttgctggaaaaggtcatgaaaaattaaattatattacgattatacaatataattgggccgggtctggcgctcgacagactttcatgggccacccgagcccgcgccagctaaattttgaaactaccgggttcaggtcgtccggttaaacgggcttctttgagccaagcggacagggtcttgttaaattgttaaagcccgagccttgcccagacattttgaccggctttagcaggattagcgcgccgcaaaaagtgtttcaaaaatcaaagcaaaaaataaatttcctttaaattttgactaattgtaaaaatatgaatttttgagtcaaaactaaaatttgcattgtttgtcctgaatttacaaataaaaagacttgtactataatttttaaaaatggagtcgcaattaaaatcactcgctatttaattga

SEQ ID NO: 29202 - DNA, 559 bp, Heterodera glycines
  misc_feature (466)..(467): n is a, c, g, or t
  misc_feature (500)..(500): n is a, c, g, or t
  misc_feature (509)..(509): n is a, c, g, or t
gagtcattatcaatgtttttaatggaaataaattgttgaaatatttttggggtcgttgaattttgcgccgccgcaaatgtccttttgactgggcgccgcaagtgtccttttgactgggcgccgcaagtgtcggcgccgcaagtgtcgcgccgcaagtgtcggcgccgcaaatgtcctcgccgcaagtgtccttttgactgggcgccgcaagtgtcggcgccgcaagtgtcgcgccgcaagtgtcggcgccgcaaatgtcctcgccgcaagtgtctgcgccgcaagtgtcgctttgactgggcgccgcaaatgtctgcgccgaaagtgtcagcgccgcaaatgtcagcgccgcaagtgtcagcgccgcaaatgtcagcgccgcaagtgtcagcgccgcaaatgtcggccaatcgtcttcttgactttcccttcttctttcccatggttcaattcctctaagtaatannatattttgtttatttttgtataatcatgagttncctatcgancaaatatgattactcatagttttttaattaacacatttttatattttttt

SEQ ID NO: 29203 - DNA, 1478 bp, Heterodera glycines
agtttttgattttaagccctttaaaataataacaataaacttgaaaaataaagtgaaaaataattcttaataagataactcagtgaatatgccaattttattcttaagcgatcttgctacagttcttgcaaatgaaattacacatattccacatctctatcacaattttaagctaaagaaagtcaaaattgattgggtttaaccatagtttattttgattaaaaataacataataaataaatatttgcgaagcctcccatactggtgatgcctcgaaacccatcataaaaaactccttaaaaattaatttttaaatttatatgtatttcaaataaatagctatctgttttttgggaaattttctataaaacaaatattctcgagcatgagagggagggcggtgcgcaatggcccttttattttttaatgaatttttaaatttcatatctattccaaaaatggctatctcttttttgggaaattttctattaaaagagcattataagtagcgaccttgtttattagaaaaaattaaatccacttactctgacgactgttcaggtaaaagtgtcgtagagtaagtgacaaaaaaaatatgtgaataaaatgaggtatcaaatgggtagttagtagtgatagaaaacaattgacatttggattggagaagcaaaaaagtcagacctccagcaaagggaaatttttttaggagttagagaaaaaaaaatatgtttttttgggaaagttttggtaagtaagaaatgtttgaagtaatagaatttttttttctctctttttttgaataaattgtgggagatcctgtagttctatttgttgaaaagatggagggattggatttgctttccgaatgtttttttgaaggatttcactgaatttaaaatttcattttggaggctttctttgttaacctccgatttggacgatggtcggatgttcagttgttgccacttcacgttttgcttcaaattggcccactttttgctccattccgccaacagctagctgcctttggaattttaggatgtgagaataactttcattaatcgcggcgggaggcgacctgaaccggcttggtatggaggccccattctataattagaaatcgggcactcgacgccaagctcgttgagtgcatgtgatagttcagtccggtcggtggcgattggagttgaaattttgaaggattgaatcggaaaaatctacgaaaatttggacaaaatttgttaaaaaaattatcagtgcttgaaaaaaagatttgttattttaaatgttacaaatgtggctgatcattataaatgatattaatttattattcttgacagatgatttgaaatttacaaatagtgatgaatggaaatttgtatttttttttgtttcacataaatttttttagtatttattttttaacaatgtcctgatttttgcttaaaacctttttaaacaaatttcttgtaaatata

SEQ ID NO: 29204 - DNA, 1099 bp, Heterodera glycines
tttatttctcctgagcttaaacttccctcaaaagtgttccgctggtgcgcgacgacccccgcaaaagtggtgggcagcgattgccaatcaaaagtgtcgaggacatggacgcgcacctcaaatcgtatcgacggcatgccatcatcattctgaacaacattttgccgggcattgatgtcaacgacattgtgaagtcttcgttggtatttcaggtataaattgtattttttgtcactgattttcaattattcccctcaccacagatttgtgtcattttgctgatgctaattccggtcgacgactgttctcaggagagactgacccgagaagatctgacggaagaggagaaggaattgtgcagcgaaacagcctcatttgactgttttattaaccaattaatggaaaagtaagcgaccactttccccaccaaaattgcttttattttttgcaatttttaatgggaattaatcgtattttccatgtgatttgcttctgtcaaagggtcttcggaatgatcgaaatgttgggcagttcggcgccgaatgatcgccattcactcaccaaaaacgaccttcgctcggccggttcaatggaggaaaaagtgatccaacagggcacagtgtctgtcttctgcactttgcttagcaattgcagtgcaccgttttttcaagtgggttttcgcaccggcgcgagccgaggaaaactcatagttaattatgaattattattgtttttaaatttaacagttgtctttcactacaagaaagtttctcataaatcttattatattcatttagaaaacaataaactgtatttttatttaataaatataattctgactgttatactataaatatatttgtaaattaaaatattgttttaaaaataataatttttaaaaatttaaaatgagccgagttgtcccatcagcagctgagttgtacgtcagctgattagtccagaaacctgcactgaatttttaaataaaataattttaaattcagcaaatttccgaccgattttttgcctttgtaaatgaacacacattcaactccaggcctggtaaatttattttatattttgttttatgttttacata

SEQ ID NO: 29205 - DNA, 1086 bp, Heterodera glycines
  misc_feature (945)..(945): n is a, c, g, or t
  misc_feature (986)..(986): n is a, c, g, or t
  misc_feature (1022)..(1022): n is a, c, g, or t
  misc_feature (1056)..(1056): n is a, c, g, or t
gaaacaaaattcttccatctctttcgtcgcccgggagacattttacgggaatttagagcatcaattaaaaaagggagtcgttcacttattcagaaaaataaaataaaaccaagcggagtcattaagagtaattaaaacttaggtttttttttctggtttttgcctgttgcaatctttttatagaggcgctgtgacgaagttacaaaactatcaataatagaaatatttaaatttaattattataataataaagcataacttagcttaaacttacgtaaattaatgaaacattgtatgaaaaggtagtagtcctacgtatcctctattatattataatttttttaaaatttcgaaaaaatgaaaattaaacttggttgtttcttaaaaaaaaggaattaaatgttttatacgtttatggatatacaaaaatgatagggttttattgagttttaagaaaattatggacaaaattaatgagtctatggattttttttctgttataactttttataaatttttgctagattttttaaaattaaataagattgaggggatatttagagctatcgcttaacaatgagtttcattagtttgactaagtttaagctaagtaatgctttattattattaagtaaaattaaaacaataattaaatttaaatatttctattattgatacttttgtaacttcggcgcactaaattattcaaaatgtttttatggttattaagcttgtatatacggcatttatcttttttattctcaataataatgcaattattggggccttttcacgaaaattcgaaaattggactctataaaaattgaaaatttgaaaaattccgaaaaattttcattggtcaaaatttcaaaaggattagtcttgaaatttgatttttttttgttttaagagaatttaagtgcatttaagtttttttagatttanaaactcgaaatattaacctttatttggataaactcaatgtnaaaaattagtattatgtataatcacctaaattttanaattttatcatttccttttttccacgttttaccnatactttttgctaattgattttcaaaaact

SEQ ID NO: 29206 - DNA, 1138 bp, Heterodera glycines
ggcaccagagcagagtagaatagaatccatgccatgcgaaatggcacggcatgagaggagagtagaattggatacatgccaaacggaatggcacgggaggagaggagagttaaattgaatacaagccaaggggaatggcacgggagcagaggagagttgaatgaaatccaagcaaaggggaatggcatgagagcagaggagaattaaatgagggccaagcgaaatggcatgggaggagagcagagttgaattaaatgcaagccaaggggaatggcacgggaacagaggagggttaaatgggggacaaccaatggggaatggcacgggaacagaggagggttaaatgggggacaaggggaatggcacgggagcagaggagggttaaatgggggacaaccaatggggaatggcacgggagcagaggagggttaaatgggggacaaccaatggggaatggcacgggaacagaggagggttaaatgggggacaaccaatggggaatggcacgggagcagaggagggttaaatgggggacaaggggaatggcacgggagcagaggagggttaaatgggggacaaccaatggggaatggcacgggaacagaggagggttaaatgggggacaaccaatggggaatggcacgggaacagaggagggttaaatgggggacaaggggaatggcacgggagcagaggagggttaaatgggggacaaggggaatggcacgggagcagaggagggttaaatgggggacaaccatggggaatggcacgggaacagaggagggttaaatgggggacaaccaatggggaatggcacgggaacagaggagggttaaatgggggacaaggggaatggcacgggagcagaggagggttaaatgggggacaaggggaatggcacgggaacagaggagggttaaatgggggacaaccaatggggaatggcacgggaacagaggagggttaaatgggggacaaccaatgaggaatggcacgggagcagaggagggttaaatgggggacaaccaatggggaatggcacgggaacagaggagggttaaatgggggacaaccaatgcggaatggcacgggaacagaggagggttaaatgggggacaccaatggggaatggcac

SEQ ID NO: 29207 - DNA, 742 bp, Heterodera glycines
atagagtccggcgggatcgggactcacgcggggttttactggagtcccgttccgactcccgcttttttcggtgaacgggatttttaacgggagcgggatttttacgggattcccgttcgggactcccgtcccggaaaattttgaactcccgatcccgctcccggaaatttttacccaaaaagggagtaaaaatgcactggtaagaattgagtttttttggtaaaaataatgatttttcattgaaaatttgttaaatatatagccaaaatttcaaaatattcccagcggcgcctatcggcaccgccggatccttaaacctgctcaaatttgcaaaaattggtcatttttgaacaaaatctaacaatgtattgtatttaaatttaattaataaagggagtcaaaaatatttatttaataaattttttgttcgagtaaattataaaaaataatttatttaagccatttgaaaaaaatttatgattttcgactcaaaaataagatttttttatttcaaatttctcctcactaaatttttctatatatttttaatttaataaattgattggcctttaaatttgtgcattataaatattttgtgagtttttaattaaattttgaattactcccgctcccgcccgggactcccgttaaaaataggcgggattttaacgggagcgggatttccacgggattcccgatcccgctcccggaaaattttgaactcccgaacacggacggtccc

SEQ ID NO: 29208 - DNA, 1293 bp, Heterodera glycines
gggtgaacgcaatgatggaactgctgaggacagtgaaggaggaaaagcggcagagggacaaagcgcagacgaaggaacgctgggaaaagcaccaaaaggtggggaggagagaatggggaggaaaattacacacacaccttttaaatgtgcaggaactgtcggagattgaggcgagaagaaaacgcaaaatgatggcaaccaaaaagacggtttgcagaaatatatcgagaagagaagccaaacggaagcgaggggacaacacgaccgaaatggaaacaatcggggcgtgatcaaactctgttttccacctttttcatcatgttatttgatatttatcggcaaaaaatttatactttttaagagatcacaccaaaaaataataattaaatatgcgtaattaaaagagaattgggcggagatggcggtttcttaaaatggtaagaacaatgagaaaatggaaaatgaaatcgccatttacaaaaacaaataaatatcacaaattgtacaaaataataatataatttgaggaagggatttgagttttgtgtagaagtgaaaaggaattttgttgattattaggagttatggctttgcaaaggatgggaaactcagtgtttaaaaatggacaattataataattaaataacaaaatatctgtggagtgacggaaaggaaagtgaggggtaaattacccgtagggggggggacaattgcaattatcgggggagggggtacaattaagaggcagacgatggatgaacaatcggcggtcacatcaaacgatgatttcgcgcatcactcgaactcctccgccggcgttgccgtttctgaaggaggacgagtcgctggcggagctgtcgctgctccccgcgctgatcaactgctcgttgctgctgttccctgtgcccctttcgtttgtgcctttttccccctccgccgtcggccgatccgtcgccaatcgccgcccattggccgccgccgttctctccccgtttccgatcagtgacgaagggaaatggttgaagaaccttgtaaatgtgttagctaatctgatcactgaaatgactgtttctcccttttcccatccccggactgatctgtccttttcacttcctaatgagttttctcaattattcctttccgactgatctgtccctactccttggcctttctttcggattgatctgtccatcccccatccaattgttcactttgtgtacggatttggcggcttccctgctgtcctgctggctatgcttgactgctctcgtcgagtgctctgatggagcgcgt

SEQ ID NO: 29209 - DNA, 1980 bp, Heterodera glycines
attatgtttcttttaggattttggcaaattcgcaatagaaattcccataatgaatcccggtcaattaatcaaaccaaaatagttcccgaaaacgctaatggctaaaatattttttttcaaattttttagaaattgcaacaagcctatcccctttttcaaaagactatcattatgtatgagaaaaacggaactttttttggttcatttgagtaggagaaagggtttgaatgggcccggagggggacgaatggatgcccggcccatacattgtgccaaataaagtttttgaggggtgtgccgtctccgcagcagcggccggaagggagagggagggcacaaattcgtcgccgcttccgccgtttggattgcaaaatgccgtggatgagggcaatttgtatggtgccgtcgctgcaaatagcggtggggtttctgtcccctcccccgggggggggggggggagggggccaaaatttggggatgtagcagagagtgggtgaatagtgaatgatgatgagtagcaatggcaaaatgggtgggaaatgagcgatgagtgaattttttgcatcatcccttccacaagccccccggggcataggaagatgttttttgtttttgttttttgagtgtttgaaatggccatttaaaatttaaatgttagcgaactccgcacaaaacgccgatttttttttgacaaagtgtctcctctgagaaaagtgaggcaaatgatcaaaccatcatttctcccgggcagatatatggacgttctttttgacaaagtgccagcttttggacaaactggccaatttaaaaaaatccactaattagttcttggacaaaatgacgacactgggacatggacaaagtgtcaaataggaattgtgcctaagcggaacaaaaaaatttgccaaaaagggacaaaatgccgaaattgaaacagtgcccaaaataattactagggccgcaacttttagtgaaaaaactttttttgctcaattgttttgaagaaaggagctcaaaaaacgtatttctgcattaaaattttttcatttggacgtcacttttcgtcactagaaatcactattttggcgttttgtcactatttttcactatttcgacattttttggaaaaattccttaacaaaaatgcaataaaaccaaaaaatacacccctaagaattgagctaaaatttttcaaaatatactactatgaaatgaaaaaaaaaatttctcacaaatttactttcttggcaaaaatttttaatttaaaaaaatttttttaagtaactattttgtgttttttggtcttaaaaatcccagtcctactcatttgcaactgcaacttaaatattgaaaattaatttgattcaaataaaaaataaaaaatattaataattaaatggaaatgtaaaaattttttcatttgtgttaaatatatttattgatagcaaaatttccgaaaataaattagaacatgttgtgaaaatataaataattacaaataaatcattgtaagcaaaaaatcaaaacaaaaaattgtccccaaaaaatttaaaaaataaaaataatcaaaaataaaaatattgtataaaattcaaacatacgcgaaccaaaaacaaattgataaataaaatgttatatatatagcaaaaataaataataaaatatataaatatgttttcatacaagaattttgcctatttgagaagaagaacaatttgaaaatgtgggctttgaccacgaactagaaaatgaagattgataaaatagttagaaaataaaaaatgaaacatttagtaaccaaatactaattgtttaaagactgccattaaaaaataaaaaatgcaagaaacctattcaaaaaattatgaggaattaaattttcaataataatcgaagcccacaaataataggaatttttaaaattcctaaaaaatggccctttgggaaaaaaacaatataggcatttaaaaatgaaaaaaa

SEQ ID NO: 29210 - DNA, 1040 bp, Heterodera glycines
gcgcgattctcacgtaaacgagcgcgcctatggtcgggcatttgactgagccgcacgcgtgcgagcccgaaatgcatttcagcttcggagaagcgcccgactccaggcgcccgactaccgcccactgtaccgcgtcaaattccaccactcatcgacagcagacgacccggctgccgcacgccgcaagcagcagcgccgctcgcggcgacggcgtcgcgaacggcagcagcgtcgccggctgcgtacagaacacctgccgttttggcgactgctggccgtcactgccaacaacaatgccggagagccggcagaagacgacgcggactggacggcgttcggtgccgatcagatggctaccgcccgggacctgctccaggctgaggggcgtacgctcaacgactgggtgcagttcgacgaggcgtccgccgactgggtgcctctcaccctagcggagctgaagcagctgtcggacggagtgcatcgtggaagcgactcgacagcagcgggcgaccgcacgtgccccgtctgcctggaagatttggaaggcaaagtgttgctgcgtacgggctgttgccaacaacagttttgcgccgcatgcctgtggatgcacgcgggtgcttcccgctgctgtccgctgtgccgacggcatctgctgagcggtgccccgctgacgccggaggaggacgctttggacagcgactccgtggccagtgatgaggcccataacgacgacgacgatatggtcgtacagtcaacttcagctggacgacgacgacgacagaggcgcagcggggggcggacgggtcccagctgcttgggcttcggctcctttggcccgccgtcgtcggacagcacggacggctcctttgtggagttggctgcgtggagtgattgatgatgggatggggggggggcgacgacgatgatgatgatgatgataatgaataatttataacataatcttgctatataaaataataataatttcgatatctgttgaccgcgcgtgagcatgcgcaaagcgaatggggggggggggg

SEQ ID NO: 29211 - DNA, 1081 bp, Heterodera glycines
cccccccgcccttcagaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaatttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaactaaaaaatttttaaaatttaataat

SEQ ID NO: 29212 - DNA, 1641 bp, Heterodera glycines
ccgaaatgccctttttgacctgaagtggcatttgtcatcttaattttttaaatcataattaccccactgaatccaatgcgcgcatggcgacactcttgcaggccaagctcatcaatgatctaattgttgtagcaattaaaaaatttataaactttaaaatttccttggccagaatttttttttaaattttttacccattctggaaaggttgtaaagcattgcatccattagaaattggacagaaaatctataaaaagctcagttttggatgaataaagcaagaaagtgtagccaaaggaaataagaatttataaaattagcctaaaaatggaaattccggaggacaagcctttgtccattgtacttttctttttgaaggcgtagcccatttttaacgaaaagatgaacaaaacgcaattggatgggccttcaaaacggaaaagtaccgatccatcctccaaatcccacctcattgacgcgtctgcgcatcgtccgtttggagtgtccgaccatgcgaagctgtgcctgcgccatcagatgctccttcaccgtcagcgtgcccatgaacaagtcgtcctgttgcacgtactgaaattgtgtggaaatttatatagtataaggatgataaaaaagggttcgaaataccagaacccaaaaaatccgggaaatttccgagtccaggaaccgaaccgaaacccccgaacttcatatcataacaacttaccccgctgacgtaagtgatggaccggcccagggaatgtccgttgaccagcacttggccctccacgctcagactcttcagatttcggttgagtaacgtgttcagcagcgttgttttacccgccccgctggcgcccatcagtgccacgagttggcccgcgtcggccataccggacacattgtctgtaaaaggtcgaaatttatatacacaatgagtgcaaccccgacaggttttaccaagaattttccgtcccgatttggcatggacagcggtgagaccgtgccaagacaatgccacgggttgcacttcctggacactcttggtcggtgacatcgctccataattggaccgtcttcggcgtatgcgtcccaagccgtagtccatggtcaatgcgtcactggcgctgtgtttcaactacaaaaacaaaaatttgtttacaagattaacgggcctttatggcaatgattgtgagacggattttttgctcgaattttattggaaaaaaatcttacaatgtgattgaaattggttatgcctgtagtggcaaattgtcagctatttttgaccaaagtttaggaaaggaaaagccagtttaaaaagagtggaaatgggacaaaacagatttttggcatactgttccgccggcaattaaattcaaattcaaattattatatatggcaaaagtttatacgtttagcttttttttaaatccaattaggtacattttatcagtcgaaatctcttattgaaatctaacaaagatttcttgacatataaaaggttaataaataaaaaattgcaaaaattttgccattttttgcagttttcgaatttttgcgccggttaatcactaattttttattttgtatttctaaattatgtaatgcattgtcatattccaatattccccccggttatta

SEQ ID NO: 29213 - DNA, 478 bp, Heterodera glycines
ttccgttataaaccataggtaacaacggtcggtttcgttatcaaccataggtaacaacgtttccggtttttaaataaaacatcgcttccgttatcaaccataggtaacaacggttccggtttttaaataaaacatcggttccgttatcacccagaggtaacaacggtcggttccgttatcaaccataggtaacaacggttccggtttttaaaaaaacatcgcttccgttatcacccaccagaggtaacaacggtcggttccgttatcaaccataggtaacaacggttccggtttttaaaaaaacatcgcttccgttatcacccaccagaggtaacaacggtcggtttcgttatcaaccataggaaacaacggttccggcttttaaataaaacatcggttccgttatcacccaaatgtaacaacggtcggtttcgttatcaaccatatgtaacaacgggttccgggtttttaaataaaa

SEQ ID NO: 29214 - DNA, 1067 bp, Heterodera glycines
tcctatagccattatttagtttatgggttatgcacaaaatttatagctctctatttaaactctctatctctctgttctctctctctctctgtattcctcgctctatccaattttccctttctctgagttataaagcgcaataacaactctttctccctctctttctctgcgtgtgtgctgctgatccactcttattccatttctctcactctttcgtccctctctctctctctccctgctctctctcttattctttgtctctctctgtatgtacttatccactttacttctatttctctctgctctcttgctccctccctctctctcccccgtactgttaatttatctattattgacacgcacgcacacattaccccacaatttcgcatttaattagtcgttgctctaatgatgatgatgatggtctgatggcaacgctgtctgccttgctgtctttcattcaaattccagagaaaacgagaacagcggggaaatagtggttatttagagaaaggtgggaaagagagtgtgtatgtgagcgcaagacgcagagaaaaaagcaagcgagagaataggacaaagtggagacaaacaacgaatgagaaatagcggtttttaactgtggcgggcgacggcgctaatttggctgccgcgcgcgcttcgcgttccaccgcttgcgcacgcgcccgtcacaatcaatggcgtacgcttcagggggcacaaggctatgtaccagcacagaaagcccgaagcgaggcctctgccgctgattggctattttctgtgtgcctgtgtttagttagagttagtctcccccccccgcgccctataaaaccccggcgggggttcgtttgcctgcctctctatctgccccagctgctgcttctctatccgctctctgcgaataaataataaatgcttcaagcatctctctccctctctgacacatttttcaattctctgtttctctagcttttcgccattttcagggaagaatttttcatttttgcacttctctgccatcttcagaagatgaagaagaggaggaggaggaggagggaagagag

SEQ ID NO: 29215 - DNA, 1289 bp, Heterodera glycines
  misc_feature (29)..(29): n is a, c, g, or t
  misc_feature (1272)..(1272): n is a, c, g, or t
aattaaatgcattttcattctaaatacantttgaaaaggataaaatgaatgacttatctttttaatatctctaaactttaagcatcatctggccttccaatgcgttcaaataatttggacgaaaataaaagaattgagcagagaaaaattgttggaataaaaattggtgatcatcgggaggaacaattgcagaagagatcagcagaaatatggacaaattatatggaagagactttggaaaagattaaagcgcacatggaaatggttaaattaaaatattatttgtcaaatggaatcactttttgggactaaaataatgatttcgcatggattttattatttttattcttgattttggttttttaagagaaatttcttaacaaaaaggtttgttttattaaaaaacaacaaagtgtttttaaaataattttttagtgaaataaaatttttttgatcatttaaaagtttgttaagctaaatttagtttgggcacattaaatcaaattttgaagatttttctcgggtttctctgatcagttttcgaaccgggccaaagatccgaaatttaaattggaaattcttcccacgaaaaaacggcataagccgacttgaacatttacaatttgggctttgtcttttgagggaggcttaaaaaagaaatgttttaatttattttaaacccaaaatgaatgaattcacatcataaattgaaagagaatttataaatttaatttttcaggatccaatttaccaacaattggcagagcaaaaatatgcaattgacaatttcccgggattggatgacattttcaggaagacgcgcttttttcttgtaaattcacaacccgaagtggactttgacaattacagaagtgtcaaaggcatggaaaaggtcaaattcatcggaggatttaatttaatgccgaaagcgcgggaattggacgaagttagcaaaaaaatagttaaataaataacagttaaatttattaaaagcaaaattaaattatcattaaaaaaaaatttgttaatatttgaccctaggcttataataaataataaattttgttaaatcaatttaaaaaatgcttccgttcacacaatgtaaaatgaaattgatcattttttgataaactttttaaggaaatttccaaaaaatctggcggcaaaaatggcattgttttggtcagttttggcacagttgttgacacaaccaatccggcattttcggatgtcatcgaagccgtagaagggacaattaagaattttccaganatttttattcatatgga

SEQ ID NO: 29216 - DNA, 2104 bp, Heterodera glycines
gtctttttttgataaatcatttctataaattgaaagttccagcagagaacttcgaaatccaaatgacgaattaatgaattcgagatttcattagtttctacaatcgaagaaaaaattttttaatttgaaaattatgttaataattaggaaaaaagtcgatttttagggggtgtatttttcaattttcttgtatttttattgcaatttttctcaaaaatgccaaaatatgtgcaaaatatgtgccaaactccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaaatatgtaaaaacataaaaatccgggccctattgatcaccattatcaatgtgttatgtctctgtgttatcatttcaaatgacttgtgatcaattgtttcgcctaatatgtattaactgtgatgaaacgtgaattttattaaagacctatagacctttttgattgcgaaaaaatgtttccgataataaatcgatgaaaattcattcatggattttcggggttgctcgcatcagcaactggcaattgtctaaatttgttgtcccgataaaaaatagccagaattttggttttcctttgcagcgattttagggaaaaagttctgattaagaatatttcgttaaatgatttatcgaatccaaatttttcacattcattttttcaatggcggcgagaaagccataaaacaaaggtgcggcgagttgggcggtgccctccacaaaatttagaaaaccacagccaatttaaaaatgcacattacagttttattgtccgaataacctatttatgtacaatacaaaattagatatcgcttttttccgatcacaattggagatgagtgccgatcacttatccactgttgctttgttcaccatcaggtatgagcacaacgtgtccatcgttgtacgcgccctcaaacacggcgtttcccgaatgatacaattccgtaaattgacgaaagtgaaatttaacagagaatggggccaaaaacaaatatcgggatatgctttaaaatagggacaacagagaagcggaagattcgaaaaatggctaaaacatcattcggaatttcagtccgtgagacgggtgctaaattctgaataccaactccgtgtaaaggatttaaaggcaaaaacaggggtacacttatacagtttacagggtactttttacatacattttcagatgcctataaatgtgtttcagaaattaatgaaaataagtgttaaggggttctcgaggtcgctgattacgaatatagcatccatttttctaattccgaacccctgacccgaaatcgaacaataataaaattaaaaaatctgtatgaatgatatcctgattggcatcttacccatgagggcagccttgcaacatgaagaataatattccaatctagtatggacggaacgctgacgagtagcttgacattgaggatattaatgatcatgggaatgtatccatactctgacgtcgcaccgttgacgtcatcaatgacaatctgccaaatatcagaacattttttaaatttgacacaaaaagcgccaaagttggtgaaaatatgttaaatagtcagacaaaaatttcttagttttccctgcgggctaatgagcctcttattagtctacgaaggttgaaaaaaaattaaaacctattttagaactgttgataacaatttcttttatatcaaatgaaattttttgaaattttataggctcacagagaatcttagagctattaaattatactaagaatatttaatttggatgaatttttgacaaaataatgaaacgcttaatttgtcattttattttatttttttgtgaagaaattttttggcaaatttttgttaatctataaaatgccaccctaatgaaattttttttaatacattaaaaattaatttgaaatcttctgatattttcaatcctttcctttttataatttatattaaagccattataattaattatgttttatacttcgccgaccgcccc

SEQ ID NO: 29217 - DNA, 1180 bp, Heterodera glycines
  misc_feature (1117)..(1117): n is a, c, g, or t
attccggaagggattcggtctccccataaatctgggcgcctttgttcggggggactgccccgaaaacaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcatgtttaaaaagcaattaaaaattttattcatctccctttttgatagtaaaagcatcagagagcctattttaacttgtacataaaatttgatgcgtttcagagcactttctgaaaaaatatttatgaattaattttgcaaaaaataaataaacagttaaaaactcagaatttctaaaaaaatttaaaaccaattacaattgtcattttttcaggttaagttagtcctgtaccggggagtatgcctataaaatttggtacgattttattgcttattgaaagagctagaaccgaagaaaatctttttaatttaagcctaaactttttggcatgtttaaaaagcaattaaaaattttattcatctccctttttgatagtaaaagcatcagagagccttatttaacttgtacataaaatttgatgcgtttcagagcactttctgaaaaaatatttatgaattaattttgcaaaaaataataaacagtgaaaaactcagaatttctaaaaaaatttaaaaccaattacaattgtcattttttcaggttaagttagtcctgtaccggggagtatgcctataaaatttggtacgattttattgattattgaaagagctagaaccgaagaaaatctttttaatttaagcctaaactttttggcatgtttaaagcaattaaaaatttattcatctccctttttgatagtaaaagcatcagagagccttatttaactcgtacatnaatttgatgcgtttcagagcactatctgaaaaaatatttatgaattaatttttgcaaaaataa

SEQ ID NO: 29218 - DNA, 734 bp, Heterodera glycines
  misc_feature (716)..(716): n is a, c, g, or t
  misc_feature (723)..(723): n is a, c, g, or t
gatagcgtgcgagtgtgagagtgtgtgagtgtgaatcgcgagagagagagtgaagaagaagagaggagagagtgaagaagaagaaagcgagagagagaagaagagagagatagagtgagagagtgaggggagagagagagagtgaagaagagagagcgagagagtgtgaggagagcagagaaaaggaggaaaagagagagagtgagagtgtggcagagagagagtaagcacaaatgttagaaataaacacacttggaagcctttgaaaatgagtgaaagaaaaaaagcaaaaatcgaagaaatgagactgagagaagttataaatttaatttttaaaaaaatttttttatatcattaaaaattaccgctagttaaaggactaatgtgaaaagaagcttgctggggcactttttaaatctgccgaattggatacttttcggcacagtgctccaagatctgaggatttatcctcattttgtggttttttgttaagtaaatgaggatttttttgaaatgaggatttgaggatttttgtacttttttgagaaattttgaggatttttgagtcttttggcgaaaatcgtcaggatctgttaaattttatgataaatttgacatcattaaatttggctttttatatctcatcaaaacaaatctacccatatttttttaaaaattttctaaaccagaaattaccattttttccgaaatcacanaatttangtattttttag

SEQ ID NO: 29219 - DNA, 878 bp, Heterodera glycines
tttaatgtagagtagagcgggaccgggaattttgggcaaaaccgggaccgggacttgccgggacctgagaagccgggaccaggacctcgatttttcttcgggaccgggaaccgggaccaaccgggaatttttaaaaattcaaaaaaatttaaaaaattaaaaaaaaaatcaaattttaatttatttcaagtgaaaatattaaataattaaatttttatttagttttttatttaataaaacccaaaagttaaagctaataaattaatgaaaattttcaaatcaaattttcttcatttctttcaaacaattaatcatttttggactaagtgatcgaatattattagaaattcagatttacgtttcacataaattttttcggcacgctttttccaaaaaacttagcggaagaaagggggaccggcggtgccgataggcgccgccgggggaaattttgaaaatttgagtgagatttgttaacagattttcaacaaaaaaggctggttttgggattactaggctcaatttgtacggattttctttaaaaatgataaaatacaattaaaaaaaaattaagaatcatattttgtcgataggaaagccatgagtatatataaaaagaaatttcaaaatattttcatttctgtagagggatcgaaccaggggaaagaagaagggaaagtgaaggagactagccactaggccatttgcacagttggtattgctactttatgaatatatttaattattatttctaaattttttcctttaactccaattttctcactaatttttgcactcagacccccattcttaccagtgcttgtttttcccggttgccctaccgggaccgggacctgagcttttcaaaatccgggacc

SEQ ID NO: 29220 - DNA, 827 bp, Heterodera glycines
tagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcgggtatggaaaaattttgaagaggctctgcggaacggattagcatcgggggttacgagatagaaaattggcctaaaaagagatagccatttttctgaaaattaattcacaattcccgcactcttgcgggaatggaaaaaattttgaa

SEQ ID NO: 29221 - DNA, 1098 bp, Heterodera glycines
  misc_feature (1003)..(1003): n is a, c, g, or t
  misc_feature (1055)..(1055): n is a, c, g, or t
tttgcagggatactccccggtaaaggactactttacactgaaatgagcgccgagctagctggctcaaaaaaattttcgaaaatctgagtctttcgtttttatttattttttgcaaaattaattcataaatattttttcagaaaatgctctgaaacgcaccaaattttatttacatgctagtttaggcactctgatgctttttctatcaaaaagggagatgaataaattttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcgatatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagaaaagggagtactataattctgcgttggatttttgctccccataattttatgagtaccccaaacggacacttgaaaaaatcgatttttttgttttcggggcagtccccccgaaccgatgcgcccagatttatggggagaccgaatccttccggaatagcttccctatagcctgtactttaattctgcngtggatttttgctccccataattgtttgagtacccccaacgacacttgaaanaatcgattttttgttttcggggcagtccccccgaccgatgcgc

SEQ ID NO: 29222 - DNA, 767 bp, Heterodera glycines
gtgaaaattctaataaaattggtaaccggtactcccaatattttcttaaaacatttggcacagttttatataggacttagaatttgtaaaaattgtcgaagtgtctaattttgtaataattcaaattgcatctttgatttagcaagacaaaatccaaaaaatccgtcaacatttggagctgcaacaccagaaggagcttcgacgccaacaacagcaacagaacggcggcccgaatcagcagggcggaattggcacagcgtcgccacgaaagaacacattttggcaaattcgtactcggattggcggtgctgcggcgggcatgggacaatcgagcgccaacgaatcagtatatatctgacaaataacacttgcatttttttgataaaaatgagaaatctggcgatgcaaacagatccaacggggaccggtaaattggacaccagaaaattggacaccaagcggaaaaatggacaccgccggaattttggacactaaaggaaaattggacaccagaaaattggacaccaagcggaaaaatggacaccgccggaattttggacactaaaggaaaattggacactaagatttcctttttaaaaaaaatcaagaattaggtgaaaataaatttgagtagaataaatgggttaaatgagggatgattgatcaatgtgccacaaaatgcaccaaaaatgggtgacgatgatcaaacaaaatgcaccaaaaatgggtgacgcttgatcaatgggccagaaaatgcaccacaaatg

SEQ ID NO: 29223 - DNA, 1442 bp, Heterodera glycines
aatcactccttatcatttatgctcactttccttccgttttgatcagagtctgttccttatccccgtggcaattgtctgatcacttttttctttctttaagctctccgtttcttcaccagcagccgccaccactgatcagcagatcgcatcattacaattcatcatcctccaaatcacttttttctttccatcattccccccccctaattagttgcctaattaattcccctcctcctccgatcagttctctcccattaagctcacgaaagcatttgcccactaattgcccattaaccaacaccaccacatcattattagcatcataagctaggaggggttcctacttctccccctttcctctcctcacacatcacattacatcctcccatcaatttaccacattattaattgggctcccccctaatttacccctccctctcccccaaataatttcgcctcccctccggtgccatcatttcatttattttgtgtgtgtgattattgcgcagcaccaccaccacaaaaactaattgccctccctattattgatgatgctaatgatgatgatgatgagggcgagggcgcgccggcgaatttacgaatgatcgggcgcccattttgcattattctcttctcttcatcatttttcggtgaggtcgtcgttgttcgttgccccttcattggtggcagccggcggcccccaaattcgccgcttttcgccccattaattcatcgccccccattaataggcgcagcggccaaaatgccatcaccaatttgtacagcagcaaacacaaatgcgcatacacacatttaattgagtgataaaatgcccttttagggttggctcgagtcaaacttttgccgagatttaagcattgatcacccggctaaatctaatccctcaactcgagatcaacaagactcgcgcactgtcccctagtgcccctcccctctctcttttgtgcactttgtctatgtctgtctgtctgtctgtctgttctctctgttatatgccactgtctctcatccacttactgtctctcacaacttttctcgtttgtcaatcctatttttttttttttgctgagttccccgtccaattttctcctcaccatcattttgccgtggattggggtgggcggggaagttattgttggtggaatggctggcctaaattatcaaaaattactattcctcccgcatcccccggagggcggggaaagttgggccggggcggctggctgtaatcatttatttgatgatgatgatgacggcgatggtgattattcaattcattcactcattcattcatggcaatttgctcggggcgccaattgaaaaattttcacacaatttacattcattgttgtataaataaagcccaaatagtgccgtaagggaaaggggcggcaatttgatgaaaagtgccaaatttgatg

SEQ ID NO: 29224 - DNA, 1512 bp, Heterodera glycines
  misc_feature (7)..(7): n is a, c, g, or t
  misc_feature (53)..(53): n is a, c, g, or t
attgganaatttgaccctttttaacagatttttcacataaatggcaacaaatntagaaattttatggagattttgtgggcccgcaacgccgtcaagcgctgccggaaagaattttggaagtttcaaatagttttgtaaaggatttttttttctcttttctctcttcgctggccaccttccccccccccccacaatgttcatcgttaacagtaaaaattctcgacctccgagaataaaaactcgagaaatttcacatccctagactttgtgatgatacctttccaaaatttcaattttttcgtttttgaaattccttctcccttaataaagttcgagttttcatgatgaaaatttgttttcattcgagtttatgacatattttggccaaacttaaaaaaaaatccaaattcgaacaaaaaaaatttcccattataaaatgcaattcttcgggataaagatgtaagatttacccatgaactcgaaacaaagtgtgtagtttggtaatttgtagatacattttcccaaaaattaagcatttttctggcaaaattaatttttttgttgcaacgcaaaacgtgtcgaaggcaaaaaaggaaacaattcaaaaacaattatgagattattatttttaatttattcattcatcatcaattaaaaattattaggtcacaattttgctgaaattattgggaaattcaaatatgaatgatttctatgggtcatcattttgccgcaatttattcttaattgaccctaaaaatatgtaagcaaaatcaggcagaagaatgaatgctcatttatttattcgatccctttttaacaaaataataattatctataaaaaaattaaaatctgaaaatgatttaaggaatttgcattttctaagaatattaaatgtcaatctcaaccaattcaacaaatggcgattttacaccaacagaaggaggtaatgagaaaaagagaaaccgtaggaagttaaattgagtactggaaatgttaagataaatattaatttatgtttgcgaattaaattttataagattttcagaagttaattgtgaatcaattagtttggacaacgatggacaatctgatggaaaagcgactgatccgcagcagcagaaagtgagcaattaatagcatttgtacgagaaagatttgaaatattttgacataatatttttaaaggaatttgttgaaaagtgtgccaagatggaaatggacttcaaaattagcacattagaacttgagaaagttggttttcatagataattaatttatattcttgtcctgacctatgcacaaaatcataaattagagaaatttcattttaaatgttagaaaatggaaaaactaatttactattttgtgtttgcaaaaaaaaattgggcgtttctttacatatttttacatttttcaagaatattctgcatataaatatgtataaaatatttattatacacttttggaactttttgtaaatattttgagggtttttgagaaattaaaat

SEQ ID NO: 29225 - DNA, 965 bp, Heterodera glycines
ccaactggtgggaagaaaagtggttggaaaaataaatacttaatgcaatgaaaaatgaaattgtggcttggcttaatcctcagtcattacaattcgaaaaacaaaatttaccataaaaaactttacttaaagaaattaaataaaaatcataaattaatttttaacttcagtttaagaaaatgctataataataaaaataataaatataaaacgaatacatgaaaatgtcagaaaattaggaaatattgacaattggaaaactatggagccaatttttgcccaaatttaggacaaaacatactcttaattttaaaagcactttaatttaaggaaaaaaaaacaaaattaataaaatttcaatttttagctgaatttttcatgtttattagctaaaaaaatcaacaccaatgaggagaatacataattgtaaaataaatttttaaaaaccccgtaaggcataggttcaccatttttgatgaaaattgcccaaggcactcatcttttcctactgtttggcatctttgcgccacaacacacatccccccactatccagaagcgacaaagtttaataatgagattatttgtttgccatgccaatgcccccggggggggggcgaaaaatgttgaagaagcagcgcatatgatgatgatacaatattattaaaattaaatgggcgtgattattaaaatatttgtttaccgaagatgaatttttttttttggaaaaaagaaaacttgcattatattaaaacaaatagaaaaaatatataatagtgggaggtgggcgcaattccaatcggcatattcggggaataaacggcgacagaattcagggttcgcttttttattataaattttattaaaaataaaggaatactttcttggcaaatacaaggcgaaacccctgttcctccccaccaattatgactattctttaaaaataataataaaaaatttaatttat

SEQ ID NO: 29226 - DNA, 1728 bp, Heterodera glycines
aaagaaagaaaaagaaacatttttaagaactgttttttactcaaaatgacaaaagaaaaaaaatgtaaaacaaaaacatttcatttttcaaagcatttatacaacacaacacaatgttaatattatagtattttcttagtgaacaaactaaggagtgtcctctttcttttgttaaatattttatacaataaaaaatgggttataagtaaggaagggatgcgagagaaatttcccattatctctccctttcctttcttttactctcttttcttttccattgcaatttactctctttttttcccactccctccttcacccacacacacgcacgcgtccaacagactgctgctgcacagcagcacgcgtctgttcactgtatgcccctctcacccgccgctgcccgcgtagacagacaatcaaacagtgcactattttcccacctttccctcgctctacatttttcaaatacattttttaacgcaaaacaatttcaaaacgccacacaacattcaaaagatggcagatacaaacagacactcaactttaatatgtaggatttttccgaaaaatgccaaaaaggcaccaaaatagcaaaatgccaaaaaggcattaaaggcacaaaaatcctgaaaaaggcataataaaattcagccggtcgcttaagatttgaatttatgttcaaaattgtttaaaaaacctcataccaagctaatatatccacattatccgtttaaaatgaatttaattcctaaatcaccattttttagtaaaattcttgcatttttcgtctcaacctaatcatgaatcgtggaagaaacaatcaaaactatttaattcatggtaaattctcgataagaaattgcacagcctactaatctattcaagattttgtctttttaaaattttcttaaggaattagcaaatactggcaagtcgtcggcgctctgggtctatgcgttgtcatggtatgcatcacttatcaattgtttctgcacgtggacgaaaagcacaaatcgttcaaactgatgatcgatggacacttcaaagatttcaagcaaatccacaacgatttcacggcgtggtcaaaaaatttcacatcgcatctcaatgagcgtttcgaacagcaacaggctcgatcaagagcgcgtttcaaacaacagttggcgaagtcaaaagagcgttttgatgaacaacacgctaattttgtcaaaatccgtttggactttgatcgacagtttcaaaaaactatgcaccgttttgccgaagttgagttggaaaccgtgctgaacaaaaggttggattgtttgttttttggaaaacagagaatattcgcttcacctccacatccctttgtttaaggttttcgtataatttttgtttcaatcaaaagcatcaactcctagaaattttcaacagacaaaacaaaattcaattttcgtacttttttcgagtagggattaaaattgggcaaaatgggtataatattcgtgatcagcgacccctaaaacaactgaaaacaaattttcaagtttttttggtcaaaaaattatttttatttttttgcaaaaagagggttccccctttgattttgaaaaaactcaaaaaatacaactttttcgcttctccatttgggtattccggggtacttttttctacaaattgctggatttcgggctttccccgggattggctctggaggcgtttcattttaattttaccttcttttag

SEQ ID NO: 29227 - DNA, 1151 bp, Heterodera glycines
ttacctcctccctcatccccagaaattcatgtgccctccccctgaaaactttttctgggcattcactcataacttaattaactacaccatcatacagttgcacaagcgttttaccgtataaataatacaataccgtattcgttaacaggatttaaccaaaaaattgttaggatttttgcgattatacgccaacattttttggaaaaatcgaacgtagctgaattggaaaattcgaatataatgcacggccctttccttgattctacgctcccttttctcgcttttccccgttttttctttcctcttttttttctctcccttttctcgattttcccccgttttttctcctccccccccccgttgactacccccttgcacaggtatgatcatttctcagggtattatggtcattgatcatcacaatttagtccaaaaattacttcttcaaatgtgatttgagctgtgtcgtgtccagggaatccgccaccaatgtccaacaattgcattcgatgtcccattgatgtgccgagcacaaacaattttttggatgccgcaattgcttcacgaaatgccgatggatcacgacagccacttccgacatggaaactaatgaattggagacggggatttactaattgatgacagacgattaggggcaattaatagcgcgaaatggccagaaacattgttcgagagtctcaatttcgttatcgagtattgctcattttttgggcctgttctggcctctatggtacttaagttaactgattttgagacgcgagacaaagagacatttttacagcccgtaaaaattgtacttttgtgaagggtgaataagaaatttttaattttttttaacaaattacaccgaagttttcaacattcaaatgcaggaacattgtcaatttgaaatttgataagtttttgaaaaattcacatcaattttcattacaaaatctctgttagaaattttttttaatgtaatgaatatattaaatttgtatttttatttaatatgaaattaagaaataaaaattacgaaatgccaatcagttccattccttggtcgagtgccaattggagcagtgtcggagcagcgtccaaatcgcgtaaggatttggtggctaacggacattgtgcggtcggatcag

SEQ ID NO: 29228 - DNA, 714 bp, Heterodera glycines
aaaaaatttttcggattctggacacaatttcccatgaattatcttggtcagtattggacatgtaatgcccaaatgcatgtagggcgtaataacataatgttttaagtatttccagtgtaaaaaattcatcataattacccatcaacccctcagaatccctgcgtatcccccctaattcttgaggcaaaaattttccaaaatttttgaattcccgtggattgcataactcaattcaggcttatgctagaaacatgcttgatagctcattagaagcgtctgagtgtcgacatttatcctccaaaacatcgctagtccggtttcggcactccccgccaagatacagccctttttctgagagccgttcaaaaattttccgaaaaatttcaaaaattttctgaagaaacttttttttacgcaaaaatttcaaaaaacgcgttccaccaatcgatgcaaaatccttaaaaaatagttgtactcttttgttcggagccgatccgagcattttgaagagagttattaaaaaaaagtcatttcaagtgctattttcctcttatatagagaaccagggccccaaggggccctgtgaaagcgccggggccgctttcaacaccggggccagccggggccattgggttttccccgcgcttaaggtactcgctcggccgcttcgcggcctcgtacgggcctttggcatagtgcttaaggaagtcgctc

SEQ ID NO: 29229 - DNA, 1004 bp, Heterodera glycines
atcagaatataccatatttactcgattagtgccccaggggctctattttatttatttatttggcttttcaatttgatattttgccaacttcattacatatgtgcataatttgttgggctcaactcaaaatgatgacaatcggtggatggattggatcggctgattaccagcacagattttccattttccttttggcgattggttcatttgttggtgatggtccgtcgtggacttggcctaatcatcagaaccaatttgcttttgctatcccttttttttctttttttttttgtgccacgtaaccatttgtgataattaccaccaccaacatttgcttggctttagctatcattttgttcaatcattctcattttattgggatggttgaagcaaatgagttggggttggccattagctaaaattatttttaccaatttataaaagaattagaaccccccccccccctgaaatatagtcctctattaaggggggttgaaaatttgaagcctcggggcttacattttaggaaataaaaattttcaagggttgcccacaaacgaaacagcagactttttactttgttataagtttgttattttcattgccaacttttcccccgtttttctttgctgtgtccacacatttttggcaccgctcccgcacatttgctcctcatatgttggcatttttttaaataaattattttatatatattttttcaaatacagcctcccccgtccgtgtacaaattaaataatcaaactacctaattagtatcataaaatgtttccccgttttgtgtgcccattcattgtgatgtttttgctgatggctctgttcgacaacagttggaagtgcaatagtcgtcccttatttggtagtaaatcaacagcgcctccgaccactgtgaagccgactgccaagtcgggtgccattggtggtgtgcgggtgggccagcagttgttgcttttgcccatgccgttgttcatcgcgctgtcgctggc

SEQ ID NO: 29230 - DNA, 1163 bp, Heterodera glycines
taatcatccgattttgctgtatcaaaaagtgttggaactgttcggcgacttgcaacacaaaggaaccaaaaaggcgaaggtcgaccatttcgcgtgtttccgttgcatttggtcactccagaatgttttagaaggaatttgtcaacttttccggcgtcatttgccacttccccactcgctacgaactttgccaatgtcgaattgaggactcaggtcgaacttggccagtttcagggccgcgaaatgaacaaaacgcagaccaaattaaggaaaactgttcaaattgttcgaaattgcgacggaacggagcaccgaacggctgatcgtcgcttcgaactttgtaaaagtgcgtcggataggcgatggtatcgcatgagaatttttgaaaatttgcatctaaattcaacaatttgttgctaattttggctggcttatcccatcctttcttttcagactttggatctgctggactctcttttcggccttttgcgcgacaatttcgtcgtttttcgcatcaatcccaacactcccatcacggcactgccgcaaattgagcatcaaattttggaaggggcgaagggacagacccaaatcgtattgctgagctcaaaaatgggtccaatttggacggcttgtgattacttacagaaattcgttttcagaacggttgaactgcgaccttttccattcggcacggctcattttcttcgacttcgacccgtgcaacgacggcaaaacgatcaaaaaatgggatgccgaaggaaggctaaaagcggcgcaacgactatctacctttcggttggttttatgcggaattttaccccaaaaatcattgttccatttgcttggtctttcgggcttttttcccaatcgattgaggaaattttttaaatcggaattgcattttaggcacaaaaaatcgcaaaataggcattaaactggcacaaaaaaacctcgaataggcacaaaaaagaaaatttgataatgctttttaaaaagttaaattgcaaagttttggtctttttcaattgcaaataaatgctgatagattaacacttttggcactgctccgtgtacatttctctttttcaaggagacttttgaagcgaatgaattttccttttacggcggcgacaattcccggcccaattctcagccgacca

SEQ ID NO: 29231 - DNA, 1121 bp, Heterodera glycines
ttggttccgttgccgatcggttcgtccctcttcctccgcccaatttctcgtcttggccatcgtccgccgtttcttcgtcctttagtgcggccattgccaagcattgcctgtgaaattcctcctccgccgtcccttcccctttctccgagctcaaaatgcgctccaaatgtctgatgtacaaaatggcggccttcaaagtctgcgccttggtcagctttttgtcaaagaacgcttgacagctgacactgagctaaaaaacaaaaaacaaacaaattaagggtaattaaaaggcaattgcgatgcaatgcgatgggaaactcatcggcagaccgtttgcttctgatcagagagtgcagccccttttgatcactttccattgatcacttattttgtgtcctccccccccccccgctccccgcccgcatttattcgccctttcggtacttttccgtccgcgctcactttgctggccaatgtttcgaattcgctgttcatctgctgcactctcttccgctcccgctcgttccttctcgccacttggtgcggcttcttcccaccaaatttcactcccgtcccgcgacttcgctgtttggtcttcggcggcgaagacaccaatttgcaagcaaattgactcttcttgccatttttggatggtttttgtttgattttgttgtctttggagggattcgactgcagattggaaaaggaagaagaagaagagaaggaagaggaagaggaggaaagacaggaggaagaggaagaagaagaggaggacgagtgacgcggttgctgctgttgcggatggtggtggtaaagcggcacagagtgagtgccaatttcgaaaaaatgacaattgccggaaagcattggagaagaagcggaacaaaaagctgaaagaaatacaatagaattagaaaataaattggagacaatcagagaagggatgaaacagaaaaagatgaaaagtgaaaaagtaacagcaaagggaaggctaattgtaagggggggggggcaatgaggacgaatttggagggaaaggaaagagggaatacaaaatgtggaataccaaaaatggcatatgggggggggggggacggacggcacatggggcacagagggcg

SEQ ID NO: 29232 - DNA, 1838 bp, Heterodera glycines
gcgaagaagaagccacagagagaccctcttatgatgaaaacacttcgaatgctcaaacaacaaagaagatgaagcaacacacagaccaagtcaatcttgacaaatcctattgatcattaaaaattgcaagaaatagtcaaaactgactcgctctcgtcgtatgagttttaacaaccccccacccccctccaatcaattatgactggaatcgaaaaaccaccaaaaaagtcattgggtccttaaagttctataagggcgggtcattttttgactacgacttgcagagggaatgcccattaacattactcgggatcagaagcaacaacccctttctaaatgtgaatttttctattatttgtttgtgtatatcttaaatggcgtgttctttcctttattatacgggagtgaaacattaaaatgttgtagtctaaatttctaatcgaattgttttttctattaattacttactttttacttgggtttttgcatggcgctaacttccatttaaaattgtgataagtaaattcgaccaatttcgaacttttgctgttttgtctgtgaattgtcgtccattgttaagaatgcctttgctcctggtcaccggctttccgtcctgtggcaagtcgtcaatttgtgaaaggattttggcgttttttgaggatcaaaatccgggaggggaatttcagctgcacatcgtttccgaccgaaacaatgaattggacttttcccctttaatttacggtgacccgaaaaaggtctgaggagtaaacgtattggcaattgaatgagaaatgattaaggaaaagcaattgcgaagtgcacttcgcgccaaagtgcagcgattgttgcacagaaagtcactggtcatttgcgactcgaccaaccacataaagggtgctcaattaacaattaatttggcgtaattacaaaggaagtcaattaaggctatcgatacgaattgtttgtctagccaaaaacacacagactcggtgcgccgttctccactgcaaggcatccctgccacctgcaaatggttaaatgagcaacggacggacaacgaacggtaaaatctgatggcacttctttgataatccattctttaaaagatatccagatgaaatcctatcaaatttgtttaaacaatttgaaactccggaccaaaaaaatcgatgggtttttttttatatagtacttttttataattttaatacttaggacgcgcctctttttgaggttcaaattggaagagaaagtacggaagagaaagacgaacttggcggatttggttcaattgccgaaggcacaaattgcgctttattaactgagcgaacggaggaaattgacgaggccaaaatgccacgaaatataaaccttccctttgagcagctccacgcgattttgatcaaagtgatcaataatatttgtgaagcaaaaacaaaaaaaaagttaagggcaaagaattgaccgccaacaaatgcatgaaagtgcaaattccaatggtttcgtccgcgtttctcgtcgccttggaccagcaaactcagcacattttggaccgtcttttggcattacaaagtcatgcgactgatggcgacgaattgaaagtatttgacggagagacgggacaaaggaatacggtgactttggggccacaaatgaaattgacatgcaatttgatctgtttttattgaggtgactttccatcatcgcctccgttcactcccacagctcagccgactccgacaacagttcatcgcttatatgaagacgcatccgatcgacgactttgacagaatcggccacgtttttaccgactatttgaattctaattcacattgata

SEQ ID NO: 29233 - DNA, 1402 bp, Heterodera glycines
attcaactccttataattacaataatatatggtgagaacaatcaaatgatataagtaaataaactattaaataaaaaatgagcttctcaaattttagaattagttttttaattacgaataaaattaattataatgagcaaaaatatttatttattttatatttataatacataaaaatttgctaaaaaaatgaaataaaaaaaattattttggttcaaaatgttaaaataatgagagaataaatatgcttgtaaataaatcattataagctacattaaaataaaattgaaaaatttgaaaatataatcttataattgaaaataaaattactataattaaaatggacaatgaatcatttattgtaatttgaaaataccttttaatttattgcatttttgcacacagcgaggactcaccaattaaacacaaatgctttattaaaagataaattttaatacataaaacttaagataaattattttttgaagaatattactttcaaaattatctataattcaattagaaaagaattattgtaaaacaaataaatatgcaagaacagttatgagaacgctatgaaaatatcataagcaaaagtacaaaaaataaaataaaaaattggtcgcccgttagaattcgatagaatcttcacttataagtatgaagcagggatgttgctcgtctcgtgtatcgtaatctcgtattctcatgtttttgggggtgtctcgtctcgtgtctcgtatctcgtattttggcacgagacacgagatttttatgctctggtaagaatgggggggggggcggggtgtgagagaaaaaaagttttttggaaaataaagagaaaaaataaaattaaaaaataataatttgatttattcttttacataaaactaaaatgtaaacatttagtcaagtagtccattcattattttgtttttgtcttttaataaatggtgacaagatttccgaaaagcgccggaccctaaattccctaaaattttaaaaatttaatccaaaaaccagcgaattttatctttattaattttttagttaaagatgtgatattctcgttccaaaaatatttcgagaaggctctctaaaaggaagagtttttctggccgaaaaccagaaaaaaaatggaggcgttgttaattcagtcatcaaattataaaattcctgtacatagagactatgaaagccgcttttctgattttaataattcttgatatctttcaatagcattaagtgttgtttatcagaatattaatttataaaatttttatatgaaattataaaaaagttatggtccaaaattttcaataagttctgaagcaaattcctttaccagaacttttttaatactcccctgggggggttgaaattttaaccgtaaatagagaat

SEQ ID NO: 29234 - DNA, 1269 bp, Heterodera glycines
attaggtggtataaacaagttaatatgggagaatttctttgtttccatggctacaaagtcgaaaataggttttgattagaaaatgtaattgaaaagttggaatttttggtgtttgatcaaatttctccgcatactcgaataaatagtgccacggttctcgaccaacttttgctattagtaaaattggtcattttttgtagtcaaatgagccatattaaattttccctttttaaaagtgcttgctgccctaccttataagttaattacttgggctgggatttttaagcaaaaaaaaaaaaaaaagcaatgattcattttttatctaataaaataatttctatagcatatcaatcaacaaatgatgacatcatcggaatcgtcgcaatgcacttataagcgcttgtgaaacccgctgttgccagggttactaagcacagtctcagagtcatgcacttgcggatggtctcctgaaaaaataaatttattaaaaataattaattatttattacctttgggagtgcccaagctgatttgcccaacagaagaatgtccagcgcagcacagttggtgtcaattgtgccaacttgttctcggaactggacagccaaattggccaattcggcgttggcaccggcatgggaagcggcggaagcggcaatttcgaacatggcacggatgaagccgagagagcgagcacactcatctaattaggaaccaaattaatagaaattgaatttaaattaaaaaataatagatgattttaaagggatttaattgtccattggtaccagatgatgattgagctgcgttgatctcgttgatgagtgtttgaccaccattgccagggcaccaaattgttttcagttggttttccaccgcagcggcgactctttcggcactcagacaaagcgaagactttggcatcgaagcggagaatgtgccggtgtgatctttcatcatcgaaacgacatgttggctgccaggacagcatggatctttttaaataaaaatgattttaaataaaaaaattttaattaatacggggtgccgaaaagcagcatttgcacagcaaacagacaattgcgacgatggaaatgattgaggagcagaaagatgaagccattttctgagaggatttgaattcttagaggatgagtgaatgtgaattgaatgatggttatttggcattttcttctgcgtttaaatatgcaatgaatgaaaggttatcgaataccacttttaagacggggatttcctccgacacaaaaa

SEQ ID NO: 29235 - DNA, 1378 bp, Heterodera glycines
ttttaaaaatatgatgtaattgtattttttaatatataggtgcaaaatttgcagcttttcacccggcgacgcctatcaacccccccccccccccaattttcttaaaaaataggctcaaaatcgcaaaatttttatattttttgcttaaatttgttacaagatagatcaaatttcaaaattttcctcgcgtctatcggcactcgtacccacccttttctccaaaaaaaattctttaaaaaatgagcagcaaaaaaagtcgtgtgaaaagtaaaataaaaatagtcgttgccttgacttaaaaaccgcgaaagacttagaaatgacaaattttcgttgaatcaaaatcaaaaaggaaaaatttattcagaataacctcatttattaatttcttttaatttgagaagctttaattatttttgtgaatacgaaaattttttgaaaaaaaatgtttttgttaaggaaagattttttcaaaaacttcgtgcttcgaaaaaaattgggcttcgccttcggctccgagtgttaagccgagcttcgcccagccctgatatagatagagaaaaatatcgaacatttttattgcttatttaaattttttaacgctcgatctaaagcgcttcaaaaacaaattttctaacacattttttttggtactttcctgttatgaggaggccaaacccaaaaatttaaaaaaatcaacaaaagggcgcgatttatgcctcctcaagtgtcatgcgcttgcttgattttgcgcgtcattttgttgatttttttttttaatttttgggtgtgaccttaaaacaggaaagtacccttttttctaatatctctaattgattaggcatttgcttagaaaaagctgtaaatgaggtaaaaactgtccttccctcggatgagagaatttctctgttccgtaattttcagagaaagtaattttattttgataaattattctgtgcagcgatgtatggatttaaattaatcagatatatgactaatcattttgaactaaaaatgttgaatgagcatagattgatatggagctaaattggacaatgaaaaaccaaatgccaatttacgacatgattttgctgttggcaattgatacatattatggatgccaacaaatgaaaaaatgttctgatttgtcagaaatgttctgattttggggtagcgaccaaaatttgttctgatttcttagataaactcatatttttgaaattttgtggcataatgttactttttgtcaagaaaatataagatttgtggcaacatttggtttttaaacgcaaggaaaagtcgtcgcttagcttttaattgcaaaaagcggccttttttggtgaaaatctgttaacaaataaaaacgaaattacaaaaa

SEQ ID NO: 29236 - DNA, 1301 bp, Heterodera glycines
  misc_feature (1289)..(1289): n is a, c, g, or t
atttcattcattcactcactcatcatacaattttggtagaaaggctggacacaatttgcttaagaggaatttgcaggaatttcagtataaattttgaattctgtaaaaattttggcatggcattccgtaaaatgccgcaaaaattttcaaaaaagagagctttttaccttgagatgtaatccgccttttcgttttttcattgttttacacttttttggtcgaaaggcacgaaaactcgtgaaatccgtaaaaacggttatttttttggagacatttttccccattcattttatgtacttatcaaaattaaaaaattattaattttttaacttttattaaattcctttagaaaattcaaaaattgtagtttacaaataattatagccactttcttttatgaatgaatacataatctttaaatccatgaacaaatcccggattattcgcttaatatggtaacaattgcttaatctctggcaaaaaaaggatttaatttactaaatttataagccggcactcaatttctggtgccgaattagcttttccacatgtgccacaaaagtaaattggcaatttttccgaaacttttggcttttgatagtgccaaggcattgaaaatatattttcaaaacatggatttttaaacaggcattgattgatactggtaatttttgattaattcacttcggggttcgaacaagcattgcaattttctattggaaaaattactatgaaaataatggtacatttttgctgctaaataatttcccgaaaccatttaaattaatttaaattggcaattttggcatttcttaattatggcgtcgaataaaaatatttaatttcaaaaataattgcattttaaaagtattaaaaaaatttccggcatttttgccgctaattattaccttattataagcaattttaaaaatttgcaccaattttggcgttttcaaaaaactctcatttttgattctcgacactcttccagagcaatcattcccgaaatcgatcatcctcctcctcataatcacctccatcattatgcacatttccatcgttgtggcgggcggtcggccgtctccattttatggcgtcaaaagcattacaaatcattcattcgttcatttcctccccccaccgctcctcataagcgtcccccccattagtcatccaatcgcggcgccggagcgtccgtccgtcccgcgccgcgggggcgcaaaaccaaacaaaatttgccgccgccgccgccgccgccgccgccgccaataatattcttccgattgtcnggcggcaaaatt

SEQ ID NO: 29237 - DNA, 2217 bp, Heterodera glycines
cccaattcaagcgttttattcctaatatctatgaatagcatttttgtgctttcttttcacttccattctgctgtttgttagtcctgttatttggcatgtcatcgtgccccaagaatatctacaagaagtttctttgctgtttgtgtggccaacattttgatggagttggtccgttggagtcccatttggccctggtgcatgtgttttacttggcctatgaatgcggtcagtcctcaaacacagttatttagaggaaatgggtggtcaaacctttaatctaatttgactgcataacgctaagcattttcagatctctgcaaagatgcgttgtttccttccgattttgcgttgcgagagcattacgttaaaatccacaacaaaacatgttttactgtgagttcttcttttggggttgtgtttatgggtcaatgcagttcgtacaaatttattcaattaaaaccaaatttttcaaatagtggttttatacagagacgggtgcaggacccgggtcccgtgccaaattttacgagttcccattcatcccgcattttgggaattgagggttaattcttagaatcgatcaaagcttctgttttcatattcttttgctcttctcagataaaatatcgcgtctctcctgagttggaagagcgacgcgcattgctccgtcgtttggtcgatcagtcaatgcataaaacgggaagcggcacaattcagcagaacaaagcaccgaatttggagccgcccaattcatacacttctcagctgctgatggattgcacgtcactgctgcaaacgcaactgatggccagcaatcactttctgaacagtggcatcaaaaaggagaatgtttgggaggagagaaacgacggcgaaagggtcgaccatttggagggcgaaattgaaggaccaccaattgagggggttggtgaacgatagaagacaacaaaacaaatggaaaccgatagggttaaggtcaccttttgcgctcacaaacgaaacgctttgatgggtcagaaacgcaccttttctgatgaagacaattcaactttgtaaagccaattgcaatgggaaagtgtcactcatccaaatttaagcaatttaaacgatcgcctttcgccgatgccaatgaattcgctaaatgctgtaatggatacggaggagatgctaaacgaagccaatttggagattaaaggcaccatttcagcaaaagtttgattttattttttatttttttagtttctccaaccaaaaaacaaacaaaaaaccgacgaaagacacaccgagacacgggaaatgaccaaatgcacgcgaattcctcgcaagggtccaacgaagaaacgaagcagcaaaagggaggaggggtaattttatttgtactttttcattttttctccaagaatggacagatttgaatttgttccgaattaagccaatggttgagtgttcgggctgcaaacggatggttggccaatatcgcaattcgatgctcatccatgtcaggtcagcagcccatccaaatgattgaatggtccaatccggctttgactgttctgtcctctgtcagtacgcatcactgcgaccagccgattttcgaatgtattgcggacggatgcgggaagaaatggtactccatttcagcacggactaaagagcacattgaggctaagcacggaggcgacttcaactttcttcaggtgcccatcatcatttcagcattcatttgttgctattataatttttaatttcccattttatttgactctgaaattcaaacatttatttcccccccccccaggacaatcgcagttcgctgttgcctcttctccggtcgaccgccgtccgcctcttttctggtgcttattaagcgcacatttgtgattttttgtgtaaatttgtattttctgatcactttcactgtatcgggtaccatttaatgcaaattcaatcacatggaaaataaaatatttgcaattgccattaattgtttagtcaattagcagtattaataatagaggaattgaatctcctttttgcttattttttcaccattttgtggttaatcacgcttattatcttataattttctgtgttttattggattgtttctttttcgaaataataataaattgactcaattatttttcacttttctgtactttttttactctttccatgcttttcttcggaataactttttctttcccttttccataa

SEQ ID NO: 29238 - DNA, 1263 bp, Heterodera glycines
  misc_feature (1155)..(1155): n is a, c, g, or t
  misc_feature (1226)..(1226): n is a, c, g, or t
tacatatagtacaaaactcaattaatgttccaccaaaaataaaaaaatgtcccctcatttgatcgaatttttctcgttcaaatttgttctaattttgttgtagctgttgttgttgcaggtgaatggccgtttgagaccgggttggcggcgttccctcggggtagtgcatccgtctcttacgagtctaaaaaaattgcgtagaaaataggggggggggggcacatcaagtccgaattttcagaaattaaaatttcgaaaaaatcgctagaaaatttaaatttttttcggtattttcctgttttggggtcgcattccaaaaattaacaaagggcgcgcaaattcacaagtttcgcaatattccaaagctaatctattcgaagagattttatcaacaattgttgttctcattatatccccgagatttaatgctttatgcactttataaatttgtgcacatttttggagaaaaacgagctgcaccctttttttcattccccatcccctaaaaatgagcaaaaaacatacaactgttgttggcgctgtgttcacttcaatcattttggtgatcgctcggccggtcaccggtgccggcttcagttgctgtttgcccttcccttttcctttgcctccctcagtcattggcgtgttcagcaccctcaccggactccgttccaattcctcgtagaatgtgctgctcacacgaaagcgtggctcaatgattggacattcctaaattgggattcaaaaattaaaaaagaaatggggaaaacaattttttttttttgccaacactcaatttatcggctggcatttgggcggcaagttggtcaagttcaagctcagtgttgtgcagtgccgtcttcagatcttgcaggagaacaatgtgggaacgaaagtcgttgtactgcttcacaatttcttcgtaagcgtgcggatattcaagaccaattgagactgaaaacgcagaaaattaaagaaattaaatttcaaagatttctgttttttctactcgtcctttttgattttttctttaatttaaattaggccattaaatttggtctcgcttaccaatttttcgagttgtcacaaccagtccaatgttggacaatttcttctgtccaatgttgctaggcaatttcatttcttgacttcgcnaatgtgggccaggcgtcttgaattcgggccatcgaatgtgcgagtccatctacaaaaatgatttttttcanttgaagcaaatcgaaagcatttttttatgaatcagag

SEQ ID NO: 29239 - DNA, 1065 bp, Heterodera glycines
gcggtcggggtcgttttcgcgtggccgtttttgcgtgagggccatttgcgcgtggccgttttcgcgtggttgaacataagcgaattttttacttttttatagtttggaaaattttttcactcccgttttacttctggtgcttaattcaatatatttaaaaaaaatttccaacccctattacagaattttttctatataaagagttatttgtgcgtaaaatgtttggggcattacttttgtacggcaaaaaattgaacaaaacagttaagactatccaatgggttaatctcttggatatgtatgtgaaaagaagagtcctccgccccggaaaaagaaaaaaattaaagaaatgtcgtgatgccgatggtcggattctgtgtctcattcacgttgtcaatacttgaagttgttaatctttacaagcataaaaatgaggacgcttttgagtaaacaaaagcaaaaaattgtttgaaatcggatttgggattcgaaataggtcgaatgtatgttcggcacacatccgaccaatttcagtcctaataggcactcacgcgaaaacgtaccccacgcgaaaacgggccacgcgaaaacgtcctggcccccaaaaccgggaccttggtactcagttgtccgctaccaggtcccggtcccgtggcactctattttttaccatagaaaaagtgattttgtaagaaatttttttaaatttattttttcgggcggaacaccaattccgaaagattaccaacaaaaagatacaaaaacttcatcaattccttttaatgactataaaaatgtttgttttttcgcttttcctcgcatttgaaaaaaaataaattttctaacgcaataattctgcaattattcttacctctgtgacgacgacatcattcggagctcggccaaaattgtgttaattgccaaaaaatgaaccgacggtaaaagaattttaatagtcacacaaattcatcatttatttaactaacaataaactgttttctataatttcagttggatttgcaacgacgtttggatggacattttcccatcctttgaccatgctca

SEQ ID NO: 29240 - DNA, 1176 bp, Heterodera glycines
tatgcctatttaaattactttcattgctttcctttcgcttacgaccataccacgttgaaagcacgccatcccgtccgtctggcaagttaagcaacgttgggccttcttagtacttggaacggagacgtcctgggaatcgaaggtgttgtaagcttttttccttttttcacttgtaaatttatttaaattttcaatttttttagctttttttcgaaaaattttttgtctttttttcggcaggcactgcctctgacaatgttttttatttatttagaaaaataaattgattttttttctttttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttaattgctgtcctttcgcttacgaccataccacgttgaaagcacgccatcccgtccgatctggcaagttaagcaacgttgggccttcttagtacttggaacggagacgtcctgggaatcgaaggtgttgtaagcttttttccttttttcacttgtaaatttatttaaattttcaatttttttagcttttttcgaaaaattttttgtctttttttcggcaggcactgcctctgacaatattttttatttatttagaaaaataaatttttttttctttttgatttattttaattatatttcattcttaaattttttaataaacattttcaaactttcaccttattaatttaaggcgaattttgccttttttaataaattctcttgtgaaaaggcaaaaaaataggctcttttaatatgcctatttaattactttcattgctgtcctttcgcttacgaccataccaccttgaagcacgccatcccgtccgatctggcagttaaacaacgttggggcttcttaatacttggaacggagaagtcctgggaaaccaaggggtggaagctttttttccttttttccttggaaattattaaaatttcaattttttaactttttttccaaaaatttttttgttttttttccggggggcctggcccttgaaaaggtttttttttttttttaaaaaaaaaaatgattttttttttttttttattttttttt

SEQ ID NO: 29241 - DNA, 612 bp, Heterodera glycines
ataagtaaaattgtaaaaaatgagcgaatgttaattaaacctaacttatgccaagtggcgagggatccctcaggcttagtttttagaatcttaatttttaaaaaagtacatttttctatttttgggttggggcccaaacgaccccggggcccaaaaacgggggcccaaacgaccccggggcccaaaaacgggggcccaaacgcgggggcccaaaaacgggggcccaaacgctctggtcccccatgtcgccccccccccccctcccttgcacgatccgcgtcagtctctctctttctctccctctctgtttctttttctctcactatcaatctttctcactctgtctttctctacaaatgcaggacagaaaaacatccgccgatatgtaaatacacatgatatgatggggtgttcaatcaatcaccatcctcactttcttaggacaacaacttttttcggtaatagtgaagacaatcgcacctcagatgagagtcattcagaggaatggccaatcgatcccctactgggatgcgtccccagtgatcgatcaatataccttaccttccaagacctgcggcgtctaaatatggacgcgaaagaggactcctctgg

SEQ ID NO: 29242 - DNA, 1198 bp, Heterodera glycines
tttatgttaatatttaaagtttaaaaatttcttaaattttattcatgcataaattatatttattcgctatattcattcttgctaactttcctgtaggaaggaacgaaaagcatttctgtacttaaattcttatatttaatataattactattattccgcttcaaaaatcttagttgatttgttaattactaattaaatttaaaaggtcgtttagcattttttaaattattagataaatctgatttttcaataaaaaatttttttaagttcaattttctgctatttaggagtgtcatgcatttcataacatggttttttatgaaaatttaatactaattatttcttttctcctcgaatattttatattattttaattagtatgtcttttatgatatgctaatttatttgttgtttattatctttaattcatcgtacagagtgctaagcattgtaatcatctggtaaattgtcgctagtgtatgatagcatatgattgtgcaaatatgttgagttactgacaaaaacaaagggctaaaagcagatagggaaaatatgcatattggctatgattagggctgaaatatgtatactaaggctatgaaaataggggtgaaatatgcgtatgcgccatgaaaagaggggggaactatgcttatgggctatgaaagagagggggccaatatgtttatgtgctatgaaaatataaggtgcggataaagcaattggaaatatgaggcaggaaaagaaatagagagatttacaaatgacgtgttagtttagaccatggactgcataaataggtaattggccggagcaaaaggcatcatttcatttccatattagccctctccctatcaggaatctgctttcgcgattcgctttcgcatatttcgcttttttggcactttcgctttcgcgtttcgcattttatttccagatttggcccatcccagctccctatgaatgtgaataaaacatatccaaaagctgttcactggggcttaacatttgtcctaatccatttaaacagagtctctctcttttggcgatttgcttatggggataagaaatggaaatgtaacgttcgccacgaatactgccccataatttgtctccctccaaatgttatgatatattttaacatgttttaccgcataagtactgcatcgagcttattttttccttgattttggcggca

SEQ ID NO: 29243 - DNA, 1284 bp, Heterodera glycines
gaatggggatggcacatgtcagcctttacggtgggtgccgaattgcccgcccttttcaagcaaatgcgagggacttagttgcggcacattaactctctctcactcccatataaaaaaagatattttcatttaaaaaccgtcagttcccctttaatataataaattttatcatttttctcctacataaaaatattgttctatttacatacatacatacaagatatattagctatgtattcattaaaaaaaagaaaattgccgcccgaacttctctcggagttggccagtgccttaccctttgactttcgctgggccacaacccgagtttcttcttcttttgattattttgtcaaaaagagacagaaaaaatggatttggaccgaattcattcgggtaaataaacgtttgatgggtttttttagggctcagattggtgaaaagtggaagtaatataatgatcagcggccgctataaaattctcggggatttaaagttattttaaccatttccgacttcattatcattaaatttgaacaaaaaaaacgaggaatttgagttttgacttttttcaagttcgggttagggatagaaattggtcaaaataatgtatgatttgtgttaatctaaaatatattttattaacagatgaaccaacgtaatgtatactacagctggacggtgagttgtgttttgattttgcgcctattctttaattatacaaattaatttatgaattgaaaatggtaaatgatcgataccctttttttagattagcaacttttccttttgtcgcgaggaaatcggcgaagttttgaagagttcgactttcaggtttttcccttttaaacgttttttaaacatttggactgcatgttatttgaaaatttgattggcaaaaatgatttaaaattttcgattttttgggttcagtcgattcactcattgcccgtgggacttgaatttgggtttttgtcactccgctttagtgtcggccccaacgacatgttcaagtggcgcctgcgcatcaacccaaagggccgcgacgaggagtccaaggactatttgtccttgtatttgctgctggtgcaaagcaacaacacgcaggtgcacgccaaattcaaattcggcatactgaatgccaatggagatgaaggccgagtgctgggtgagtgacaatgaagggaattggatggaaatgaatggtaggagatggaaacttccatcgttacgagtctcccacatcgatacgactgaagcaccgtgactttacaaccctccagtaga

SEQ ID NO: 29244 - DNA, 1035 bp, Heterodera glycines
  misc_feature (1014)..(1014): n is a, c, g, or t
aaaattcaacatcgctggactggtcactgccattaagaacatgccaattgcgaagatatgcggcgacgttttcatgacattggcccaaagtcgcctatttgaggaatcggtaagtgttcagaatttcgggaaagcctagattttttctttgcttttttccgataaattgattattattcgtttttctcatgttcaaggatctcgtcgaccgttctttggcatacattgaccaaaatgcggacactttgctcaaatcggaggaatttctgcaaattgaccagcaaacgttgtgcgaaattttggggcgcagtcaattggcggtggaggaggaaattacgatttggcaaaacgtaaatattaggccatagaaatgccattgaataaatgtgtgccgttttgtttgataggccctccgctgggccgatgagaagtgtcgccaaaatggcaaggaatgttcgggaccgaatcggcgcgcaatgctcggcccggcactgtacaaaatttgtttcccgcgcatctctcaacaggacctttgtgaccagattggtagttgttgctcatttttcagaggggtcttttctccacgcccttccctcgacgaaattataaaaaaaaaatttaactagacagacgtcctcgtactgttttaagtggccgttcattcgcccttggatctgttcttcaccgcatcgttccccccccccccccccaaaaaaaaaaaaaatttgtttttaaacttctcggggggggggggtaacgtagtgcatttggggaggggggtaccccaagccaaaaccctgtggacgaacttgtccccaacccccgctcccgaaaatttttctttacagttttgtccggcgtattgacacatcaagagttgctcagcctctttctgtaccactcccgtccgaatttgcgcgccgttaccgaagcatttccactgaaattttccaccaatattcggacaaaattcgatggtatgaacgacttgaaaacagcatgcattttacgaantgttgatcaccatccatttta

SEQ ID NO: 29245 - DNA, 1571 bp, Heterodera glycines
  misc_feature (1516)..(1516): n is a, c, g, or t
gcggtacgccccgctcggcgaccacagcagcggcggcgattgtggcggtggcagcgcaacgcgcgcggcagcagcggcaaaaatggcggcggcggcggccagcgcattcccatcgcggcggcacagttgcacatcggcgggcgcggactgttccgaatggtgagagagcaattagcgggaattacagtaatggtttttttgacaattagtattagctacaagaataattacagtaatcgtgttgcatagttcgtcgagagttacggtcaagggtaattacagtaatcgttgcatagttcgtcgagagttacggtcaagggtaattacagtaatcgttgcatagttcgtcgagagttacggtcaagggtaattacagtaatcattggcatcgaggagttatggcaatggaagcaataaaaaacatttgtatttaggtggacgttttttgacaggaaaaattgcgttcaactaatcctttgaatttttggatcatcaggaaaactaaaataatttctcttaatttcagcattttcatcataatttagttaattattttgggaattttcacttagattttcttcaaaattttggaatttatgaaggtatttctaaattttaatttttttttaaatttatttttttaaattaaaattcgttgtattttctttcaggtgatgtttctgtcagcacaatcggttgctgaactgttctcaatcagagattggctcaggttcgaaagggcacggcattggtcacaattttcccgtcattttttcaaaattcaatttaattattttttcagatttttggtcgtccgccaacgcattccccatttgatcttgggcctccaatttgcgtgggctgtcgaggaaaaaaagaaaaagcaaaaatcatcggccaatgccatttcgccaaaaaagcgatgtcggacgatttacaacaaaattttgactgtttttggcatcaaaaaattgggcaaaaaatgaataattaattattactataattaaataaatgatgaaattagggtttttccattaacaaacaattacttttttttcaaaaccatgaaatttggaaaaatgccgtgaaaaacggtggttgaatgaatcaaatgcttcttctcaattaaaataataattattaaatttatttttatcttttttgctggatcttccgcgctctcttcggcttttttcccccaatttaaaattgcccttttgttggttaaattttaatttgttccattatttcacatcgatcaatgagtggattatttagttttaacaattttaagggcttttttggccttaaacgtcggattgtttagggtgttttagtggggtttttgggcaattctgttttgaattttcttaaattcaataccccacactttatcaagaactaattaatagggatggaattgtgtccgtccgaatgaaagaaattattaaaaaaggattaaaatcaacattttttaattaattcttcatttttgtttatttatttaaccganttaaatacaaaggtcagtgagcggtggcagcggtagaaaaaagagagagaaattg

SEQ ID NO: 29246 - DNA, 1616 bp, Heterodera glycines
tccggtctccaaaattatagaaattcaaaataatttggcattttgtaatagaaatacaatttttttttaatggccatcctgttcaggccgattgcctcgtctttcgccttgcattttggatcaccggtgccgtgttcaagctgttcccgtgcctgttgctcacgctgctcgtctcgctgcttatgcgcatcctgcgcgaggtgcacgacaaccgccagcgcctgttcctggcggggcgcggctgcgccaccactgcggccgccaccgctgcgctcactgtggacgcgccgtcttcctcgcagcaaaacattcagccggacagcgtctccaacgccaccggcaagttgccaaacgcatttgactgatcagaggtggaaatcgcctcttttggcgccggggagttcccgccatgaatttatgctaaaccaaatgttataaaatggcatttttcgaaagcatttgacaagctctagtagcctgctaaatttcaaaaaaaaacatttttgatttgacccgggtctcaaaattttccaattacgtctgagacaagtttaagaagcaatcacttttttattctttgttgatcaaatcaaactaacttggtaccattcaaatgctcttaacaagctcttctgagctaagcaaattcacaattattcgttaagaaataaaacagttaaaaataaaaatatatgaattttttatgggttccttaatcgctttgcaaaagcttacaaatatcttcgaaagatatagacagagctttcgaatgatatctatctagtttatttgatttggcgaaaaatgaaaaaaaaatggcttcttaaagttgtctcagaacgcagttggccagacgcaattgcctcctaccgggtgtgccaatgatcggataacataatgccaattcaattaaatccccgaactttcttccgttaaattgctgtagcttactttgccatcatctctgattctttatggtttacagcggtgtttttcttttccacacattgtgatcagcacgagcgtccgccgctgccgcctccgtatggcaccgtcgtggccaagcattcgcaacaacatcaaaggaaaagttcgtcgccgtcaccgtccgcgctgtcctccgccgcttcagtggcatcccatcagcaccaatgtcggcacaatctgatcaatagtgatcagcatagcccgatcagcagcagcagtcatcatggccatcatgaaaagatcaatccgattaatggttcggtcagtccaggcgatcagcatcatttggcgatcgcgacggctacgacgccaaattgttgtgtctgttgttgttactcttgcacaaatggacggcacatgctgaccgggacgacgacgacaacgatggcacgggcggcaagaacaaattcgccgatgacgacgagtccgagtgtcgccgagaacgcatcacaaatgggcggcggtggtgccaatggtgttggttgggcaacagcggtagcggcaaatgccaagtgggtgaagggaatgggtgtggcacggagttcgttttctccccccttctcactgttttgaaaaattttaaatcttatgtatttcatgaaaaaaattaaaaatttgcccgttttttt

SEQ ID NO: 29247 - DNA, 1594 bp, Heterodera glycines
  misc_feature (50)..(50): n is a, c, g, or t
  misc_feature (92)..(92): n is a, c, g, or t
  misc_feature (112)..(112): n is a, c, g, or t
  misc_feature (117)..(117): n is a, c, g, or t
  misc_feature (1460)..(1460): n is a, c, g, or t
  misc_feature (1550)..(1550): n is a, c, g, or t
aaaaaaggcatgcccagcggggtattagagtgtcttagactcattggganaatactgaggggggagacattgttcctgctttggtccacaanttaaagattccaaaggaatnttgtntgagtcataaacggaagcatcaccctacacttaggaattaccgagaaaaaacgtaaagagcggcaacctgttggaggagtaataagtaaatggaatcgaaatcaaaatatgacaggacggacttggtagaagtgccgctgttggaaccatttgtccctgaaatgggaaggaacaacaattaatttgcatctgaattttaagaattacgaccaaaaaaccttttatataaatttgtctttccatttcagccccatgataaaatattttcttgccaagacatgcgtcccaatcggtgcgcgtcgccgctctccgagttcagtcggctcatccgccgctgtccgctgttcggctcactaactcccccgtaaaaaagtgccgtgacggcggtaccaagcgcaacagcaaccagaccgagattctgaacgagtggagattttggatgttgaaaagtccgacaagaaatcaattttgcttgtgggtcgaacccgaaaattggccaaatcggatggtttgattttgctggtgtccttgtcttgggccaaaaacagaaagagacaggcaaacacgaacagattggctgccacggtgaaaccgtaccgataggaagtcattgactgaaaagggatggccaaaatgacattgctctcattaattgctttttcgctgaccattcgcgtatgctcggagttggacagctcgggaatcattgccaagtgcgaaatttggacagcggcccagccaaattggaaaagcataatgggcggaatgaaccaaagaaggcgcagaaaaggcagccaatgacagagcaaacaaccggagaaaatcagcgggaaggaaagagtgacacagacggtgccgaaaacgcaaaggttgaaataggaaatggaaaaatgccaagccaacctatgatatgccacgactttcgtcgcccaaaacggcgtaaaatgccgggcagaagggacaaatcgctgagcattccaaccaacggagtggacacggcgtcagtcacctggcggaaaatggcgaaatgtttttgtccgtctacatttgcagtttttccatggaatattcattgattgtcagtccgtgtttgcctgtccaatgaacatgagcagaccagcttgccaacttagcagcaagacgaccttctccaagaaaatcagcagataggtgaaccacatcgatgcgcacaaatcgttgtaaaaatgacccgtggaataggccaaaatgcgccgttttggaaggtcatccgatgaaacttgggccgaaacaacctgaacagatatttagaataattaaaacttatttcgggcttggtaaaaaaatggtaactgcaaccaganaatttcctcacattttgttcgtcctcattcccttcgatttcgacgccgtcaacgctttcgctctgaacgctcgcatccgcgtgaaggagncaatgctgctgacttccgcttatcggagaagaaagcatcgcatg

SEQ ID NO: 29248 - DNA, 1331 bp, Heterodera glycines
aagataaatagatgaaaatatttcaaattttatggtttaggtgacgaacaatgatacgacagttaattggaaagctataaaaatgctacgtacactattatacctaatggacaatacagaatatttgtagctgttgggccatacggtaattcgaaatgaaattttttatatataatatttactatttacttttccattttccattatgcaacccattttagcgctatgaagaatttggcgttttttttttgcatgattttaccaaaaagaaattttttgaaaaattcagaaaaatttctataactttttgaaatccagaaaaaccccctaagattggtggatctcttaaaatttgttgatgaaaattatgggaggcggtataactgaaatatggcataagcagtaactgaatattttgataatgttaaagaatgtgacttgaaaactttaagttttttttaagatggcccaaaacaatttggattttcaactgacaaatatggcaaaattaatcgaaattttttgaaaaacattgtaaatgcagatgctacccgagaatggtttttaagcaatgaaacagcagagaaaatcaccattctagtggagaagggctctgataaacgtattattagcgaatatacgaattatgccaaattaaacaaagcaatggatgaaaatgacggcaaacttttcaactccaactacatcgatttcgaagcccttacggtattatacttagaaaatattagagaaatattaacaaaaaataaattaaaaggaattgtttgagaggaatttttatcgataaaatgagaacttacaggttgcgccaccagatttacctgatttaatgggtgatagtgaattgagcaattataatgcgaaaaaagatgttaaattcatccaaaaagaaaaagtttgtttaatattgcgttaatagaaccatgcataaaaatcaaaataagatcccttatgaaaataaatattttttaaaactttgattaatataaatcaattgacgaatttgctggattattttaattgccatatgccagttttaattaaaataacataggcattcaatttcttattcagttggttcgcgatgcggaacattcaaaaaaatctactaaacctatcagaaaaatacaaaaaattggacgagaatggaaaaagaaaactaagctggtacaaaaaattgaaacggaaattgaaagaagaaaaaaccgcgaaaaaaagtattaaaatattagcaaacaaatgaatcaaaagggacaaactgaacaattgcactttccagcctcctgaaaaataccaaattattatcgtaa

SEQ ID NO: 29249 - DNA, 926 bp, Heterodera glycines
ttttgctctccataattgttagagtaccccaaacggacacttgaaaaaatagatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgatttttttgtttacggggcagtccccccgaaccgatgcgcccagatttatgg

SEQ ID NO: 29250 - DNA, 1030 bp, Heterodera glycines
gtctccccataaatctgggcgcatcggtctgggggactgctccgaaacaaaaaaatcgatttttcaagtgtccgtttgggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaac

SEQ ID NO: 29251 - DNA, 1728 bp, Heterodera glycines
tttaaaattttattcatctccctttttgatagaaacgttcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgctgcctcgtggtgggccttcgccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccggaggaatcggtctcccccataaatctgggcgcatcggttcgggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaattacaggctatagggaagctattcctgaaggattcggtctccccataaatctgggcgcatcggttcggggggactgccccgaaaacaaaaataaatcgattttttcaagtgtccgtttggggtactcaaccaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaccatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtgctcaaacatttatggggagcaaaaa

SEQ ID NO: 29252 - DNA, 1307 bp, Heterodera glycines
tgacaaataatctttgttttctcctttagttgatcctttcccgtcacattttgtccgagcatatgattcatctgatacttctttcctcaaagcaaaagaaaatgcccttgtgaaaatcgttgccttcagcttctctgatagacctgatatactcgaagctgaggttcaaatattattactattttgacagtgctgatcaaatgactcccaattctttttttaggacaatgaagggaaaaaaggcctcattttcgatagtcacattgacataacgccttatgtgtttttcttggagtctgctttaaaaagtaaccaaaccctgtacatggtggaacgaatgagtgactggccgaagttaataagtgggttaattagttaatcatgtgacactttcgaacaaattgttttttctttcaataatttacataattgatatcataaattcgtattttttagaagaagtcagtgctgtccctgaacttttgagaatgtacatcaatcatgcaaacaaattggaaaattattcattggacaaggatctggtcgcacaattagcaaagtttgaggaatcacagaagaaaacaaaagcgcaccaccaccatcatcatccaaattctcaacaacaacagaaaaacagcaaggaacttcttactgctaaaagtgacaaaaaagaagacgaaaacacaaacaatgaaatgagaacggacgaaggcttggaaagaaagcaggcagtttcatcaccatcgcatgacacatcacaacaacccgaaccaattcaacgggatgaaaattcaccacccaaaactcagccggaacaaatactacaacatcaaaatccagcaagccaaaaccaacagcaaactccaccccaagtccaacagaatccatcgactgatgatcaaaaagaaacggattcaattcaacaaaccccaagccaaagccaaccaaatcaacagcaaactccgccccaagtccaaccgaatcaacagcaaactccaccccaagtccaaccgaatcaacagcaaactccaccccaagtccaaccgaatcaacagcaaactccaccccaagtccaaccgaatcaacagcaaactccaccccaagtccaaccgaatccatcgactgataatcaaaaacaatcggattcaattcatcttcaaactgaaggtcttccaaagtcagaagtaaatattcctcatcagcatttgaatcagaatctaccacaacagaatcagatacatcagtccgactcacaacaaattcttcgggaaatggtcccttcaaatgcacatcaaaatcagcagcaa

SEQ ID NO: 29253 - DNA, 1382 bp, Heterodera glycines
cttgcaaaaccatttttcatgcaaaaatattttccaattggcgcttattagcaccgtctttttgtttcagtttcttcccaattttggactttggtaagccttcggcatcgtccaacgccattgtcaaagtgggcaatgacggcaagcacaaattttacgtcaacaaagaagtatgctttttttgtgggaaatggaggggaatgaatttaaatttaaacaacaacaaaaaaaaatttccacttaaatcccgttttaaatgctcttttttgcagttgctctcaatgttttccgagggcttcgagcgcatgttcaacagtgagggctttcgcgagcagcgcacccaggaagtggagctgaagaccgtgtcgccggacgtgttccgcgagtttttgtacatcatttacccgagtcacaagcgtccgcatggtatttttcttagaaaaatcatttatacagtttatccaagataattggaagagggtgcaccacccaacgaactttttttaagtcttcattcatttcaatttattttcggggttttagaggagggagacccaatcctgatttaaatatttttcaatttctaaagtagcttcagtatattgcaatttatttatttcccttttcttctagtgccaaatacgcgcggactgctcgaactcgcccgcatgtatttcattccgacagtgactgcgatgtgcgagcagtgtttgctgcaagcgaccgagactgacatggtggtgggcgagcggctcaaactggcggacgaatacggactgttgcgtttgaaggtacaacacgttcctacggaccttttattcaatacaaaactgccataatgtcaatagattttcaagtaagaaaaattattttggaatagaaagtccacctaatcttgttgttagttatcttcgcgtttttaaatttaaattttttgtctttatttcctcattgcccctttctcgtgacaggccaacatcatgcagaagacggatccgaacgcgttgcgcgacatccaaggactgcgggaggacacgctgagtatgttggtgcgcaagctgcagaaccgggacaaactgcagcgagagaaggagaagcgtatgcaacagacgcgaaaggacgacggcggagaggcgatggaagtggacggcaaacaggtgggggagagggagagcaaagtggaccccaatcttcagtggctaatgatgggatttttttcaaaaaatgagacatgaaccaataaatagagagtgcagagaaaaaacatctctctttttggcgtactatttctttatctgtgttaatagagaaaaactgaatttacttcatgctgtttaaaattttttcgacttgttaaatctgcttcaaattttgcataccga

SEQ ID NO: 29254 - DNA, 1244 bp, Heterodera glycines
tttgtttggtttcttttttaagcaattttccgtcatcttctaccaactgttaggcgtacagcaacggcggcacttgccttcgatgcagctgttcacgggctctctaaccctatttttattttttttctatctcttctctgaaaggagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaccctatttttattttttttctatctcttctctgaaaggagttataacaatttttcacaacagttttgcatttaacagacacattctaaaatttctaattagtatagtagtccaagcctattattattttttttgacttgtctctgaatggggttatcccagttttagtatcctttttgaaaaacaaaaattttaatgacttatagaataatcgccacaatcattggcatctatatagttttcgatagccataagtattttccattatccttcaaaattagaaaaaaattcttaaaatttaaaaaaagttatgacctgagaagctcaaaaacacaagtttttttgaacatttttagtcataactttcttgatttttaacgaaactttttggaattttgtaggttaatagaaagcacttagtgctatttaatgatatcaagaattaaaaatttagatgcttttgaacaaagttatatcaaaaaatattttcatttgatggttttttgactaacgcccattatgatggtttttgactaacgtcatagcaccaataatcctattgctaatagttaacactaattccattcttcgaatccctgaatcccttcattccaattcggtattgaagggcatgaatgtggctgatcaaatcctcgtcatttttatcttctttggcatcgtaggcaacaactagtcttcttattgcttcatcgttttcaacatatttttttggacgtggacgagatcatcaagcccgcgt

SEQ ID NO: 29255 - DNA, 2052 bp, Heterodera glycines
  misc_feature (672)..(672): n is a, c, g, or t
  misc_feature (766)..(766): n is a, c, g, or t
tcgaaaataatgtcagattcggttatttggcccttaaactctataatacatatttgtatcggtgtttaaaaaaatttcatttttcgaaaatggggggggcaaaccagactattaccggatcccgtcctgcgcgcgccggtctcttcgttttcgggtcactggtcacaaatctagcatccatttcgaacagttccagccccggacccattcgaacaaaaagtccaagattcaaaattttcgaatttcacttctatattataaaaactgtttgatgatcttttattgaagtatgatgactttttgttcgtccgtgtacttaaacaaaattaaatttgtgctgccgtcgaaaaattttaccgaaaatgcctttaagctccctcttctttatcattaattaaaacaagagaaattactcattcctttttcatacattcaattttagtgtaatccgaaaaatggtgcgctttatgtccacttgtgttcgttgtctccggacaccgaatatgcgttttacgtctctgctcatggggcaagtggccaagaattgcgccactctcgccgagtgtgtgtgcctacggatatcgcttaaatggctcgctcattggccgaaataacagcgggatttatttattgacataatacatacgcatttttgttctcacgatttcaaangcgggaatttttattcatttttaaccgatctcgccttaaagttgtttgttgacaccgtttcgaacactgaataaaagtggaaattacgtacganatgtttttgatttgtttatgaaaagaggaaatttcagtctaatttaaaatatatttttattggattgacaaaatagttcgggcttggggggtttgtcgttacgaaaattttattttgttatgcactttggatccccaaatttttcagcttttttcactttccaagcaaaaaacatacgaacatgtatgtttcgggctcgctgatcactaattcagcatccgttatgcccaatttcgaacccttgacccgaattcgaacaacaggtcgaaaattcacttcgccaaaaaagggtggtgggaagggaaccaaaaagggtggagtgggaagggaaccaaaaagggtggagggcggcgaggcgttgtgtgatgggccttcactctttttgaagtgctgttaaaatccctaatcaaacctgaaaaccgaaaatgaaagagcttcaaagataaatttgcatcaaaaattggcattggaaacgatgaatgatattttcgactttttgttccaattctggtcttaagttccagtctctccgatcaaacgcaaaaaaatcaaaatttctctgatcaattttcaattatctaattcgctctttcccgctatttgctatttccaaatatgcataattattacctaattatttcgatatttaaaatttgggttcaatggtggtttgacagtgccacggttcgcaccggaagaatggagtgtgcatcaacggacgttggatggaggagacagaaccaacaattacgcagaagcattccatagaaaacttcaacaggcatttgattgtacccatcctagtgtcttccacttcatcaacacaattcgatgtgagcaaaagtcaattgatgctgacatctcacgatgcgtcgctggtgaactccctcctctaaagaagcccaaatatcgtgccgccgatgcgagaattcttcgacttttgcagggatacaataccatcaacaataacccggctaaccaaaatgaccacaattaccatgccaatgtcaatgttaatcccgataacatcaaccatttgctcgttggtgtttctcgaaattatgaaatgcgcccgtaatttttcaatgctttgttattttttttttgttgttaacacattgataaatattttttgataataaattaaacatttttagaaaaaaatcagaatataacccatgtggcacaaaaacagcttgccagactaaaacgaccccctgactaaaacgtcccctcagactaaaccggccagactaaaacggccagactaaactgacccggtccgc

SEQ ID NO: 29256 - DNA, 905 bp, Heterodera glycines
attttattcgttttcctcctttttaataatttgtcatttcccaatgatttcctttgtttttcagatttatttaatttacagcgcaaattgtgcagcattaattagtaattgaattttctcacaatggccctgccaatggtcggcggcgtttatttgggccatttgtggcgcggcacaaccggcaaattgcgcgccttggcccgtccgctgctcaaagatggcatcggcgaccgaatggacaagggcaatctgtgggtggtgcccggcttcacattgctcgtctttgccattctgtggacaacaaaactgtgagtgaattatccccactttttactcattaatcccccccccctttcccattttccccttatttttttgtaatttttccatttcgtccaactctcttttccatccgttgtcgtccaaacttataatttgttattgtacaaattcaattgttcatttttcagttccaaaattgccctggaggagtccacttgccgcggggcatccatttatgactttgctggcacacagctggacgaagatgcgaagaggcattgccagaccgcgaaaaggtattacgttgggccggacgaggcgttttcgttggaccacaattggcgcaaacagcgggaggtcaaaaacccggaggtgggcacaaaatgcaataatattaatattattatttatttatttttatgtaaatattaattaataaaataaaattgataattttccaattcttttaattgatcgatgaaagtgtttatttaattatttattatttttttatttattgatttgtttgtttgttcagtggatcctttggttttgggctccaattgtgttcgtcatgtacgtgttaaccccgttcatgtggactcttctgcttgaaaaccaag

SEQ ID NO: 29257 - DNA, 923 bp, Heterodera glycines
ccaatcagtaaacacagttggagatctgctggatgggatggttgtgctcgcccgatcggaacacggtgatcactccgtgttctccgtaacagccaacctcaaacaaatctcattgtcagttaaggagcgtatacgaagcactcacagcttgaacatgcaccgctcgttgtgtctgtggcgattgcagcggaaatgcctgttcttgccgtggaaggtcgtcttgtgcaccgtcacccgttgcgcctgtcgcaacgtttccaactcttccgcggtcgtcaccgtctgcatcggaatccaattggtgcgcgggttgcctgagggagagaaaacgagaacagcgattagcaaatgtctcaatgttccacaggagggactaagaaggcacaggggtctcagtgattctcaccaggcaatcgacctgttgctctccccgacggcaccaccgcgtggttgtgatccccgcttttgtacacgcgaaacgtcccgtcctccgattggatggccaacattttgaaagggcacttctcctggtgccggtgtcgattgcagcggtagtgtttgatcaacttcaatggacaataagggttggccttcaatcgcaccaattgaatgatcagtcagccacctgcttcccatctgtgccgttgctaatcgttttgtgtacgatcgcctgacttcgcactttcagttcctccaataagtctttgctggcgattgtggccataaattccatacttgcggcggcggcagctacattttggctgattagctcaacaaccgtacaaatgcggttcactactgtactctcacttcccgtcatactgtggcgcttttcccgtaatgtcttctttcctatcgtttctctgtcgggagcactctctccctcttctctctctctctatacctacaatgctaatccctct

SEQ ID NO: 29258 - DNA, 1614 bp, Heterodera glycines
ccttttggtggaaaacatttgattcttgctggcgattttcgtcaaactttgcctattaaaaaattttgcggaagaatgtgagattagcatttgcaacaacttttataaaaagtcaaggagcaacatataaaaaaattggcattgattggacaagaccaagtttttcccatggacaaacttatgtagctttgtcaagaacgggttcatggaaacaaattaaaattaaactttcggaagagaatactgagaaaaaaatagaaaattttcttataatataaaataagtaataaatacatttcataattcttatttaccttattattgaactttgatcaaaaatagttaaaagggcactcattgttattcgttttgcataaataaacaaagaaataaaaatttagaacctagcctttttttgagaattttttaaaataaagcataaattaagcatttcaaaaccaatttggattttttttttaatggagaataatcgtctgcaaaaaacaattaacaaattaacaccaattaagcgtctaaaaatcggcgaaacaatgatctaagtttaatttaaaaatacatttaattatattttataattattttaacaatatatttaaaataaatgtttaataattgttgaaataaatttaatatttagtgatatcaaattgacaattgtaattgctgatgcggttagaaatgtcaatggaaaatcagtttggacattggttggtagcgatggttacgattttatcaacatcacaatgtggggcagcaattacgaaaaaatggcacgagaattcggacaagaatttaaagttaaatttataatttaattaaaaattatatttattgttaagcaaaaaacatatgtatttaatacttggggagtacaaaaagttattccgaatttcaattatggtaatgttgattatgaattaattgcaaaggaaggatcgacaattacactgatcactgcggaacaatatcaaattttatcgataaaaacaaccaattatttcacatttttgcgtgagaaatttgcactcgataatgatggtttttttccaacgccaatcaaaaaaattcgcgcaggcgaacagtttgtgtaagttaataaatagggattttagctaaaacaaaaaaataaaatttaagtgaaattgaatgcgaattattcgaattaaagcccgtgagaactgtaatggcaaaaggaaacgaagcacgtgtcattgatgcaatgattaatgaaggaaataacaaaactcaattaactgcttggaatattcttgcggattttcttgaatatattttacaagacaaaaaggtgtattaaaatatatatttttttaaatattttttaaaattaagggatatgttttaaaacttcaaggcttacttacgaagaaaggctttccggttcagaatatttcttttgtttttatcaacacttctcgaattggatttgctgaaaaacagcgaccacagaaaattccattgaaattggcagaattaactgaaggactttgtgaatgtaattttaaaaagttttgaaagtcataattttcggattaggtaacattcgtctcagtgtttcaaaggaaacagtgtctt

SEQ ID NO: 29259 - DNA, 1004 bp, Heterodera glycines
aaaaaatcgtttgttttgtttttcggggcagtcccccgcgacccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttt

SEQ ID NO: 29260 - DNA, 1128 bp, Heterodera glycines
tcacgccggaattcgttgaagggacaaatcagacagtaaaggagcgcttgtacagatatattccaaagagagacactcttcgatgggtcgacgtaatagacaaaataataacaaacattaacaacagtgtgaatagaacattgggagccaaaccgtcttcaattaattttgaaaatgcccgtgcgctctggaaaaaattatataaggctagggaatttaaaattttaaaaaataaaaaatttaaaatcggtgatatcgttcgtattaccaaggaaaagggaaaattttcaaagggatacctcccaaactttaccgaagaattgtttaaaatcgttgttgccaattcgacgacacccgattcatacaggatcgaagatttggaaggaaatttaataaaaattttataaccaggaattagtgaaaacagatggatgatttttacattgtactaccttcgaacacaccggggcaggagaacactacgtcaaaattcacagtacgcctccccgagactttggaattgggcacaaattggtcagtagctctctcatcaattatttacccctactcattcaccgcactcggtataaatggtcaagagtttattaaagtatgggaaaatgacaccagtgtccccattcaagtttatttaccggacatgaattttaaaaccgccgggggcctgggaaataaaattaacgaggcattcacacatcattacaaaatcaaaaaacaacgtggaaagagagaagccaaggctgaagataccaaagattcaaaaattgatgtcgcaaagagggccgcagaacgcgccgggagagacgtagaaagacattttaatcagatcaacaatatatcgaattccatccaaacccaactaaacacactacgagaaacaaatcctcaaattttagaagagcctgatataaaaatttggtttgacaaaatggttgagatgggaaccgaaattcaaacaacccgaaatgaacttaaatcttttcaagaagaagtagataaagataaagccaaaaacataacattggagcatgtggaaaagaatgacttgaaaaaagcaaagaaatcagccgacgtcgcaaagggaatcgccagacaggcaaagaccaaata

SEQ ID NO: 29261 - DNA, 1307 bp, Heterodera glycines
  misc_feature (650)..(650): n is a, c, g, or t
caataataatcaaagttaaagatttaatcagtaaaaaaagtttttaaaaagtcatccataggcttattgttaaaaaaatactcgacctaagacgataatattaaaattatgtagatttaattgctaaaccatttgatccttaaatatcaaatgcacgaaaaaagtcccctaaaaatagctataataaataaactgcagaaaatctgagactaacattaaatatacaacaaaaattgattacaatttgaatatgaaaatatcgtttattattgacaaattaaaatcttaaaaaatggatattaatttgagcttatatatatatatatatatatatatatttctacaaattttagtttgcaatatcaatattgaaataagacaagaagataatcaatccttcagcttaagtaaaaatcttttaataaaaagaaaatataaacaaaaaaattcacttggatttgtaaaataaaaagaaaattatttattcagcaaaactgaatgcagcaacccagagtataacgcacacctgattgtttatataccatcatggatttaaattaaatgcattcatttcttgcgatattggatatcttggatctccattctgttctctttcacaattttatgcatttttacatttttcgaatcanattttcaggttctctaccatccccagggtatgattgtcaacgggctgttcccttcatcaatttcgacaatcgaaagacgtttccaattttcaacttccactcttggccgtataatgcaagtgcgaaattgaatttttatgaatttttttgaaaaaaaaaattttttcttcagttttacgactttggttacgtgctgttctgcatcccggtctcatattttggtggtcgacattcaaagtcaacgggtctcggggcgggtttgcttctgatgtcggtcagtgctaaaaactcatgacaacaatttttgcattttctatagaatagaaaaatccaacaattttatttatacatgggacgggggcgtgaagactgaagggggggggggggggtagaaaaatttgcaatttttttttcttcaaatttttttaacaataaatcttttttcttgaaaaattgataagtttgaaatttaaaaaaaataaacggtgaaattttacccggcgaaattttggggtgcaccccgaataagctacctaatttcttcccttttcacagcttggctccctggtgttcactttgccgcattttttggccgaaccgtacacaacttcgtaccagattgaaaatactggactttcccgttgcctgaacggtttg

SEQ ID NO: 29262 - DNA, 1500 bp, Heterodera glycines
  misc_feature (1352)..(1352): n is a, c, g, or t
  misc_feature (1405)..(1405): n is a, c, g, or t
cgttcccaaaaagctcagtgtgggcgttccacaaaaacattcagtgtgggcgttccacaaaaaaagctcagtgtgggcgttccacaaaaagctcagtgtgggcgttccacaaaaagctcagtgtgggcgttccacaaaaaaagctcagtgtgggcgttccacaaaaagctcagtgtgggcgttccacaaaaagctcagtgtgggcgttccacaaaaagctcagtgtgggcgttccacaaaaagctcagtgtgggcgttccacaaaaagctcagtgtgggcgttccacaaaaagctcagtgtgggcgttccacaaaaaagctcagtgtgggcgttccacaaaaaaagctcagtgtgggcgttccacaaaaagctcagtgattgataaaataaaataataaggttaaataataattttgaactgtaaatgtaattttgatttaattttattgcatgcttttaaattataatttttattacaaaactaaaaaaggaaaaacaaattaattgaagacaattgataaggtgctaattttctttgcatttcatgtaaagaatttataattttattacaaaactaaaaaaaggaaaaattcacaaattaattgaagacaattgataaggtgctaattttctttgcatttcatgtaaagaatttataattttattacaaaactaaaaaaaggaaaaattcacaaattaattgaagacaattgataaggtgctaattttctttgcatttcatgtaaagaatttataattttattatttaagtcggattctcgtgcttttcccaaacctttgtgccaaataatcttgccttctgactcacatttataattttctcttctttgttctctatcaacctgttctgtttccagtttctctaatttttcgggcttacagttagcattatggtttgactgcaacataacaagttgtattccctgtcgcagaacagctgatgcgacgatcgatttgacattaacatttttttcttgttcgcgaaaataacgacattttgaacaagaaatatatatgtcttcattattctcatttgtttgaacatattttctccaagcagattcatttccaattataaaaacattttttcttaaagtttttgaaaagcacttttcaaatctaagttcatgttttggcatttcatggcttgaagcattcgagtttgaagcatcatttttatttgtatgcgcagaaacaatagttagtcttgacacgtagcgtcttaaggtacaaaaacttaagtcaataccttttagttgcatttgttcatggagtttttttaatgttttaatttctttattttgatagcttttgacaagttctatagctntgtgattttttataaattctttcaaaccggaattggtagaggtcgaatactcnaatcgaaataacaaaaaaataaaaataaaaagtcttattcatttttctaattataattttatttaaccatataaaatttattgtattaattttac

SEQ ID NO: 29263 - DNA, 993 bp, Heterodera glycines
aaagttttttcttcataacttttttatattgctaaaaaaattttgtgctttttgtaagactaattgagcatgtgaagcgctttctaatgataccaagacaattttgatttagttgaaaataaaaaagttatagccctaaaagttgggctggcgccaaaacgacccattcattctccctttttgactgttcgcttttcatttgtgctgccaccgctgctgctgcgaccgggtccaaagtacataaaagggcagacactgaccggcaatgggtcatttgcttttcctccgttcgtttttcctccatgcctttgcactccctttgcccctttcccctctctctctctcctccttgcatttgcttattccatcttttttaaaaacattgattattttgagacggcactttcattttaatcagcaggacactgcacgaatggacggagaaaaacatcaataaatcactctggtacgaaatagtgcaggacagtgattgcctcaggcaatttgaatggctttgcgctccttttttgcctgaggcaatctctatcatgtactatttcgcaccagagtatattttcttttcgtccatttttgtgcagctctcctgatttgaatgtgtatttgtttatttgttttactgtactcatttattttctttttagagttcagtaaaccctcttaactatccaacatttggtcaccatccgtgcgtcctgtaaagcattgacacaacatgaatttcccggcaaatattttggtgggtttattggtttttttctttccatcatatttctgctaacaatttattggatattctgtggcttttttgcaaaaataattgtaaatttatttttgttttttttaatttatgtaaatccattttttattcaaattgtttttaattaaaacaaaattattttttttttaaatgccatttgtttttatgttttttggctccgaatatttgtcttcttattgtacttttttgatttt

SEQ ID NO: 29264 - DNA, 1928 bp, Heterodera glycines
gttcgtaattgtgattgaaaccaacgacacatttcagacgaaaaagccaaatatttggggggggggcgctcaacactgcccctcaaatttgtcgtctgagaagtgtcccaaaaatccaccaaattattttgatctaaaaaaagttttatttaatattaaaaacatatttctaggtgtaaatgagttcgctcatgaacccgatctcagattttcatttctatatttttatctatgatttttcatccatttattcgggtcttttgaatttaactctaattagagcaaaataaatgttagattcggaatttacgtacccaaaaaccaatagaaagacttttttttttgccatttttcaattttttttgcattttcctgaaatgtttaattcttatgaaaaatgacgacaaacgacaatttacggtagattttgtcaattgtgattgacgacaattcacacgacggagacaaacggaaaaacggcttattcaaacgacaaaatttttgtcgtaacgacaaattcggagacaactgccaaatttgtcgtttgtcgtccgttttgtcgtttgtaattgtgattggccctggggcccaaacgtgtggggcccaatcgtggggacccaactgaacgtagggaagcggaagtttaggtaccgggaagtttgggcacaaattaaggatttaaaaaataaaaatatctttaattgtctataaattgcaaacatctaattaaaagcatattaaataatcaagttaggaatcgaaaattttttaacggatatccactcaattttaaccatgcttattttgtttgctaaattcattacaattcattctttatcaatgtcatacatatgtattgtgtatcattacaaggctcggtctattcaaagacttaaaattttatgagtttaaacagaattagacgggactcttgatatttcgggcccaactaagccgggtattcaggactaagtccaaacagaaagaaatacgcgtttaactctacgtttaaacagctgtaagaattgacgaaataataagattgccatgctttaattttcaagaaaatataaatttttaagcacgataattgttaaatttactaaaatttaatgatttacactggtggaaaaaagtctttgaacaaacatgtaattttttataatggttcataaaccgataattaatgaagcattgtgggcaattgtttatgtatttattagtccaatatatcggcttcatatcagcgccaaaaaattccgaatcgaaaataaaatgaaaatgatatggtcaacgaagtgagagagatggtcaaaataatggcggaaaaaagtctttgaacaaacttagaaaacaatttcaaaagactcttaaaaatctgaaataattcatgcagatttatcttttgatgctgaacaaaaaagtattttcaccaacttgatcagatcactccttcatagtgattggaacaccctaaaatacactgaaaatctgggaaattattcgaaaattcctagggggttgggaaaatttttctagtgaaaatgagtaagctcactgcaaagagcacaaaattctcttccgaatttccctttgaatggtgccttcttctacgacttgtacataaaaagttatatttggttgaaaaattgacaccataaaattaatcaatttttgatcattttcccttgaaatactgtagaaatcaatccaaatttgcatatttgtcttgtttttttgaaatccctccctctgtgcctaaacttcctggtgcacaaacttcatgtcgccctgacgtggaccgggtcaattccactgtgcagagaaaagcctagtactatcacgtcgttactctttttatttgtaatttctctcactttggcgtacaagcgccattttttaatagaaaaaacagcatttacttacta

SEQ ID NO: 29265 - DNA, 1285 bp, Heterodera glycines
tcggagtcaagtctcggtctcgagtctcgggaatttttcggtctcgagcatcactaatggcggggtgggacccaagactcatttggggggggggcgggggccgagaattggccggaaatggcacaaaaaatgttagggattcattgatggcccagtaatagtcacaggattttggctgggtgccaaaaaattttcgcccgctctatttttgaaaaaaaattctgtaccaaattttaaatgaaaattcaaaaaaaatttttttgttttttcccattaaaaatgttgagtattttgtggttttgggagattgattaccttttgaagacgcggaaattatcatttttcacaatttcccttttattgcttaattgatatttactataattgttaaaatggattcaattaatgttttgttttttttttgactgaatttttctcctatttttccattgaatttttttccaaatttcaattgttttttctatttcaccaagttaacatttttaattattataattttaacaagggttgaattactgtcctttttttacattggattttctctcattttcccggttctgaattttttccaattttaaaattttccaatttttcaggcactctctcctcacttcggcggacggggggcggccaaccacgtccacggcatggcaatgggccgaagaaacattacgccaaagagatggacaagtaaaatataattttttatttaaaaaaattattttttccaagatatttcataaatttatgcaataaaaattcaaattttctcccctttggccgacttttttttggcccaaatgccaaaaatgcaaaattttggcccatcttaactctcttaaaaagcaccaaaaatgccctcgggagatcatttactccctcccccaatttcctgctgcacccggggccaccaaatatttatttgctggccgcttcaatttcaccgcaaattttgtgccgtcagtggcggcggcggcggtggcggcaattttttcattgccccaggggaaatgacaaatttgaaattgttttttctgttttatcagattttgtggggggaattttttaaatttcgtcattttatgaataattttagggttgaaaaaaaatacttttaattaaattattaaattatttattatattaaattttaatttaaataatttatttttaattaaattttaaagcaaaaaggaaaataatttatttttaaaatattattttctattatttttgaaaaatcattattttaagaataaattta

SEQ ID NO: 29266 - DNA, 1317 bp, Heterodera glycines
gttatggagcctggactcaaatgtcccgctgaggccaaaatttttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttaggcctaactcgaaaatttttgaaaattttcgaaattttaaaatttggaaaaatcgagctttcaaagctctacaataagtccgctggagccccctcgctcagatcaaaccctgacgcggtattcacctgggactgaagtggacaaagttggtactgaatttctcctattttctgcagcccttcctactataggtagaggcctggaattttttttgacttttagacaacacttcaacttaggttcctaccagcggaaagtttttgattcgggatttagaaaaaaagttatgggccgtcaaacgcacgaaaaaatgagaaatcagtccctggtactcagttgacccttggaccggaaaacctatatttttcccggatgcgcctcaaaaagttgtaagacccttccactactttcagggcgctcccggccttcggccgggagattttgtttttgcagacgaaactccttgtcaatataacatatatagtaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaaaaaaatggctaatatgtaaaattggcgtcttgaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatccttacataatactcataaaaaatacaaataattcaacccaccaatggtatgaccacattctgaaaaaaatcccagaaata

SEQ ID NO: 29267 - DNA, 1548 bp, Heterodera glycines
atttctttcatgtcactgcgcagtacaagtgcataaaattcgttgaaaaattgctaataatacatttttctgagtggcacacgagtgcattattgattgaaggcgctagtgtcgtggagcacatgtccgcagtgcaaattttgcgtcagagacgtcacggtacaaaatatcgcaacatcggctcaaagcgacgaagatcattatatgaacccactaaaatattcgtaacttgtatccttacataatttccggcttaggtattaattattcgctaaaagccagcgctctttccactacggcggccagtaggtgcgcgagaattagaaagaagtgcgcgcgtgatttgagcgggtctcattatacgtaatatatttcttcagcatcggcaggtgtatatctggtccacccccgtaaaacacgctttgtgttccccatcgcgttggacgtcgttgacatggcgaattagtccatcgtctggggcgagcaatggaaacacactttttgtggcaagacccccccacccccaaggcccttccgcactcgaaatttttaaggaattacatatttttgctgaaaattttaggttttccttgcttgtatccccctgacctagcctcacccaaattttccaaaaaatttcgctaaatttttcaaaaaatctacaattttttgaagaaaatctgctaaaaatgactaaaaatcgcaaaatttgtcattttttggacaaaattcaaccccctgttcaccaaaaaattttttcgtaaaaacagcaacaaaaaaaaaagtcgtcgcccgggtggagggtaccctccccaacccgaaatcctgggaccgtataaatgcttttggtaatcaaaaacggtgaatttcgcagtcacctcacggcttgtcttagccacggctcattatccctaactttacagccattgaccatcgttttgtcccgttccgttgaccgactgtcgccggcactgtccgtcatgccaatggcaaacagttcgaccagaccagtctcagcaacaggtgttttttttgccggtttcaaaatttgtaatgtgttttttacgaaaaattacattttctagtaattttttgaatttaggccaaaagtctcactcaatatatttttttaaatgccgctttcatgaaagttttaccattttgaaaaaaaaagattgttggtagagagaaagagagagagaggggagggggggtataaattggactgaaataaccaaaaaactatcacaatcaacatttctgctcttaattaggtaattaataaatttcttataaaaatttaattttatttttaaaattaaataggctgctaaattaaattgatttttttaataaaaaacataatgattaatttcttttttaataaaaaattaaattacgtaataattaaattaattttttttaaataaaaaatcggtaaacatttttaactgtgttcttttctacttggaaataggtgactaaattagattcttaaaaggtaaaatttattttttaaataaaaattggtaaaaattgactctagag

SEQ ID NO: 29268 - DNA, 1289 bp, Heterodera glycines
  misc_feature (139)..(139): n is a, c, g, or t
  misc_feature (1226)..(1226): n is a, c, g, or t
gtataaccgttttagaaatagcgtagaaaacagcttcgatatcagaaaccaagtcaagtccagaaagggatattttaaaacgatttcgttttgttttggcattatgataccgaataactttcggaaattatggaaacanaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccatacgttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattattttgaagtcttgaatttatttgacaaatccaagacttaaaactgggagaagcaaggggctgtggctgggggcctaaaatttgggccacattggagaattaattctgatttctgaaaaagtcccagaaataactattttttctttccatacgttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattntttgactgcaaattttttttccttttttgaattgggttcaaaaaaattttaagaagaattttt

SEQ ID NO: 29269 - DNA, 895 bp, Heterodera glycines
  misc_feature (556)..(556): n is a, c, g, or t
tagcagtggaaaataaaacttatttaaaaatttaaaaatcaaattttatttttttaaagcgaaaatttttcagaaaataattttttcttcaatgaaaaaaccataaattttgaaaaggattaattttaaaatcattatatttttttgaatgattttcatcaaataatattaattatttgttcaaatattaataattaaatttatttagtgctcaaaaaaaaatttcaaaaaagactaattagttaaataattttgttatttatttgttaattagtgaatctgtttaattcaaccaaatttaaatatagctttggccgcgtcctgctttttcatctcgggcattccccgccccattgaatcggcccataattttgtacatacagactatcatcctattagaacggtcgcaactaattgagcccattatttcttatcaaagagaagacaaacacacgaaaaaataataatttgtcaggcttatcatcataataatctgttaattgacccttaattattattttgttatgttgccattattttttgccatcaaaattgngacatgaaaaaagtttgctgatgaggtaaaaaagtgtgcgataaatttgggcgaggggtgactgaccgtggatggtacggacgagtggctagacataaattgctaattagtaaaaaaaattaacgaaaaaatgaaataggtaataatatttgacaataatcttctatgaaaaaaatgtatattttacaatgtttgaagaagacaatagacacaattaaattcagtttatagaaattctaatgtcttttgtgtttacgtaattagttcatcatccccaattgtttcttccatattaaaatgctctttcgatcaattttcaatgtcattgcaatttttttt

SEQ ID NO: 29270 - DNA, 1138 bp, Heterodera glycines
acgccgaaaaagtctgttgatatttaataaatttacttcagatggtcaagcaaaataattttttatttttgtggcaccattttaacgattctccaaaaataatggcaacacaatatttggccagaacgccgaaaaagtctgttgatatttaataaatttacttcagatggtcaaataaattaattttttatttttctggcactattttaacgatactccaaaaataatggcaacacaatatttggccagaacgccgaaaaagtctgttgatatttaataaatttactttagatgctcaaataaattaattttttatttttgtggcactatttttacgattctccaaaaataatggcaacacaaaatttggccagaacgccgaaaaagtctgttgatatttaataaatttacttcagatggtcaaataaattaattttttatttttctggcactattttaacgattctccaaaaataatggcaacacaaaatttggccagaacgccgaaaaagtctgttgatatttaataaatttacttcagatggtcaaataaattaattttttatttttctggaactattttaacgatactccaaaaataatggcaacacaaaatttggccagaacgccgaaaaagtctattgatatttaataaatttacttcagatggtcaaataaagtaattttttatttttgtggcaccacttttacgattctccaaaaataatggcaatacgaaatttggccagaacgccgaaaaagcctgttgatatttaataaatttacttcaaatggccaaataaattaattttttatttttgtgacactattttaacgattctccaaaaataagggcaacacaaaatttgacccaaaaccccaaaaaaccgggtgaaatttaataaatttccttccaaggggcaaataaattaattttttatttttgtgacaccattttaacaattctccaaaaataatggaaacacaaaatttggccaaacacccaaaaaagcctgtggatatttaataaatttacttcaaagggccaaataaattaattttttatttttgtgacaccattttaacaattctccaaaaataatggaaacccaaaattttggccagaaacgccaaaaaa

SEQ ID NO: 29271 - DNA, 1334 bp, Heterodera glycines
tcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaatacagaattactggagttagcatcatagcagtgcttttcc

SEQ ID NO: 29272 - DNA, 890 bp, Heterodera glycines
caacctcatcagctgcaggtcaaccagttggccatttgcattttctttacgaattcgaagctcagatagcaaatagcatttggagagatcaatgcaattttggctggagtgaagtttgaagtggtagggggtgtcggtcagagggttacttgggagcagttcaaacactttggaggatgagacgctgacgttggttggcgggatgcggaaaaagtccaaggcgttgttgatggagttaacactgtcattgtaaattttatggaatgccatttagtaaagaccaaatgcgtcagatcgaacacgttttctcgctagtttgctttaattgaattttttcaaaatttccaaaatcccgcacgggatcccgcaaattttaaatgcgggattaatcccgcgggatcccgtaccgcaaaaaattttggattccgaacccgcagcgggatccgcaaatttgaaatttccggtctttaatcactactgactaaactaaaaactcattttttcaagttttggttttttatcacccatccggcacgagaagcggtcattatcggtgttgctccttcgctgtcccgagattggcgttggcgccactctccacgagaagggtgactgaaaatgggaaaaactgctgatgtagaaattattgcggatgattgcttcaccgattcctgtgagtcagcggcgtcaaggaggagtcggttcccaagtcaacgtcgtcaccgtgagcgacaacaaatgcacatctccaaatggagcaactgacagcaaaccacaagggcgtaacggctgcaaattgcgtgaaaatgcgtgaattaggaaaccgcagaatcggtccgcaaacgcattcttaccaaggttgacttggcgatagtgttctgatgcgggtc

SEQ ID NO: 29273 - DNA, 1282 bp, Heterodera glycines
cctcgctcaatgtgccaatcaatgccttcatcgcttggtgtccttttcataaatcgggtcaaacagtggctccacctgaaaagtgcaaccaaattattgtcaggatcttcggtcgaaatccatttctaagggttttcagggtggagaatccgattctgatatccagatcgaccaaattccgaaccccggacccgatttcgaacaaaaaaacgaaacttcaaattttcgagtttcgcatttttggttcaaacccggcatgaatgtaagtaagcaaactaaaagccatcaatgcttcaataaaaactttaaactatttattagaccaaaatgcgaaaattttgaattttcgactttttgtaagaaaccgggtcaggggttcagaatttggtagatagattttttgggcaaaatttgatttaatattttttgtcaaacttttgccgtttgaactcacttcttcgcgctccaattcaccgtccgatttcagtgcatccgcttcatattccttaattgttttacaatatcatttgaagcattgtcacggcactttttttttgaatttacaactttttcatttttgccagcgcccattggcaacaacattgacgtttttgggtgtaaaaccgttccaaatcaaattctagatggtgagccaccttttttgaagaatttttgttcaaaaagtcatgaaaatatgttatgggtggtttcgggttgtcgctgtcacaaatctgaaattcattttgatcaatttcgaatacgaacccgaaaatgtcagattcgtgatcagtttagtgacccagaaaaccgccccataaacatgttttcacgattagggatcaaatttcaatttttttttttgtgaattttaccgaccttccatgggatggtttgcacatgaattttgtagttggttttgctaccgccaggcatggacagaaggaaattcattggaaaagataggtaaataaatttgatttcaaatgactaaatttcggattttggggatgacatattagcaaaaattaagaaaattgaacaaaaaatggtggtactatgtactatccggcaatggcgtgtcccgacatttgctcttttgtccaaaatcggattcaaaactaagttttttcaatacctgatcgcctaaacaactttatataagtggtagaaagtgattgtgtctgataatttgatcgtcatgaatttagaaaaaaacatcattaaatcaaacaactggattaatggttcaaataactaaaaaacttttgcttccttaattttt

SEQ ID NO: 29274 - DNA, 1078 bp, Heterodera glycines
gcaaagaagatatatttttaattttgacatgagcatttggaaattttataagctttttttatgttttatgactctctttctaatttattttaaaatgttttttaatgtaaaatttttctgtttttgttcaatatttattctatatattttccttcatttttttttgcgtatcttccctttttttctttccaattccaattcataagacgttttcaatttaatgatctacatcattaaattatttatttatttttattttttttgctttttgtttattattatagctgcatttattttttattaaataaatattatttttttaaaagcttgcataaaaaatagcattcttggtattcaaattatacattttattgatatatgatactttaatattgtacttaatttttgactatgttttgtaaaattataaattttatttttttataatgcctgcggccactcggctctttcactcctaaaagcattctcttatttccaagaaaaactcctttgtcaaagatctatttatttgtaatttttattaaaatatttttacataaaataagaatgccttagctggaagacatttttttattttattatttaccattgtaattttgtccattcttagacaaactaaaattttaaaatatattcaattattagcataaaaacttcgataattttaattgttcttttttaagtttataaattacaagcaaataaatatttgattttatatataaataaaaattgtttttattaatcctttgatgtaattagattctttgttttgtttaaataaatgttcatttatatggaatgaattaaaaaattgttgaaagcaatatttattaccgaaaagtctcttataattttaataattttgtacaaaaaatcattcaactaattatgttgtttcaattgccaaagcttttcttcgataaagatattttttttaactttttttttgttttttttaaatacagctaagaatttatttttataataaatcaaaatatttatatgagttttaatagattcatttttatcttttattatttgataatgacaacta

SEQ ID NO: 29275 - DNA, 398 bp, Heterodera glycines
atttcgcctctagcacaattttgagcagtactttctcgacgccccgccccctcgcgcacccccgagacttgcgcagcaaaactgtgatggtaagaggaagttcatgccgttgaagaggaggtccgcggcgatggccagagggggtccgcggcgacggagagagggggtccgcggaagagagggggcccgatccgacggagagagggggtccacggcgatggtgagagggggtccgcggcaatggaaagagaggtccgcggaagaaagggggtccgcgccgacggacggcagaatggtggggggaggggtccgcggtaatggaaagagaggtccgcggaagatagggggcccgatccgacggagagagggggtccgcggcgatggtgagagggggtccg

SEQ ID NO: 29276 - DNA, 1092 bp, Heterodera glycines
  misc_feature (52)..(52): n is a, c, g, or t
  misc_feature (84)..(84): n is a, c, g, or t
agtatagagtcgatagacaaatcatttttagaaaacctctttataggatacntaataatttgtgaatagagaaaagttttcttncctgtcatatccaatggttgagatctctagtatagagtccgatagacaaaatcattttttagaaaaccttctttatagggatacctaattaatttgtggaatagagaaaagttttcttccttgtcatatctaatggtttgatatctctagtatagagtccgatagacaaaatcatttttttagaaaaccttctttatagggatacctaattaatttgtggaatagagaaaagttttcttccttgtcatatccaatggtttgagatctctagtatagagtccgatagacaaaatcattttttagaaaaccttctttatagggatacctaattaatttgtggaatagagaaaagatttcttccttgtcatatccaatggtttgagatctctagtatagagtccgatagacaaaatcattttttagaaaaccttctttatagggatacctaattaatttgtggaatagagaaaagttttcttccttgtcatatctaatggtttgatatctctagtatagagtccgatagacaaaatcattttttagaaaaccttctttatagggatacctaattaatttgtggaatagagaaaagttttcttccttgtcatatccaatggtttgagatctctagtatagagtccgatagacaaaatcattttttagaaaaccttctttatagggatacctaattaatttgtggaatagagaaaagttttcttccttcaatggtttgagatctctagtatagagtccgatagacaaaatcattttttagaaaacctttatagggatacctaattaatttgtggaatagagaaaagttttcttccttgtcatatccaatggtttgagatctctagtatagagtccgatagacaaaatcattttttagaaaaccttctttatagggatacctaattaatttgtggaatagagaaaagttttcttccttgtcatatctaatggtttgatatctctagtatagagtccgatagacaaaatcatttt

SEQ ID NO: 29277 - DNA, 1869 bp, Heterodera glycines
  misc_feature (279)..(279): n is a, c, g, or t
  misc_feature (287)..(287): n is a, c, g, or t
  misc_feature (319)..(319): n is a, c, g, or t
ttttttaggagttcaaaaagttaaatcgtcaaaattcgcacgtttttggaaaatttacacaattaatgaagcagaagcaaaagcgaagaaagaagcggaaaaactggccaaaaatcaagaagtaatagcgagaaaaggaggcgatagctccaatttgggctaggacgacaatgaaaaagatgatcatcattgtttgagacgcattgattgtattgtattgttgaaaaaataagtcgaaggatgccaaaatgtattcgcttcgtttgtcggcgatggtgntccttccnaattggttttggtcagtcgctttccccccccncccccctcccatcctacagcgtatttggcgtctccccctgcccttcccccgcccccatattccctccggcgactttgctgccctttagtcccttcggtgtctcattcaaaatgcgacgaccttcgtcctcctcccccttccccaactgtcgctgcttcctaattttgttttccgtctgctgctgttgctctttgttctgtcccttctccaatggcgagtacgtgttgagaatgtctctctctctgcttttgttttaactttcccttcctttttaaaaatgtttactgcacatactaccgggattccaacgagatcacttgcgggtgaatatcaataataattataataataatgactctgatttggatagcttttggatgagttttccgcttttaagtacggtgacttgtgagacgcattcgccgttcactcccgacaattccgagcttgacggtctcgacacgaaattgccgaggcaataattccaagtgtggttttttgaccaattttcttttcaggggatggtaccgtattgggacagtaagcattcaattgattttcaatttaattttatgtgtttcctactgtagctgtcaatcagacacgacagggcgtggttcaacctgtacaggcaatttgaaattcattagaattaattgtgagttttgtcatcgctttaggcgacgggccactggactcggctattgggacttttacacacagtaacccacctccacatttacagtatgtaacaaaatactcaatttaggattccggagcggaattgcatcgggtgggtcggcttaactggtcctctgtacttttccgcatagtcaattcggtttgcacgcgggtgaaaacattgccggatctgtggcagtgaaagacaaacgatgttttggtaagggattcaaatgtattgcatctggcgatacgttttttgcctttggcactgcctaaacactgatcgctatttcagatcgcctcgtcgtgcaaattgagcgcaaatcgaccaccgaaaaggcaaccgaccgcagcagcaaaagggaccaaacaagaatgtttaccatttcagttcgatgttctccaatgccgaaagtgtgtgttcaactcgtgttggcttggctcgcgcactttgcacgaccaacgcacttatctgaccaacctccgatcgtattgaccaaagaatatacggataacaaacaatgataacaactaaattattgacaattaaaatgtccaaaatgcattttgatcggatgaaaaaagactttccgcccgccgtttccctcctttttcccattccgtcctttgcttttttctttttcgtctgttgccggtgccattttccaatgcacaatttccgattgcatccgggtaataatcgccgttctccgcctccgctccctcctcctctccgtccattggttcttcgtcgaatttggccactttccttccgtttgatgttgctaaaactgtgttcgctctttccaaaattgcctcgaattggcgtcggccgtttgccaacccaacgatgtctcttcgtcctg

SEQ ID NO: 29278 - DNA, 957 bp, Heterodera glycines
  misc_feature (948)..(948): n is a, c, g, or t
atttcaatcactggggactcaacccaccagcatttcaatctcacccgactcaacccaccagcatttcaatcactagggactcaacccaccagcatttcaatcactgggactcaattctcctgcatttcaatcactggggactcaacccaacagcatttcaatcactgaggactcaacccaccagcatttcaatcactggcactcaattctcctgcatttcaatcactgggactcaattctcctgcatttcaatcactgggactcaattctcctgcatttcaatcactgggactcaacccaccagcattccaatcactgggactcaacccaccagcatttcaatcactgggactaaacccgccagcatttcaatcactgggactcaattctcctgcatttcaatcactgggactcaacccaacagcatttcaatcactgggactcaacccaccagcatttcaatcactgggactcaacccaacagcatttcaatcactgggactcaattctcctgcatttcaatcactgggactcaacccaccagcatttcaatcactgggactcaattctcctgcatttcaatcactgggactcaacccaacagcatttcaatcactgggactcaacccaccagcatttcaatcactggcactcaattctcctgcatttcaatcactgggactcaattctcctgcatttcaatcactgggactcaattctcctgcatttcaatcactgggactcaacccaccagcatttcaatcactgggactcaacccaccagcatttcaatcactgggactcaattctcctgcatttcaatcactgtgactcaacccaacagcatttcaatcactgtgactcaacccaccagcatttcaatcactggcactcaactctcctgcatttcaatcactgggactcacccaccagcattccaatcactgngactcaacc

SEQ ID NO: 29279 - DNA, 1327 bp, Heterodera glycines
  misc_feature (27)..(27): n is a, c, g, or t
cgacaatttggcccggatttgtcccgnatcaccgactttcaaatttctacattcatttcccgacaaatttggcccgggttttgtccccgaatcacagactttctaaatttctagagctatccccgattttggtccccgaatcacagactttcaaatttctacattcatttcccgacaaatttggcccgggttttgtccccgaatcacagactttctaaatttctagagctatccccgattttggtccccgaatcacagactttcaaatttctacattcatttcccgacaaatttgcccggattttgtccccgaatcacagactttctaaatttctatagccatccccgatttttgtccccgatcaccaattttttaatttatacagccattccccgacaaaattaggtccgttatttttgtctagatccccgacatttttttttatccccgatgctcggggaggggcccaagtttaatttgtttgcaattaataactctaattggatcgtttgctgatcactctgtcattgatcattattgatcaggaattggtagaagaccacacttttcaaatgattgaattattgttttttcaactaccaaatcagccaaacaacagtaatttctgatcgctactgatcggaaaaaaaataaaattatttttaaatcagttataaatttttgacgacaaaataccttcgtcgtttgaagcttgctatgccaatttcgttgttgcgagcacaaattgacggtgcacaacccataaaaatgggcaaaatttaattggaaatttgggtaaattgttttttgaagcgaatgattggcactgatcagtccgagttgtttattcagtgccactgtagttggaaatgatcaaaatgggttggccatgtgaaaaaacttagattttgaattaaatgatggcctgatgctgttttttctaaattttatcgtaaatcggaaaaaaactgaaaaattgaacggtttagaattggggattttttatatttaaaaaccgaaattttaatgggaggcttagaattaaggatttttttatatttaaaaaatgacatttaacgggagataaagctaaaacttacaaaaaaattttataaatacctagcttatgcctaggacggctttggctgaacttatggtcgatttgaaaaccccaggtcccttaaaaaaattattttcacgacagaaaaattcaaaaaaaatttttaataaaattttatgagttttgacgggagttctgctgtcgctatagtcatattttgccgtcaattttcttaattttttatcgcgcgaaagcttttcattctt

SEQ ID NO: 29280 - DNA, 1930 bp, Heterodera glycines
aaaaaattgaaaatttaaattaaaaagaaaaattcaaattaccgccataattaaatcagcagtgagtaaactgacaaaatttgtgcccgaaatgacaacaaccaggaaaaaagtgtgcccaatttggtggaccaattcacaaagacaaatcaatgccatcagaaaattggcggagccgcggagggaactgaaaatttaaaatggaaaaatgaaatttaaatgggaaaatttaaaattaaattcagaaatgccatggcatttgcctggatttggcagtgaccaccaaaactgtgccgttcaacacaatgccaaccaacgcaaccaaatacagcgcaacggccggcacaatcaaatcgacggatggacccacagaacggtaggccaaataaagctgaaaaagtaaatttttattttcaaatacctaattataataaatttatgggatttttttattcacttaaatatttggttaatattttcattattattttttgttgttttaccgcattgtctgagctggtgttaattgaggacattttatggtcaaattttgtggcaatttgttaaattttagtgtgtttaaactgaagataattattccttttattacatttttgtccaattttctgtacttaaatttgccaattcgaatttgtcgtataaaacatcccacgtttaatgtgcggcgacataattttcccagcaaattcaaaactttcatttcataaattgtcttcaataaaaaataaaaaattccatgtacctaatgtcaatatcattccaaaattggcatcctatcgtactcattttactatactttttttaaatttcccatatttttttcaaggcttattttaggagcatgacttttggcgtaatattctcacgccgatgttttatttttgtcaatgcttctcattaatgtggcatgggaccggaaatttttgggcaaaacagggcccgggaatttcacaggacccgtgaatttccgggaccagaaagtccgtgaccgggacctcgattttcaaccggtatagccaaccgagaaatttctaagaaaaataaaataaaaaaaggaacagaaatcccagacgaggaaatttcggaaaaatttcatttcatggtgtataaaattgggataatttgttttattttcctgaaatccatttaattttagtgagatctgctaaaaaaaattcaaacgacttttttggggcatgctttttcaaaaaaagacctttgctgacagagttgtgccgaagcgccgccggagaaaacttgaaaattttggcatgctctggtaatagaatttgtatgaaaaatatcattattttgggtttttttttagtttaaacttgaaattttttaactaaaatgataattttgtgtgtttataagctaaaaaagtgaatgaaaaaaagcctgaaacgaagacagagaaaaagtgcaagtaatttagttcaattatgagaaataacttaaatacattttaaggccgagattttatagggaattttgtgctcctttaaatggacttaatcataatttatattaataatgctaagtatttttaatttaattattaataagcagaattttcaacattttatttagttattaaagaaataaacaaagaaaaacaaagtataaaaccataaaaaaatttggcacagataaatttattgaacatttttttaatttgttaaatttgaaaaaaaaaatctttgctcaatttattgtttggttatgtttttcggtacgtcgaaaccattttaaatgtccaaattacatattaatggacatttaaactgtcattaaaaacgaattacaatttttaggtctcaaaagaaaattcaatttaattgggaaacaatttaagccaaaacatgaagtaagagggcaatttctggatgtgaacaattgaagaaaa

SEQ ID NO: 29281 - DNA, 802 bp, Heterodera glycines
tcaatgatttatccagccttctctgatcagtgatttatccagccttctctgatcagtgatttactcaaccttctctgatcagtgatttatccagccttctctgatcagtgatttatccagccttctctgatcaatgatttatccagccttctctgatcagtgatttatccaaccttctctgatcagtgatttatccagctttaactgatcagtgatttatccagccttctctgatcagtgatttatccagctttaactgatcagtgatttatccagccttctctgatcagtggtttatctaaccttctctgatcagtgattatccagccttctctgatcagtgatttatccagctttaactgatcagtgatttatccagccttctctgatcagtggtttatccagccttctctgatcagtgatttatccagctttaactgatcagtgatttatccagccttctctgatcagtggtttatccagccttctcttatcagtgatttatccagccttctctgatcagtggtttatccagccttctctgatcagtgatttatccaaccttctctgatcactgatttatccagcctagttttttctaagtcgtttgcctgggtttaattcccctagcaattaattacttttcgcgatttaaaattacatgctgatcctcaaaccgtaaagagatccagctgatttgctctggctaatcattatgcggaaaaacagtttgatcactgatcagtgtgcattttaggccaatcaaattcagtcactgccaagccaattcttcataaattgt

SEQ ID NO: 29282 - DNA, 1728 bp, Heterodera glycines
caaaaaatgacaaaatttcactcttatgagcaaattttcaggcaaataagtatttttagtgtgcgccggcgccgataggcgtcgccaggaaatttttcaaaatttcagttccatttattaacaaattatcccaaaagtccttggaaatccctaaacaatggctaccataaccaggcagcacctcaaagaagccctgcggcgtttcaactcacgacaaattgtcatccgctccagcgcaaaattgtcccgtatcccccgtcagtgtccccccgcccgtccgaggggcatatgcgaatgaataaatgaatgaatccccctacaaacaattcaaaatgctccaaatttggtgatggatgggacgttgatgagggggggggggggagcaacccacaaaatctttgagtggatgaaacaaaacccacccaaatttagtcggggggagggggggggggggggcgggggtccttgaattggggatgatgggacgggagtggcggggcgggcggtacagttttctcgagattaatggactgttcccacgagagattggatgacgatgatgatgaagatggatggcatttttgagaggcattttcgccggggtcttccaagtgccaagataatgagagggcgcggggcgggggagagaaccgagaattaatgaaatttggaggccgcggaaaattggggtttgcaaatttggattcaaaaactgagactttttactgacgaaatatgtgacttccaggacccgtggtcagagatttttttaaaatttgattttagcccaatatttattgggtgactttttttatatatattttttcaatttattgaaatctgccatgaatttggtcaaaaattttggaaacataagttaaaaatgacaaaaaaaaattcccgtgtttcgttttcctttttaaatttcatgggggggggggggatattccttttcctgagtgtgaaaaaagccggataatgaaggctcctgcctaaaatttatatcattatgttcatcctgaaattaggtagttaattccctcggttcattaaaagcatttaaattgagcaaacgaaaaacctttcttttcttttttttttttgctataaaattaggtaattcatttacaatttgaataaatcaaattggcacatataaccgaaaatcgcacaaaaaaataaaaaataaatgcgcgcaaaacattcatggtttatgtataaagttgttgtatgttctctcgcatttgctcatcgtcagcatcaaaataaaatcaaataaaataaacgcaattgaaacattccgcaaaaagttggcaaaaaaaaaaaatggacgggcaaaacgacacacaaaaaataggtgaattgaatgaacatgaacaagtaaatgagtgatgaatgaatttggtaatggatggataaaaatcgtcgaaacaaaacacaataataatcaccaaagaccaacgggcggatgatttgaataatctccaaccttacatccaacatcaaagggaaaagccgcactccatttttaatgccaattttgcttatttttgaattacatacctaatctatggcatcactatcaatatatccgagattcggagacacggatatagaaagtatgcccaacaatttgggaggcaaaaattggggcattgtttgtgtttgcaacaaaatgccaatggcgaaaagagcaaggatcaaaaacaaagtgccgccataaatttt

SEQ ID NO: 29283 - DNA, 1366 bp, Heterodera glycines
  misc_feature (83)..(84): n is a, c, g, or t
ttttattaatgctaataagattatcttctttttctatatttaattaaaatgatataccattgttttgggggaaacaaaattgnnttgatttatttgtcttttgaaaaaatgttttaaaagaaaagtatgttatggccaatgtcgcctcggtggctcagtcggtagagcgtcagtctcataatctgaaggtcgtgagttcgagcctcacccggggcaatgttttttttaaatgttttttgcgttaagaaataaatttattactaatttttaatgcttttttcaaatagctaaaaaaagctgaaatatcttaatttattatggatttgatttttttatatttgttctttttttctattgatgtatatttcttcttttaattgatattagaatacaggacgtctgaaacacaccttatgcttatattctgcaaattgctgagaataaaaattataacatttttatgaaatttttaactgcctaagattttaggcttttatttttagtgaaaatttaattccccataatttttcgctaattgattagaagcacaccaaatttcacagaggcatactaaaaggaagagaatccacctaatttaaaatatttcatcccatttcctgaaaataatcaacgcttattggttttaaaatttttttttaaattctgaatgaaaaaattaatgctaaagtggtaaatgtgaatcaatatgttcctcaaggccaggctttttcaaaatgccgagctctaattgatatgtatggtcgaagtttgatcggattaaatgaataaatacaaattaatcatttacttccaaaatattgcttacaattaaggcaaaggaaatatataaatttccctatttttacttttttttgtatatttattattttaaaattattattcatctattttatttcgctttcattttttttttatttctttttaaaattatgattagattaatcataaaattatttgtaaatttttcaattaaatataaaaaaataaaagaaaagccagcttagttattcctatattttcatgtctactattaaattcaagtaaaaaagaaatcttaaaacatgtatgataacgcctcggtggctcagtcggtagagcgtcagtctcataatctgaaggtcgtgagttcgagcctcacccggggcaaagccttttttctccttttacttttttggtgcttaaatttcctgctttggaaataatactttttcactgaatttataaaaaaaaaaatatatttttacaatttttgaatttaacaatcataattactaaaatttaatttgaagaaattgttaaaaataattttgtaaatattttatttatttaattaatacctatttcc

SEQ ID NO: 29284 - DNA, 1786 bp, Heterodera glycines
atttaatccacaaaatttttaaaatcatgaaagtaaacacttatattagcaccaggtttttagtttaattgcataaaatacttcttaattggtgctaaaaaataaattaattggtcatattagttttattttgtaatattttggttaacaaaggaaatgaaaaatagttacaaaagaagttgcttctacttttttttagcgtaatgttgcgctcgttaacagcatacaacacactgccattgttcttcattctaattttactcaaacggcaatttttttaaatttaatttttattttaaacatttaaaaaaattttttcaggattataacaatatcaccagtgataaatataaacaaatttgggaattggttgatgatccaattgtgatttggcatgatggggatgagcatttcaacagcatttgtttggtaaaaagatcaaaatgccaaatgcaaccaaaaaacacttatttttgaatttatttaatctttttctttcttacttgaatatgataaatttttaattatgaaatatagccttaaataaacaattaaaatacactaaaaaaatatattttcaaaaaaagcaaaaataaattaaaattgtttatgaaaaaaaatcaacaattcatttttcaaatttttggctttctgagcattataaatatgtatttatttttgttttaacatttttaaaacgcatatttcagaagaagaagatgaagagctcgttttggaattttaaatgaaacaatttgacaaatgatttctcacatttattttacatatgtaaatttatttatttatattatgtatttattgcaaagagtataacaaattttaaaaattccatgagaattttttgatctttcaaccatggttaagcccgacccatcggggaagaaattctcgtggagcgcgggggaagccaggtcggggattgactgggatggagcagaaaacccgattgggcaatgcgtagaagaaaattagatcacaaaaatgccaatttttcgtttttgggatccgttgaattttttaatttttttcaaataaaatcgagaatttattatcaaaaaaaaattaattgtttttttgccaggaaaacttgaaaaattctcattttcaaaaaaaaattgaggtgttttagaaaaaaaaaattgattaaaaagtatgttgaaatttctctattttttattttacacagtgtaaagcgcagatttgttaaacagagtttgtaccaaaaatggtcaaattttaaaaataatattgggttaaatttttctaaattttatagggagtgatattgtaataaaaaagatggtaaactcattaagaagaaagttatttttatttaattttttttgacaacttaataatgataaaatttggacttcaacaaaaaatctttaaaataatgcattaacacacaccgctatgagaacaaaatgaagctgagtaaagaagaaaatgaattcaagaaacaatcaactaggccaaaggagagataaataattatattttataataaatattaaattacttttttaaatttttcttatccccaatttgggtcaatatttacccagacccccccccccattcttaccagtatacttcaagaccggaggttagacccggacctgccagatcgggtacagggcattggattctcaaaaattcgggtccaggtccggagcttggaaatgtttgacttaacaatatcaaaaaaaaaaaatgcagctatggtcttgcgtctcaactcgagaacagtcttaggtttagg

SEQ ID NO: 29285 - DNA, 1773 bp, Heterodera glycines
  misc_feature (46)..(46): n is a, c, g, or t
  misc_feature (49)..(49): n is a, c, g, or t
  misc_feature (51)..(51): n is a, c, g, or t
  misc_feature (1737)..(1737): n is a, c, g, or t
  misc_feature (1751)..(1751): n is a, c, g, or t
ggggaattttgagaattttgcccatatttttgcagattaaacgttnaancncaggcttcttatgaaaattttcaaaatcagcatttttgtggcgcacttttttaaatttagtcatttttggacaaattttcttaacaaatcgtattaaaaattgcaaatttttcccggcggcacctatcgacaccgccggttgcctgccccccccccctgttcaccaaaattctttataaatattaaagagcatttttctgttaataaaaacggtttattgcttttttggaaaaaaataaataaaatcaaaaaaaaaaaccgaaaaaccgtaaatttttcttcggttttttcggttttttaaccgaaaccgaccttcttgtccggtctctagttttaagcgatcattaaaagtaaccgttatcagaaaaaaaagttttcaacggctctccattcgaatccttattttttaaaaaagcataaatttctaaaaaaaataataatgccatagttggacagagaatatttgttattcagtatttacaaatatacattaataacatatatggtatgtacaaatcacaacaaaattcacacaaaatcgtatggcattttaacttcgttttgctcatttttctcctccgtccgtccgttcctttctttttccgtcgccgtccgtcacttacagcagcagcagttattgcatttgaccaaacaaatcacgaggcgaacaaccaggcaaaaggcgagcagcaacaccaggacaaggaaccacgatttcattctgaggcaacaatctgaaaaatggagaggggatggcattcgaaaatggcacttttcatttcaaaatggcacttttccattcaaaatggcacttttcatttcaaaatggcacttttccattcaaaatggcacttttcatttcaaaatggcacttttccattcgaaaatggcacatttccatttacgatccaatttttttgaaaaaaacgaatcctgaaaaattcaaattttcttctttttgtccgagttcgggtagttgaaatgggcctaaataaatgccatattcatgttcaacggcacaaagaagccgaaaagtgccacaaaacatttgtcatgtgccaatttcgtgtgccgacctgcgccattgtcgccacagcactcgaaataatgcgcaacggatggttcaccgcctgaaaaagcaaaagaaaatgcagaatttggtagatgaatttgtgtgggaatctcacagattttggcgacatcggaggagacacaaggagaagaaggaggcgccaaataaaaagacgaacatccgggcaaaaatgggacgaataggaaaaggacgacgaacagcgaaaaaggcatcggagaggacggcattttggaagaggtcacggcaaacaaattaatttcctggaaatttggggaatttatttgaaaatggcaatgtttaattttctcagaacagcaattctttttcaacttcttaattgatcctcttttcgtgtttttttgatctccaattctcctccctccctaattttgtttttctcatttaccgatcactaaaattgacattttgtgaagattcttatcgcctttccgtccgtcaatttatcttaattattattcattttagaaacttttctccgtttctaatttaatttttgaatggcagctgcctcatcgtccgcatacccaatgcttttcttcacgcaaaaattggccggagacggtgagttatgngcacataatacaanaaatatttgtagccagttgatt

SEQ ID NO: 29286 - DNA, 1921 bp, Heterodera glycines
  misc_feature (1902)..(1902): n is a, c, g, or t
cagcgcaatggattgcgtcaaaatgggcaaattccgtccacctaaatgccattcccttgcggcgcataaatttggcatggccccccgggggaaggcggacgagtcgctccaccgcaaaagcgccttcctcaatcgcgggcaccgggcggtccatgaacagcgccaagactttcttggcacgtgccatcgtttccggcctcgagacgaccttttttaaacaataattatttatcaaccattttgattaattgatacccaattaagtaatcatttccaagctcaaaaaatgaagaattccgctaaaaaactatttataattttaaaaataatttaaaaataaacgtttaaaaaatgttttcttttcaaattttttaaattattttcttttaaaattaaatctcttaagtgaatttgtgtctctattaccatctgcttcatatgtcggcataatgtgcataaatcatatcataattatatcataaatatatggcattttgaattgaaaaagaccaaaattgataggccatgcgcatttatatgaatattatatcatatgtggccataatatgtaagatatgatattatgagatgtcatatctcaattaaacgtacaatatgacgtgtcttatctgctactgggatataatccgaattgaaatcatttcaaagccatttcgagtgacatttattaaaattatttttttaaaaatattattattaaatcattaaatctttgcctatttgtgtccttatttttaaatattaaatcccgaattctgtctgtttgttgtttgttttttacttggcttatcgttttgagcagacgcacgtcgtcaacattgaatttgttaattactggtgcgatgttcaatttgagcagcaaatgcgcagtgtgtgactaaatttgtgttcgcttgtgcaaatggcacccttttttgacttgttccgcatagaccggcatcacaatgagcggaacgccggcacagattccctcgcgaacgctaattaaacgacaattaatacaataatttgagtaaattactgtcgaagaaattcggcaccttttgttgcccccgtgggtgacaaaggcacgaacattgggatgggcgaggatttcaagttgaggggcccatttgagcacaagcacagagttggtcaggctgaaggcacgggattggatttcgcaacaaatgaggaaagagaaagacgggaattcgggaatggcatttttaatcgaataattttcaaattggtccgctgatcaactttcgataagtattggtttttccatctaaaccctttaagccgttctcccttttttaagctcactcttccggcagtttgcattcgttgcacacaaaaatgaaacgatattggggcagttttcgaaaaacggtgacaaaatcgtccaaaaatttccgtggcgcaaatttccaatcgatgtgagaaccgaaggcgatataaattgtgcttaaaaataaagcataaatgaattaattggatattatttttaatatcttttgagctcgggtcctccaaaaactgtttgattttggcggaaagggcggaagaatcttttggcgttttgcaatgggcgccgactccgaaaatgtcagcagcagctgaaccaacgaatacaatttaattttgtatttgtacaaaaagcataagcgtaattaatgctttgaaaattaatcaaattattgttcttttatgatttaaattaattttgctaattgattatcctctaataattatcattcatttcaattttcctcctcctcacttgtcaccggcaacccgagcctgtcgatgctgtcgtgcaagaacaattggctacgcgaataaaattcggtgaagctgaaattcggcactccgaatttggcaatgtttggcatcaanaaagtgaagggctgaaagt

SEQ ID NO: 29287 - DNA, 1298 bp, Heterodera glycines
tgtgggggagacggcggagacggttcagaaacaacagcagcagcagaagaaaaaagatggaaattctgcgaacaaattgaacaatgtctatttccagaaacaacagcagcagcagaagaaaaaagatggaaattctgcgaacaaattgaacaatgtccatttcaattttagtgtctgcaagagcattgggtgagcaacaaaaccatagaaaatgaacctgacgggggggggggggggaggttattggggaaaatcataaaatgcagtgatcaagatgcgaattttttttttacgaaattgagaaaaaaaattttaccaacagattcgtcaattaagaaatttcattgcctttttaggcctctttctccaccggcggaagcagcaaaagaagcgagtcaaagcagcgaaaagggcgtctaattatgtggaaatgaatttttggcatttggaaaatgtgagaattgaccgatcatttttgagttaggtattatgctaaattgtgttgattatatatataattctgtattgcgttttttgcgtccgaatgttttttttgttaaaaaaattatttgcttatcaatttatagaaattgcttatgaaaaggggacggattcgtacttaaatggcaagcacgtatttggaaaagcggtcctaatgtgggaaaatgtgaaatccgtaccctcacacctgcttaccctaaaagcatgaaaaagtgagccgtaaaaaatgcacatgcagcgaaatgaggaaaatgatcagcggaaacaaaaaattagaaaaaaaatctattccagtgaaaaatacgggaacaggacaaaatttcgtcgttgaacatcttggcgtcactgttaatgaatttggtacttgtacagtttggaacacatttaataataaaaacaagtttccagaggtattcgggatcgcaaatgacgaatatggcatcctttcgaccaatttcgaaccccggacccgaattcgaacaagtcgagcatgcatttttcaccaaagttcaacccttgaccatttagggtgacagcttttcctttttttttttgaaaataatttaaattgcgttgagttttcaaccctctttctccaccgggagcagcaggaaaagaagcgagtcaaagcagcgaaaatgacgtctaattatgtggaaatgaatttttttgcaattgagacaaatgtgagaattgaccgatcatttttgagttaggtatatgctgaattatgttgatctatatagtagagtgcagcggaaccgggaatttttggcaaaaccgggacttgccgggac

SEQ ID NO: 29288 - DNA, 1149 bp, Heterodera glycines
  misc_feature (40)..(40): n is a, c, g, or t
ctcgataagggaaaaagagaggcggtaccccccccccccncccaagacccccgcagtaccccagagagaaaaaggaatgccaaatttaaattaacgccaaattatcataacgaaagcaacatattaattttaaattccaacgccaaattacaaagaaacattttctctgtcttcaatttcttcatttcctttcttttcaattccaaaatcaatcctcctgttcttcttcgcaaacacccctattttcccagtgtcgctggtatgagcaaaaaaaaaaaaggtcgttcgggcgaaagtttttcaaaaatacacccctaataattgacttttcggatcggtaccccccccaagcccaaatcctggatacgtccctgtaaatgtctgattgtgaccagcgactctgaaaacacacataagcattttttaaagattttttacggaccaacctgatttgtattactttgtcacgcacacattcttgacaattgagagtttaataaaaaaaataatttccaaaattcttacagctaatccgatttcaggaaattgcgaaatttacactaaaaacaaaatttaatttaatcattgcaacagaagaatatttggtacttcgggttatgtcgccccccctcaaaaaaattccaaaattcgtaatttggggtttccaacttcgctgatcacgaatatgatatttattttaacatctgatgacttttaatcatagatttgacaagtatctatgattttatataatgatttagaattcaagtaactcatgaaatgactcaaactggtagatagtagttgatcttggatattacataaatttaaaaatactctgtgaaattagatggggattgcacaccgcccttgctctcactctccagtgatttggcaacgtataaaatttctcatgataagagatattcatttttctcggatataagatagcattaaaaaattctctgagaacttaaatgctcgaatgccaactaacctccgtctcacgctcgagcgcttttgtaacacataaaatttctcataagaagagatagacatttttcttgcatataacataaattaaaaaatgctctgtgaaattaaatgtgcgattgctcgccgcacttcctatcaaggtcgagagcattt

SEQ ID NO: 29289 - DNA, 1172 bp, Heterodera glycines
ttttataaatttttcaaaccattaaaattctccccggatatctttttcaatgtatttgttatataaaaacatgatttttatgaaatctaagcatgattgcggcgctttttccaaaaaactttagggggaaagggggctggcggtgccgataggcacgcaccggaaaatttttttgtaatttttaatacgattcgttaacagatttgtccaaaaaaatggcaaaattttgcgattttgagcatttttagggtgcgaaaattaagaattttgaccattagcatattttcattgaaaatattcttaattttgagaattttcggaaaaaattgactattttctggtttttatgaaaaacaaatttttttggaaaatttgaatgtgattttcgttttgatgctctattaaaaacacaaattatcggtctacgtcagttcggcccccacggttcggccccagcatgtttttccaatataactttctataacttttttatttgtcaaccaaatccaatgttgttggtatctttcgaaagcttaatatgtttagaggctttatctaagctattgcttagcgattagacaattaccaaattagttataacatgaaactgcaaaaaagtcaaaaattcaagttttttctcaataattttttttccaggcttgaaaatctttttattttttgttaggctaatagagcatgatacgaactttcgaatgataccaagattgtttgatttggatgccaaataaaaaagctatcgtggaaaaacgaggtggtgccgaaccgtggggccgaactgagggttccgcaaattattaaatgattctcatacattatgccaatttatcgattaatcataaatttaacagattacgacgattttcctcaaaagcctcaaaaaacctcaaagcctcattttgtaaatttagcctcattgacctatcaaaaaaccacaaaatgaaatataagattttaggcaatggtcattttggacaaaaactgttaattgtattaaaaattacaaaatccggacgcccctgtcatcccaaagcctaagatagatatttccaaaaaatcaattgttgcataaaattttttggacgccgtatatcgaaaacctgaaaatgtgtaggaaaaatatggatttttcacgaaaatttacaaaatttttc

SEQ ID NO: 29290 - DNA, 801 bp, Heterodera glycines
gaagggaagagggaaaacggaagggaaaaacgtgagaacgggagaaccggaccgacaacccagtgaccgtcccatgccatcgccatttcgtcacaccggccgtgcttttcatcgtttgaatcgtacgccgactcatcacccgtatgcgaaccccgtcgaccgacaccagccccagccttttcggatgccgaatcagcaaggcccgagctgccgacagttccagcgctgaagacatcgcttgtcggagggcgaggatgtcgtaattaataatgacctcattttatttttgattttattatatttttggcatttgttttaatgtttgtgatttcgttttttgttttccttttttttcctcagactttaatttggaattgcctgacataaaataataaggctttattctgtgtgctttaattgtgtgtaagcgctgaactgttcgacgtactgctgagtaaaattaaattatttgtacgacgcaaaacaataacaaaacgccacattcaaacccagtcacagacatatatatacttatctttattatataggattatttgttctttttttgcattttttaaaattgttttcatttaaatattaataaatcattcttcctaatcgcaatctcaattaaggatttattcttattattttttaaattgataatcataatatgcaaaaattatgatcacataatcatggacataatcccgcaatgacaatgtttattatcccaaagttaattttttacattgtgttaaaaatgatatttttattataaaatttttaaaattcttaaga

SEQ ID NO: 29291 - DNA, 1631 bp, Heterodera glycines
  misc_feature (1095)..(1095): n is a, c, g, or t
gaagcagtgatcaaagatttaaaatgtgaaaatcattggcattctgtccttatgagggaggagcaataaaaaattcccgaggcaacaatttttatttcacttacaattattttcaagaaataacaccagaggcaattataaaatggaattcagagacccctcaaaagtcccgcaagtcgtaaatcggaattccgaggccctaaaaaaattcggcggagtcggaagtcggaattccgggcccctaaaaaatttcgaaagttgggacttgaaattccgaggccctaaaaaattcggcgagtcggaagtcggaactccgggcccctaaaaaatttcgaaagttgggacttgaaattccgaggccctaaaaaattcggcgagtcggaagtcggaactccgggcccctaaaaaatttcgaaagttgggacttgaaattccgaggccctaaaaaatttggaggaagtcggaagtcggaactccgggcccctaaaaaatttcgaaagctcgaaactcggaattccgtcccatcccctggtggcgggtgaccttttgttggcacgaattttcgtgatgtttagaaaattccaaaattgggaaattgcacccctaaagaactgaaaagtttttcaaatttttgaaaaaaaaacttctcaaaagacgaaagcatttttaaaaataatatatttttgaaatttatgccaaaaatttaattggaagattttaaaacattaaatatccaaataacacaacatttaccgccccgccgatctgtgatcgaaaagatggcaattttcattgacaaaaaattgttggtgaaaaccatttgtaaaatggcggcgccggaagtttaatttttccgcacgcattttaaaatttaatttcattaattaaatttctgccaaaaaaaaaaattactgcgcggcgaattcttttgaattaaataattgtttttgtttttggaccattctttttttgccgagacttttctgatcatcggaccgacaaataagaattaaaagttttgaaccctacgcaaaaaaaatggaaagaaaaataaataaattaattgtgtgtgtgacatgcggtgcctttcccccncccccgggggcagaaaaatgttacaaaaattttaataaattttaccaccgtatgggcgcgcatggaccgaccgtcgtgttcaccgctaatatcaccccctctttaccttttccttcctttgtgttttattaattttcgtttccgtcgtcgccgcagggggcaattttaaagaggcgcctttttcttgctctctctctctatctcctctctctctcttctgtgttttctctctcgctctctctttctctcttatttatcccctctctctttctttctctatttctctctcttcactctctctcactcactcttatttatttatttatttttctcttttttcttcctccatctctctctttcccctctctttctctctctctctctctcactctcgctctctcccccccccctctctctgatcactagaaaaaagtgatcagcagccgtagatagagagagactgataactgctgctggatggtttgcaaaggtcgcgcggctggcggcgttttgtttctttggcctctccccccccc

SEQ ID NO: 29292 - DNA, 1967 bp, Heterodera glycines
  misc_feature (8)..(9): n is a, c, g, or t
  misc_feature (29)..(30): n is a, c, g, or t
gcctgcannggtcatttgaaatttaaaannttgttaccatcgaaaatctgggcctaccctcgataaaataaatttaaatggggacagggaatatccaaaagtttaacaattatgttgtagtgatttttggccggtacaacaattttaatttttttttatcaactaaaaacattttgagagtaatggggggggggcggacaaattcgagagcgatgggctcggaggtaaattgagaattgaatatgtgtgtgtagtggaaaggggcgatttttatatgaaaattctttgggtggagggtagacactgcagggaatggggcgggataaagaggggagagaagctagaaaatggaagtagtgtagaaggaagagaaaaagagatcggaaaagagtggagagagagagaagacagagagaggagagagtgggagaaagagaaacaaagaattgagacagagggaaagcaaaatagaaaagaaaatgtcattttgagagagtactgaaacagagacgaatgaaagagagagagagagagaatgagagagtgtgttgaatgaagcgaaaaaagaggcagagaaaagagagaaaagacgaaagacaacgggcgccagacaaacagacgactcacaaaaacaaaacagctgtgtacgtacataaatgctgaagagagtgagaagaagaggggggggggggggagacacattgtccaatttgaatggggacgaagggtcaatttttacgacaaaaggcaatttatgcgtggtgtaattgtcccctccggtgctgtgctgccgctgtgagcaaagagcagcagagggaaattttcccttcggggaaaaatttcaatttaaaagattgatggatcaccaaataacaacgcgactaaaaagaagaggggtgatcagagagagagagagagagaagaattcagaaaaatgtgtgttttgatcaattaaaccctcctgatcagttggaggaattgcttgattgattggttgatgagtcgaactctgatcagcaacatggggtgatcaaaatggaattttttcagagataaaagttgaaagttacactgatccggctggccccaggcaaattacgaatgattaaagctctctgatcagtttgcaaatgagtgaatgaacgaaaaaaattgacgtatcttaacattggtgatcagaatgggaagcgttggttaaactgttcaacaaaaaaatcccgatcaatctctcctgatcacgatcgatcaaatcccgattaatttctcctgataatgatcgatcaatctcctgtgtttattttggcttgtgtccaattaaaaaagaaaaaaatgctattgtccataagcagcagcagttgcttctgctggagggaatatttatggacaacactccaaaggttcgttgtcgtcggctgtcagatgatctgccagacgacggacggaatgttgtgtgaaaaatgggccggcggcgaacgcttttcacaaaggaggccccgagggggaggaggacaaaacacatccatccatccaaaaccattcattttcattttcaattttattcttttcgacgacgattttattgggttgtaaaatgtttcaaatccgtcggcgaaggcccgacgaaaagaaaaaacgaaacgaattgatcaagtcaatcattgggcactttggccaggcactgcgattgatcagtcatttgggggtcggctgtcagatcgtgtttcgtccccactcccctcattaagatgctttagtgatcattgaaattaagctctcgatcagccccgaatgaggtggatgctagcggccagcagtgcctagtgtttgttgatcagtgcttcctctccccgggagggtggggggggggaaggatcgctggcgctgcccgatcattttctatgagtgatctctgctcttttgttggtcatggtactgctactgttactggttgtacacactgtcgtgtc

SEQ ID NO: 29293 - DNA, 1381 bp, Heterodera glycines
  misc_feature (76)..(76): n is a, c, g, or t
gaagagaatggtgacaaattatttatgagggatttttatttatttatcgcatttttttttttgctgacccttcccnagttgataagaaattaaggtaaattaatatgaattaccgcttgttgactcatgaaggacgtaggaagatttttgtcggcaaaaaatattaaatgataaatacgatgagattaatgatagatgctttcaaatttgaaagataaagtggaatagagatcgaatatgacaattatggcacacaaaaaatttcataaatgagagagactacggcataattcaattttatgccagagaatgtgggcccttgaatcgaaccctcctatattaccgaccccatatgagcagaaacacagtaaattgcatgctaacattgacataatttacatactgtaagcctgggttgccatcccaactccgttttttttctcatcccgagatgcaacccaaaaatttggttatcacgatcagaatcctaagccgacttttttcgttccatggcaaccctgctgtaaaaaatttgaatcacaccaagagccatcaaatatttaattcatttttttaatggcttcataacttataagcggtccaacaccgctcaaaaaagcaaagataaaaaacccattggaaatcacagcatacatgcacaaggggtgtctcgaccgcaaaaaaaaacgttttttttttgaaaaaagtcgtagacttgccaaaaaatcgcaaaatttggcagtttttggtgaaaatctgttaacttatgtgttttaacaataccttaacagtaattgatcagatgcgataaaactgtatttgttcaagaaattaactagcgctaatttttattgattgatcaaaatatgctaactgatcctggataagaaaattgatctgatcagaaaatgccagctgattagaccaatatggcaaacatagtgattgggggataggcaatgacaaagaatctaatacaagagtaaactgatcgggggagtaatgttaagtgattcgaatatatgcaaatgtgatcgggcaaagaaaattgtttgtgtgtgccgttctacactaatgcattttcccctccggcacttttgcagttgccacagttggtcggcaccagcagcacactgacgctgaaatgtgtcgcggacggcgatggtagcggtactgaagcgacgcctccggtgacaggcgacgacaaattcacgtggtacaaggacaaccaagaaatgtcgacattgacaacagagcaacggatcaaagtcggtcttcatttgtactatacagcgcattgatcaaaaatgcaatatatcgattttatcaatatattgatcgatcgggcgctggcatttttgcacggatgatcaaatatgga

SEQ ID NO: 29294 - DNA, 1786 bp, Heterodera glycines
aagaagcagttggacacattcatttctcagatcatttcttttagattgggctcatatttcacttccgctttttacccaaaataatgtttaaaaatttttatttttttattaaaattaaatatttatttttgaggtcaattaagaaaacaacgcgtgcaaacgattaattataacggggcgtggcggagcgggaggggggcttaatggtgaccgatcagtcccgagggaattagtggccattagcagccgtgaacagcttttagcttttatgcttctgctggcagagtcttctgtctgtgcttcccctcgtttctctgccgttgtgcccggggggcgtcaaaccccgcggccaacagacagtcgacggtcggtctcttcttggcagccgctttgccttcattttgtttgccggttctaatgaattattgaagagttatgaatgtgtgtggagagaaagagagagagaaagggaacgagcggagagagaaacatttgaaagtggaaagcaaagaaaaacagtgccgagagagagtggaaagcaaattttttatatttaaaaatactttttttagaaaaacagtgccgagagagagtagaaagcaaagaaaaacagtgccgagagagagtgcaaagcagagaaaaatagtatcgagagagagtagaaagcaaagtaaaactgtgccgagagagagtgcgctttactgaaaagaaacaaaacatatttagggcaaagaaaagaaaaagccaaactttgccaacagcggcaaagagattatgctgacatgacgagagtgaggtaggacataagcgttgaaagttgggttttccgagggggagagattgtttttgagaaagatggatgggatggacgacgttacgccggcacggcgaaaatgaatgggtggggggagggggcgggaatctttggaaaattgtccccacctcagctcatccagacggaccagcagcagaggccattaatgattgatgaggtgggccaaacgccgagccgccgtcgttgaaaggcacgcttattaaaagttaacgtagccaccacaaaatgtacaaaaataaatatgaaaagtgaaaaagtgtttaaaaaaacatttgaattaattgcttagtaattaattaaaaactccttgtcacctgacaggcgaaaatttaaatttacaaatcggaacaactaattagatgtacaaaatatggaagccagcttacaaattagagctgaaattgataaaaaaacaaaaacaaatgttgtgattaaaaaagagatggaatgttattaattatttattctcattttaatccgttagttttttaaatacaattcaaattgaggatgaaccagacagaatattaacagcacaaacagagcagcaacaggtcagaacacctgcgtggtggtgcactttctcacttaatgcattaatattaaaacattattttatttaaatattttattttgaaatttaattgaaaataatcgaattttcaaaatgcagacatttagttcttcttgagattaattagcaaaaagcgggaaaatcaagcagtgcatagatgcggttttttttcttgctgcttttgaagtccaattcttttcgcttggcgttgcgtatgaaactttttcatcatttatacttttggtcggcaaaaaaaacagaaacacatttctccaagaatattcgttcaatcccttcatattcgtccacaataaaagttttgctgactaatggcccttcccgccccccgggggccattcattcttccaccccccccc

SEQ ID NO: 29295 - DNA, 1043 bp, Heterodera glycines
  misc_feature (66)..(66): n is a, c, g, or t
cggtccctgaccgtggacattttgattatgccggtcttgaccgtggacattttgattatgccggtncctgaccgtggacatttttgattatgccggtcttgaccgtggacatttttgattatgccggtccctgaccgtggacatttttgattatgccggtccctgaccgtggacatttttgattatgccggtcttgaccgtggacatttttgattatgccggtccctgaccgtggacatttttgattatgccggtccctgaccgtggacatttttgattatgccggtccctgaccgtggacatttttgattatgccggtccctgaccgtggacatttttgattatgccggtccctgaccgtggacatttttgattatgccggtcttgaccgtggacatttttgattatgccggtcttgaccgtggacatttttgattatgccggtccctgaccgtggacatttttgattatgccggtcttgaccgtggacatttttgattatgccggtcttgaccgtggacatttttgattatgccggtccctgaccgtggacatttttgattatgccggtccctgaccgtggacatttttgattatgccggtccctgaccgtggacatttttgattatgccggtccctgaccgtggacatttttgattatgccggtcttgaccgtggacatttttgattatgccggtccctgaccgtggacatttttgattatgccggtccctgaccgtggacatttttgattatgccggtcctgaccgtggacatttttgattatgccggtcttgaccgtggacatttttgattatgccggtcttgaccgtggacatttttgattatgccggtccctgaccgtggacatttttgattatgccggtcttgaccgtggacatttttgattatgccggtcctttgaccgtggacatttttgattatgccggtccctgaccgtggacatttttgattatgccggtccctgaccggggacattttttgattatgccggtccctgaccgtggacatttttgattatg

SEQ ID NO: 29296 - DNA, 1258 bp, Heterodera glycines
tttcctggacattactggccacgaatgaatggtatcaacttttttgtgggtggtagactatagtacaaccaatagattttatgttatttacatgagcatcttaaaatgatatatcaaaatttaaataaagtaatattttgtatgaaattaaataacgagcaagttaattttgatcaaaaataataataataaattccaaaatgagtattaactttaacctttataaaaaattaccaatttcaacaaaattaaaaaatttgcaaacggaacttattatctaaatttaaacctaaattaaaattgaaaattaaaaaacattaatatagtatttttaattaatatccaataattagagtaagaatttatagatataattgattttttcaatacaggatatagcttaaattttaagaaaaaatcaatctctaaataggataaaacttttttgaaactttaaatatttgacgaagggcaataaaattaattaagacatttaaatatgaaacttttaacttaataaataaacttgtaacaaatacatataagaaatatttacaattaactagctttttggtccgaggggataaaaattaataacgctcaatcagtttttgaactgtctaaaaacttgaaaagtgtagagaaaggggtaactcttaagttttctaactgccaaacttgcaagaaaagtatggaagatgtcataacaaattataattcttactttaattaaaaattgcattaattttaaaattcatcatttaaaaaatattttgcaaaaataaatgtatttttaataaaaagcatagaaattattgcaccaaaaattgttgctacaattttctcggaacttatgtaattgtctcgcagctatacattattcaaagtgcttgatgaaataatggtaaataactaaaaacaattttaactatctatatgataaattcaatgagactttacaaactatattcttttaaacatttctcaagtaatgaataatttaaaaatctaaaaacaattttaaatgctaaaattataaaaacattcattatatatatataatatatactctacagacaaaaagataaaaatacctctataaaagaaggtaaagaccaaaattcaaaaaactagagtaattttattaaaagatttcaattcttaaatcaaaaagaattaaaaaatttaatgacaaaaccaaaaattttagcaaaataaatctaaattatatgctgcatgagaaacttccaatgataaa

SEQ ID NO: 29297 - DNA, 531 bp, Heterodera glycines
ccgacatttggcgacccccctcttagggaacccgacatttggggacccgacttttggggacccgacacttagggaacccgacatttggggatcccgacatttggggacccgacttttggggacccgacacttagggaacccgacttttggggacccgacatttgagcaaaaggcacttagggaaaccaccgacatttggggacccgacttttggggatcccgacatttggggacccgacttttggggacccgacactttggggacccgacatttggggacccgacacttagggaacccgacatttggggacccaacttttggggacccgacacttagggaacccgacatttggggatcccgacatttggggacccgacttttggggacccgacacttagggaacccgacatttggggacccgacttttggggacccgacacttagggaacccgacatttggggacccgacacttagggaacccgacttttggggacccgacacttagggaacccgacttttggggacccga

SEQ ID NO: 29298 - DNA, 1382 bp, Heterodera glycines
  misc_feature (82)..(82): n is a, c, g, or t
aagagattagcaaaaaacattctctcttggaagtagttttttacccacaaaattctgaggtaaatttcaaaaattgtaattntaaagcattaaaaaattaatttttaaaatttttttaataggaatacatttgttcggatgaaaccgaatacaactttgtcaaaaatgcttggattgaaattaatcaaaacgatccggcactgagccaattgttagaggcattatttgctacggtcatttcggcaaataaagctttggaatacggtaaaaaataattcgcaggccgaaatttcggaaattttcagacgatgctaacaaaatatctgcgcagcttaatgaactcaaacagagtttggcatatgccgtgtttttcatggcaaagcgtggccaaattccactggaaagcccacgagaggagaaggaaagggagccaaaagaaattttaattggcctaattgacatttataatgagtgtcaattggacgctgataaggtgctaaaaagttgtggagaatgtgggaaaaaaggaaaagaagaaaaatggcaaaaaggaaaagaaaaatatggcaaaaaagaacgacgctttcttgaatttgttgcgcattcattggaaatgaaatgggacgcaaatgcattttcagcaggtggtcagcagcagcaggacgacgatgatggtaattattagggagtccaattatatgcacatgcatatttttttcctggactgtgggaggcctgaaacgcacgaaaaacatgtttttagcttgatttgaagcttctaagatgactttccatatgcatattttgcatatttgtgcatatttcgcgatttatgtgcatatttccatatttgtccatattttggcatttaactccatattttatgtccatattttggcatttttccaaaaaacctctaatagaacggcccccaaaagacaaattggactttttgacctcaaaaaccggaaaattttccaaaaaaataattttttgcaaaattttcacgaaaaatattgaataaataaattttctcaaaaaatggttaatttatgacaaaaataagcaaaaaaagcaaaatttcgctttttgggttgatttttcgcaaaaaatgagtaaattttgttttatcatgtttttttctcctaaaatgctttttaataccacatttagccatttttgaagattttactttatgtttaacaaatttgaagaaatttttgaaaaattacaccctcaatttggaaaatttatgtgcatatttttcactttttatgtgcatatttcgcaatttttgatgccatattttatgcgcatattttgcgatttatgtgcatatttttggatgccctagtaattatatgcctttttaatgattttca

SEQ ID NO: 29299 - DNA, 1349 bp, Heterodera glycines
  misc_feature (46)..(47): n is a, c, g, or t
  misc_feature (116)..(116): n is a, c, g, or t
cagttagcaagtgcttttctatcgcaaaaccttctccgatttctcnnttccttccaatcactcgcctttctctgctgatcactctcaaatgccgcctttccctttccttttgcttntcctttgatcaattttccccccccccccccctttccttcgattgatccgtccatgggttttcctcgcttttccatgctttgatcgccaactgtttgtccttatcatagcgtgccatggctcgatggaattattccaaaactaatgaaagcatcaaaagcctccaagttgaagagcatcaccggcagaatgactttggtactgtccctccttcctcttttcctcgtcttcttccatccctgccaatggcaaacttttcgccaacacttcgccaaaatgaattccatgccaatgccacccgcaaattcgcattacatttgtctgctccactcaatgcatgtttatctgtgccctcgagaagcagagcgagaaaagttaatggccaactttttgattcggacgagcaaaaatgggcggatggacggagaaaagcgaaggacagcggaacattggcactgacaaaggcaattcggcacaatttggagagggcaaatcccccgccggttggagcaacgcctcctttatctgcactatccgttttggcacattctccggtatcggcatcgcctcccaaggaatattcaccacagaaggaattttgcgcgaggcggccattgtttcccaagtcaaaatttttgagaaaagctcagaagctgaggaaagaatggaattgggtggcaaacggaagcggaagagaaacgacgccaacgcggacaaaggcaaaggaagaggaggaggaggagaaggaagaggggaaacggaagaacaggaaaaacaaagcaatgatggaagaggaagaggaggaggaagagaggaaacggaagaacaggaaaaacaaagcaatgatggaagaggaagaggagaaagaaagaaaaaatgataatacaaaggggggcagcagggaagagcagaagaggatcattcatctgctgatagtgaatggagcagcagcagaaaaagtaaaggaggaagagagggacgacgagagcgagcgggacgaagaagaggaagaagaagaggatgaggaggaagatgaggaagaagaagaggatgaggaggaagacgatgaggaagaggaagaagaggagcagggggaggggacggaagagagtgacggcacaagttgctggagcggaatatccgtttccggcagcagcaaccaaagtcggagtttgagcatgagtcggtccgtgacaaagtccccatcagtggcactttgtctccacaatgccctc

SEQ ID NO: 29300 - DNA, 1391 bp, Heterodera glycines
  misc_feature (97)..(97): n is a, c, g, or t
  misc_feature (121)..(121): n is a, c, g, or t
  misc_feature (141)..(141): n is a, c, g, or t
ttgcgcgaagcgctcatgtaatgcatattctttcatctctcacaagtatactgtctacaccgagcaattaatgtgcaaacatatacctttaatgttntaatgaaaataaattagttaaatntaattaattaagaataatanaatgaggccgcgaagcggccgaatgaacgcattaggccttaccgaatcaattagacaaagaagccgcgcaagcactagcaacgaagtccttttgcgcgaagcgctaatctcaacacacaacccaatgcttttcaagtacactgcctatagcgaagctatcactgtgcaaagcatacggtctacacaaagaaattactgagcacacacccgctagtttatatactttagaacaacagtgagtttcatttccaaaaacaaaatctcccggccgaaggccgggaggggttcgaaatttcgaccttgggggtaacttttgacggcgcattcaggaaaactatagattttccgatccgagggccaactgagcgccaggcgccgaaaagtcacttttttcgaagcagtttttgcagtttttgggattcaaaaattttttaaaggcctaaatgaaaaatccgctcccataggattttaagttggaatgtttggcacattttttgcttcttcaccgaacccctagggcctaccagtttttccgaaaaactgactaaaaattgcatacttttttgggccatttcagcgccggtggaataactccccggcttttgatgggaggaggtcggtgtaagcggcttttttgtagagctcgacgagctctatccaaccatcttttcggatttctgaaattttcagaaattttcgagctaggccccctcgaaaattttccgttttttaattttattattttttgcagatttttccgggcaaaacgaagaccactttcaagcaaccgtttttcatgctctatcgattggtgtcattttcagaaaaatttttaaaaatttttttggaaatagaaaatttttggttgctaggcctcaatttcagttctggcgcaataacttgtcaggagttgattttatgaaaaaatcgtctaagagcttttttgtagagaattttaagcccaatataatgtgctttatctcatgtttttaccatgagtttaaaaaaagttataaaataaaaatgaattttgaaattaaaaaccataggggggaccccatggttttgcatttcatgaaaaatttttttgctcctaaattagccaaaatgcatttttatggcataatttgaggtgctgaatacgtatatacgctttattttgcgtttcagattttttgaaaagtgtttaaaattttttgaaaaatcgtcataatgtgggccctggaaaatccagtgaaatttcgaaaatt

SEQ ID NO: 29301 - DNA, 1374 bp, Heterodera glycines
tgtgtcgcaagtggctgaacgaggtcctcctcctcccattttgtacttatatttcccacctttgcttttagaaacggaattctcttaagggcgtcgttttcgtcttggacagtgcgacgttcagcaaaaaagtgtcacttttctgtgcattttttacttcctttcctttctttaattatttgtattttcgttaaggatgccgccgaattgctgtacgatgtgctgtttgagtcgggcaatgccgtcccggttctgatcgcatgcaacaaacaggacattggacacgccaagtcgcactctgtgagggcgggggggggggaatcgtcatccaagcaaatgcatcgccttttctcccccattgttagctcatcaaaaaggcattggaaaatgagttcggcttgatcaatgtttcgcgtgaagctgccctcagttcgatcagcggagaatccgaaaagcgaattttgacaaaaagcgggagggaattcgcctggtccgaattgaagaacaagaaaattgattttttggagtgcaccacgcgaaaagatgagaatttttcattgtcttcggtccgggaatggatcaacacaatttgaaacgaattgataagcattttacagttgttttgatgataaaatcgagtcgataatggccaggggggggggaattgctcaactgattttgtcagtgtgtgcttttccattttgcttatcacaatgctttctcctttgcttcgtaattcgggggctccccccccctatttggcctttatccttcgcccattagggacttacgatggaatggcttggcggtgatctctccccccccccccccacaaaatagtcaggttttccctgcttattgtcgtttattcttcgaaaagctttttcttcccccgtttcatctccgtgcgatcctgaaaaggaccaccttttgatgggtttggaactcctccccccccctttcccctgtctccctatttttcttttctttcccctctctcttccgttccttccacgcgctttcatctaaaaatccgctcctcaaagcccacccatcagtgtaatgtactcgcgttcccaccccctccccccgtcgtccgttgggttgcgccgtatgcccagtggtacggtatcgcccggcactcctccgccatcggtcatttccgctctttccaccgaccagttaccacccccacaacaatcgcaaaaacggcacagtgtttcgctttttgggattccaacggcgccgagcattggaaacggcggtgtttcgacgatggtcccgtgggcgggggaagttcccctcctctctttctcaccctctcaatcaactttaaagggaaaaataaacgaaatgatttttaaggaatttaat

SEQ ID NO: 29302 - DNA, 1342 bp, Heterodera glycines
  misc_feature (1222)..(1222): n is a, c, g, or t
aaatttgattaaaatttgttgacagattttcactaaaaaatgatcaaattttgtgatttttatataatttttctaaggagaaataagagttttggcgcgccgttgagaacagtttttcatcaaattaccaaattttgcgattttgggccattttctaagaaaaaataggagttttgggggcgcggcggtgccgataggcgccgccggggaaaaaaattggaaattttgatcatttataaacagtttttcactgaaaattagccaatttataggtaaaattttgaaaaattttatgggaattttatccaattcttaggggtgtaaaagtcgcttttcgcgccaaaaagcgaaatgcgaaaagcgaaatgcgaaacgccaaaaaatgcgaataatgcgaaaggcgaaatgcgaaaagcgaaacctcggcccatccctggtgtgggcggaggccggaggctatttgctgataaggaaatagtcagcaatgaagtgggaaaccgggaaaccatttgctccccatttcccgcaatatggctcttaactatgactccccgaaacaaggagcaaagcggcacgcatcggcagatgctggacagttacttctgcgaatttttatggcgtcattccgtcaaacgaagagatgtcgatgcattcgaataccatttgcaaaacatcgttgcttatatgccaccaaattaatatgatttcttgcgatgataataatttgtaggagaaaaaaagaaaaaaaaattgaattttgataattgttcgaatccgggttcggagttcgaaatgggtcgaaacggacatcatattcgggttctacgaccccgaaaacccatagaaacgacttttattaatttaaaatcaatttaacaaagaaaaaaattttgttgacacaaaacgcacaagtaccaaaattagcaatggacaaaaaattttgaaaattttattaaactatgaaattttgaagcttctttaaattcacgaaaaccaaaaatataatttttgacaattttcgagttttttctttccaaaatttgtgtttagaagtgtatttcttggaaatttaagaaacaaatccatttaactaagctctattatgaaaaaaataaacaagccgtccagcagaggaagtacaggtcaaaaattttcacacgcctcattgaggacaccccttacaaaacaggcgtgctgagtcgtttcgtaaatctgccaaggngtataaaaacaaaaaatgtgacacataaacattcataacttggctaatatctcctggtattattcaagctcatggctattctttatctgaatattattttcatttttttaagtataaaaa

SEQ ID NO: 29303 - DNA, 1228 bp, Heterodera glycines
  misc_feature (973)..(973): n is a, c, g, or t
tttgaataaatcatcaagagtaaaatgtttaagcttttccattaatctaaaaagcaattgcgacaataataaaaaaaaaaattttgaaaaaatttgagcaataaaggggacccaaacgcaattagtacccaaaaaaagttatggccaaaaatgactgaaaccctggtttctgatgtacttttggacaatagtttgattttttttttttgaaattttgcaatctaataaaggacatttagggctttcgaatgataaccaacaaatgttggattttattcaaaaataaaaaagttggagtccaaaagcattgctgggacacaaacgtgccggggcccaactgctgaagtaaaccctccgttttcacccttttcagttacattgttcaccattccgtcgtcgcatttctccgcgtcaatcagcaaattttcgacaaaagtggcaccaatttgcgtttccccatgacatatgaaagtaaaagcaacaacaaaacggtttggaatgtttttgcccgcgaaatttggccaatttttgcgccaaacattcgccacttgtattttcaaaaagcggtttatttggacaatttgcgccgccttatttcgccgtcagttctcactgatcagtgccaattgaattcaatcgaatcctgttttctgttccccgacgcgattagtgacgatttggatgggccaaatgctgcatttttttcgtctggccaagcgttggccaaatggttgcacgcaccgccgcgcactgatggacagccgaagcgattgtactgccaccaaactttgtacaatgtggacacagacactggatggatcaacgatttcaaggaggtcggtgcgtggattttttttttttttgaaaaatgcttgtttttgctggaccgctgaattttttataacaacacaacactggagacaatttttggctcgaagagaaaaaaaaagtttttggattcgatccccccccnccccccccctctgaatcaaatccaacaattttggtatcattcaaaagctcttcacatgctctattcgccttgtaaaagcaaaaagattttcgagcctggaaaagatttattaagaaaaatttataaaatttcgaatttttcgcaattttcttgtatcactttttttgatatttgtctaattgccaagcaataagttagaaaaagtttttaaacatactaagctttcgaatgatacgaaaatcgtttgatttggtt

SEQ ID NO: 29304 - DNA, 1218 bp, Heterodera glycines
tttttactggtgaaagtaatcccgcaatgggggtggtacggtatgcacttcttcttcggtgtattgtacactggggattggactcgctccgtacgagcagtaaaccacgggcgtcccccgagcaaagtcaaagctccactcgtaagggtctcgggcagctgcaacagcggcttgggcgtcgtaaatgggctgtgggggtggcgtggggaaaagggagggcaaaagagtggccaaagtgggcggatgcggcggcagagtcagcggagtcggcgttgtgaagtacgccttgcaaaggaaggagaattcacattagtagcagaaagtacactgtcccccgagacttgtctcgtcgtgtactgttgctgtcctccttgcccttggccattttgtcccgctgccgatgcaatgtgttggccttgttggcgttgtgccgttgactgtgagtagtacccctgctgtccttgtccctgtccgttctgtccttgtcctccgttgtactgctgcgtcccgtgggatgttcctgctgttccaccatattgtgttccttgtaattgttgctgttgtccgccatttccactaaactgagttagctgctgctgctgctgcgtttgtcctccgctttgcacaatcggaatcggctgctgttggggcgtgccgtactgaccgcccgctccctgtgaagacgaaggcacaacgaccgtttgctgaccgtacgcgtaaggcgacgactgtgcagaagaggaggagtactgtgacgattgggggtagctcccggaatactgtgactgcggatagtttccgttggaataataataattcccttgggcgtattggggcgattgctgctgctgatagccactgaaaacagtctcatctcatttatttgccacaaatgccttccctcccccttttttaccccgttccgccaccgtatccgttgtttgtgttgctgttgtagctgtagtactgttgcggttgttgttgtgagtagtgttgtgccgtcgatgatccaccgttcgttccctggccaccgtactgtccctgcaccgaattgtactgtgaataggtcggcacatattgctgttgctgttgggcgtattgcgtgtaactgttcgatccgccgtccaccctttggcgttgggcttcgcaaatttggagttgaagcagcgacaaaagcagcagaaggaaaagtctccttctgagaatcacagaaagcga

SEQ ID NO: 29305 - DNA, 1699 bp, Heterodera glycines
atacaatcgaaataaaaaataattaaatatttgcgatttttctattgatttaatcgtaataaaggacgaaagaatactttcataaaaacgatttattttttaaaatacttttatcttaatgagggtgaaaaataagcaaaacaaagtaattttctgtaaaagtttcctaaaataataataataatcttagaatatttttaattagcttcattatctctgtgctttttaacttaaaaattataaaacttttacaaataatacaaaaccagcataattaattttaaatgttttaagcgatttaaaaagtcaacgctcaacatatagcatccaagaatcacttcttaggatcatgtgaaatgaacaaaaaaatttaaaaaattataaaatattctgaatataaaatggatttaagtattaaaagtaaaaattgaagataaaaaaattcaattttttatttactttaataaatttgtcttttttatttaaaattaattttcgagatataaaaaaagatattcgataacataattgtggatttatttatgcattaactgtttgaaaataaaaatttttgaatagaaaattataattatttctttttattaacaaaatttctattaaaagatcatctttatcctggtagtttattcttagaaattttattattttaaatgatttactctcattttacttagcttattttccaattaatgatttagcttaatggatttattttctgtcatgttatttatttcattctttattaacattataatctgcgactgatgggattatttcaaattttagtttaattttgttattaaaatttcactttttattattaataaaatatttcacagatattttagcaatttgactattcaaaataataataataatattatttttattaagtaataataaatatgtttagttttatcattttaattttagcagtcgattgccttgagcgctcgaaccgcatttttctggcgcgcccgcgggccgcctgctggagcgtttttgccttaaaatcttaacttattttccattaatgattttgtttaatggatttttattttatttttttaaaaattattaaataatgaaaaatattaatcctaacatttttatattatagtagatatagaatgatctataattttcttattttatattatagaatttatctactttttcataaatataaaatttaatttctaaattttcgaaaattaatttttggtttatttatttttttatatttttaattaaggaaaaataaaaaataacatgcaacgagatgtattttctaatgggcggcggctgatttttttttgtcaacccttccaaataagaataaaggtttttatgatttttgtggttaaatttgttatttgagtggtgtcaacagacaaatatgaacgaaacaaaatacgtacgttgaaaaattaataattgtcgtgaattttgccaagattagaaaatagagagtttcttaagcagcggaggaaccaagcagaattgtgattaaaatgattaattggtcttaaattctttattattttcattagttgattcttttttctagaatattaattattaaaccaatttatcattaatggcttttgttttgtgcataaaaaactcgcagtatcatcatagacaagagggcgaactttgtcgatttttaataaaa

SEQ ID NO: 29306 - DNA, 1948 bp, Heterodera glycines
  misc_feature (11)..(11): n is a, c, g, or t
cttaccatacngagttaaatgctaatttggcaatatgtcttaatccaggattaaaattcatttttgttgcttccaattcaatttgatatatttctcggtaagttttcacaaattccaatttttcttcttcattttggacatcctgaggccacccggaagcttcaactttcaattttaaaaattttctgacataattcttaaataaatttccatcaaaattttcgtaatgataactgcggtaaaatctatcaataacagcccccaattccaaagctgaaataattttttatttttttaaaatacatctatcaccttttttcaattctaaagtacaaaattcaccagtaagtgcccgctgttcagcactatgtctacactttttggtattttttgaataaacaaaatctgttttggtcttcttggcacacgaagaacaattagtaaataataataaatcatcctaaaaaatctataaaattaaaaaaactgtcttttcctacagtatgaaaaggtaaaacaggaaggaattgattttttggagggatcactcgtactttcaaaagaccctcataaggaatgtcatcaggtgaagtcctaaaaatgcattgaattttgtattttttaccgaaattaccattttactatatattgtttaggaatgactatttttgggttgccaacgggatagggggtggaatagttcacccaagggtaaagactaacaatatcataaatcgaaatttccatattttcagaagcctcagcaaatagacataatgggcctaaaaattaatcattaattcagaaaaaacgaataaatctaccagtacggccacccgcaaaaccatttcttgggataataggtccaatttccggtaaattattaaaaaattttgccatgttttcatcataaatttcactctttcgatttaacttttttctcacatcacattcctaaaacacaattatgttttgaataaacttttggcatttacccaaacttcctctacagtatatcccatctttttccccgcaattcttaatctctccattttttgttgagttctatcataattttgttccgctgttagtccattcgcttgaatcataaatcccttataacattttttacatccatgaaaagcgcatccctaaaaatctttttaatattttatttcatttccattattacctgaaattcaattattctctttgcgccccaattatgcaatcgatttttaattttttatctccaaaaagcataatttctcccccgtttgcggcatgtctcgctttaactccatccctatgcattatccattcaaaatattttatcgctatgttgctctgactatctttaggctcaaatccgctctcgggaatgatgggtattgtttcactattttttaaaaatttggcacgaaaaatgctaaaaattgagttattttccttttattttggtccctacttcatgcatgatgacgcaatagttgtcgatagtctcattacatcgatcccattcggtgtttcattatctattgttatatcaataaaaatctttctcaattttataagcgctttcattaaaatgtccgtatcatttgaacaatattcatccaatttttcttctaaaatattaaatagttaacttaaatattttttctcttacctaaaataaatccattattgtaattcatataataccatttttttaatttttcatactcttcttcacccatttcatcaggaaaataatcctcaaaaggcgggagggttgtcaaaattttgcctaaattcttttttttttgtaacgacaaaaatattcttaccgtaattttcctctttattaaattgatggggaaaatataatttagagtcacaatccaaaccaaatgttttgggtaaatgtgccaaaaggttttgcattaataaccagctgtcccgaaaa

SEQ ID NO: 29307 - DNA, 665 bp, Heterodera glycines
  misc_feature (631)..(631): n is a, c, g, or t
tacgcgtcccagtgcactttacgcgtcccatggcattttacgcgtcccaacaacagtttacgcgtcccatggcatttgtgtccatggcagggatgtcattccgaggctcaaaaattttcggaaaccggaattaagtgctatccctggtctatggtattttagccgtcctaataactatgccggtattcagtaattttttaactaaaatttcgttgttaaacataaagtataataacaactcatacacaggcaactcgaacaatggcttagactaggcctaagcttttggcttaaacctaggcttaggcttttttatattagtaactttctgttgacatcattaagaaaaattataaaaagaagattctagcttatttttaagttttctatttcaattttttttcctttattttttattatgggacgcgtaaagtgtcatgggacgcgtaaaatatcatgggacgcgtaaaatgtcatgggacgcgtaaaatgtcatgggacgcgtaaaatgtcatgggacgcgtaaaatgtcatgggacgcgtgaagtgtcatgggacgcgtaaagtgtcatgggacgcgtaaagtgtcatgggacgcgtaaaatatcatgggacgcgtaaaatatcatgngacgcgtaaatgtcatgggacgcgtgaagtgtca

SEQ ID NO: 29308 - DNA, 1986 bp, Heterodera glycines
tatttgttatttcttttctcattttattttttgcctttccttcttttttttgtttgtttcattatcatatcattaacattttatcaatttcatttatcatttcatatcttttgtttattttcaatttttacaacaattttcggttgtttttaacttttttttccttttcctccaaattgcgaaggtttaaaagtcactgtgacaaagaattcgattatttttgcaagaagaaaatggaaattaaaaacaatttattatttaattatttttctttccattattgagagaaaagtgacaaatataattatataattaatttcattttttatttttccgatcattttaaatgggacgacgcctcgagggcaaaacggcactaatcactggcggcgcgcggggcattggccgtgcctttgccgaaggtttcgtaaaggagggggcgaaggtggcattggccgacattatcgttgacgtggcaacaaaagcggccggagaaatcggcgccggcacaatcgccgtcgaattggacgttaccaatcagaaatccatcgacggatgcgtccacaaagtgttggcgcagttcgggcacatcgacattttggtgaactgtgccgcggttttcgacatggcgccagtcggcgagatcagcagagaaagttacgacagagtgttcgctgcaaatgtttcgggcactttgtttatgacccaggcaaaccaccaattagcatggctaattagcctaattaaacaggcagttgcacgtcatatgatcgagcggggaaagggcggcaaagtgattaatatggccagtcaggcgggacgtcagggcgacgcattggtcaccgtttattgcgcatccaaagcggcggtgatcagtctgacccaatcgaccgggctggcactaatcaaacacagtataaacgtaaacggaatagccccgggctatgtggacacggaaatgtggcgacaagtggacaaattgtttgccaaatacgaaaagatcgaagtgggcgaaaagacacgccaaacggcgaatttgctgcccatcggaagaatgggcgtggccgaagatttggtgggtgccgcggtgtttttggcatcggaagagtccgattatgttgtgggacagactttaatgtgacgggggcagccgactgaactgagaaggaaagtgccaaacggagagaaaaagccaatcaaacggaaaaaatgccaacaaacgaatgaatgaaatgatcgaccagcataatgtatcaatgattatgccataacaaatgaaaagccgacgaatgattaattatgaagatcaaattaattgtccgattattacgcactttgtccaaaaatcagcccaaaatatgaaataaaagtaaaaatagcaacagaataatcaatcgaatatttaacttcgcataagcgaaaacattttgggacgggcggagaatggagggaattcagcggacacttcaaaacacattttcccttgtgaattcatatacataaatcaattaaccaaaaattgtcgaccaaaatatttctcccaattaacgctaatagcccaatgaattcgaattacgaaaaggacggacaaaaaaaggaggaaaatcaaatgggaaaagtgccaaacgaacgaccgaaagaaaacggaggaaaagacgaagagaaggtgagaaaaggaaagtaattagaagaagtgaaaaggtaattaaagaaaaaggaagaagcggaagaggaggacgaaaagcaaaagggaggagagaatggaaaaaggcaactgaaagaaagcggcgaagaattccgacttttggtggacgaagaagaaaaggagaaggaggaagaaagcacaaattgcgcacacaagtaaaaaagagaagggggaggacaattagtactaattaattaataattatgctaatttagcaaaagtggccgttgcccgttttaaacgaaacgaaagaggaggacacttttgatgattgatttact

SEQ ID NO: 29309 - DNA, 956 bp, Heterodera glycines
attcccgttttaagactgaaaagcggtgtgttttttggctgtgaaagtggaaaaaaattggccattttgagggcagttttgaagataaatcagaacatttaattaagtaaaatttggaagtgctggatttttcacagcaaagaatattttaagaggacttttcgatacaggaattttcgacagtatagagtaaataattttcaattttaggagtgtaaaatcgtaaaaaatttggctttaaaaagcaataaattaagccaacagtattgagatacataatttttaaaaccaataaatggaaaattttgcaatgaatttttttgattctttcatttcttgtggatgtattttctggagttttttgggcagattcttatttgttagagtgtattccgtttttattacacttttgttcacaaatttgggcaaaaggtcaaaacaaaatagaattttttaaaaattctttaaggtttttaggtcctataaaataaaaatctataaaataaggttaatatatctcgaaaaatagtttaacaaccacaaaaaaatatgttttttcatacgtttcaggccactaggagctcaggaaaaaatagttaaaagattaaaaaatgtatcactagtaataatgattagcaatacagcaatgcacattgatatgtaaatttaaaagaaatttaattcgaagcaatttattttctgttgaaatatcctttgaaaatccgctgtcgataagtccgttatgtcgaaatgtccgctgacaaaaagtccgtttagagcctccaaattagagatctaagactcattggaataatgcatgtgccagatgatttttttcgaaaattttcacgtttctaaacacttgggggatgatgagtgatcatcagatcaaggtgggtaaaagacttttcgatcagaccttttacagcgaaatttgggtcaatttatggggacca

SEQ ID NO: 29310 - DNA, 1276 bp, Heterodera glycines
ctgctccgcgcgctgttcaaacgcaacccagcaaatccgttgggcggcggtgcgcagggggccgccgcgctccgtgaccaccgcttcttcgcctccgtcaactggcagcggttggcccagcgccaggtgggtggtggcggcgttggatttttttaaaatttcaaataaaaaaagggatttttttgctatttacaaattgcaattaattggtaattccccattttttcaaggttacgcctccgtttcggcccgcttttggcacttctattggcgtcggttgtgatgccattggagcggacgcttcgtcttctgcggcattagcattggatgttgcccattattttgacaccgaattcactaagcgaacgccaaaggcgagcattggcttcttttttattctttctctatttctcttgctctctctatgtcaccctccatctttatctctcatctctctctccctctccctcctttatccccacattttatacctccattttaattcccttcctccaggactcgcccgccgtgccgccgtccgcagccgcccacgagctgttccgcggcttcagcttcgtgtcgcccagcattctggaggaggacgaggaggagtttgccgccgctctgctcaccgcgtccggcagccgcgtgccgagcccgctttgtacggtggacagttccgcgttggcgcagcgtcggcgccttcagcgcggagtcggcggcggtggtggtcgcggaagcccttccggtcgcgtcggcggtggcggcgtctgatttagcactgtttcctgttttgttattattgctatcggtgtatgtgtgtgtgacttcttcccatttatgacaaattatacgaaattgttgttttgttttgttttgctcgtcacaaatgtgccgtctcccccactccaatttttgtctcatttattttaaaattttctctgttttttttctctcgttttgagccgagcctttgtgacaacgacacaattatattcattatcaatcattcatttaccagtgacaaaaatgaagagacttataataaaatattatttattttctgtttttttttgtgtcctcgctgccgtatctatcattatatttatccacattgactgtaaatggattggcggatactgtaataatcttataatcgcattgtttgccttctcattttcgcgacctttcttcaacataaagggagtatctcgagctttctgggaaatccataaccttaatggctcagaaaggacatatttttgaagctcaaaga

SEQ ID NO: 29311 - DNA, 1257 bp, Heterodera glycines
ctggtgctccggactgtcgtgagcctcctgggttgtccgtctccaccgggttgtccagatggaccagggggtccgggcgggcccgggggcgacactccgcagacacagcaactgcctgcctggcgcttgtgacgtctgtcgtgcgacaccttggagtaggcctgggtgcgggtgacctgaaaatttgttgaaattttttgaaaatttcctggcttttcccctccgctttttcggctttacttcgcgccacatgttgccggagcgcattttgcagaagtccacttcgttctgcatttgggtgccaagctgctggaagtgctggtaggcgaacggcacggaaatcacagcgataaccgtggccacggtggacaggcacacgccgaagaaggccaaagtgcggagcgactccgcctcgcgctgggcagcgtgtttgtcaaagtcagaggaggaatccatctacaaattaagggcatggtcatcagcagataaacaaatttttgtgcgtgggagtgaaacagccaaaatgagtcatgcttggatcacaccatcgccataaacagaagtaaatgacatattttgctgttttcaatataattaggataatgaggggcatggaatatcatttgaacagttgttgaagctttttgtaacaaactgacctacccccaattattgctaattagtggggatatgcctttaaattaggcccgtgtctgcttcttctgctgttgctggtccctgggcttttccccttggacagtgtcagccttttggggtgttttgcttctgctctggcctctttccactccccaattttgggaactgatcgctctgttccaatttgggccccttaaataccgattagccggccattattttgttgttgtgttatgagacgacactcactcgcttctcccggcactgttgcggcgccaatttcagtttaatgtgtccattaccgacggagtagcggcggctgcggcgaccgctttttgtccgtaggggtggaactttcatttcatttcatttcaatatcgggggcgcgatccttagagttccctaattgtctccagcagcaatttcttttctacgattagcgcacagcaaaaaccccgggggcaaaacggacggacgaccccaatttgccgaaggggcccccccccccgccgcggggggaaatagtattttcttgtccatatttttaggccaaaaaaaaattaataatgttttttttggcccgaaggaattccttccttc

SEQ ID NO: 29312 - DNA, 642 bp, Heterodera glycines
tttcagtgggttttcgtatatttaagctaagtttgaaccaaacatgagaaaatcaaaaatgtgaattttcgactttttgttagaattcgggtccggggaccgaaattggtcgaaatgggtgccgaattcatgatcagcgaccccgaaaaccccataaaaaatgtttttatgacttttgaaaacataaaaaatttttcgaaaaagggggggggggacaaactgcactattaccaaagtcaactttaccttttttgagttattccattagccgttctctgctgcgctgacccacaaaatgtccaagtctcgaatttgagttttttattattcagatgggcctaaggctaggcaaggggtaatataaaggttatattcgtattcagcgaccccgaaaaccctaaaaatcctaaattagactcattttgtttttataaattttgaaaaattttggacatttcgtgggtttttactcttttggacatttcgtggcttggacactttgtgggggcgccctctgctgcgtcatttcccaggtactcaatcgtccatgtcataatgctcctcccttttgctgtcattttttcaaatgcattaacttaaatgaattttattattgtataagctgattgtcacatctttcat

SEQ ID NO: 29313 - DNA, 1704 bp, Heterodera glycines
  misc_feature (1586)..(1586): n is a, c, g, or t
  misc_feature (1655)..(1655): n is a, c, g, or t
aatagtgggcgaaaaagttccattagggggtgtaattttttaaatagttgttttttaatttgaaaataatttaaaatgaaggcaaacaattttttcactgattgcagttacaaaatattttcttagcaaatattgaacaagaaaaaaaaaattgggggaagaatttttgtgaaatttttccaattcttggggggtgtattttttaaaatttttaggtagattcttaggggttgtattttttgaattttttaggtcgattcttggggtgtatttttcgattttattgcattttttgggaaattttccaaaaaataccaaaatagtggcaaaaatgatgacgaaacgccaaaatagtggcaaaaaattattttagtggccaactcccaaaatattttttttagtggcaaagctccaaaatagtgattcctaaaaatcgggacttttatttgcatatttttgcatatttcgggtttttatgcatattttggatttttctgcatatttcatgcatattttgccatttttcgtcaaatgtttttcgatttgaatagatcttaggaaaaatttgattatgcctaaaattaaatccaaatttgaatggatgcgcgagtgagtcaacagtgaattttccatgcgaaaaattgaaaaatttttgatttgaaattgcaaaaacaaccgataaaatttatgaggaataaaaattttttaaattaatttgcacccctaattttcaagttttttttgtgcatatttcacgactttatttgcatatttatgcgcctattttggctacttttcgtgcatattttttgcagccctaattgtgatataacacttttaggcagagttgcggcattacggaaaagtatcccaaatttttgaaaatggcaaaaaataaaaaataggataaatgagatatgcacctaaaatgccaaaatagtgacatagtggcaaaaagtgcgaaatagtgacataatttttagccaacaattgagcaaaaataagttttatactatttgcaattgctaatgagtagcatctggatttttaagggcaaaaacccaaaataggtacctaaaaaaattttttaattaaaaattattgccaagaaatttcttgggagtgagtgtatttttgaaaatttttgcgtcgatttttaggtggtgtatttttcttgaatttttttaagccgattctttcggatgtaattttcgtttttattgcatttttattgagaaattttccaaaaaatgtcgaaatagtgaaaaaataatgacaaaatgtcaaatagcgaattttaactagagtaccacgggaccgggaaattttgccaaaaccgggaccgtgatttgccgggacctgcgaagctgggaccgggaccgggacctcggtttttgtccgggacccggaccgggaccaaccgggaaattttaaaaattcaaaaaaaatttaaaaaataaaaataatacaaaattaaatttttatttgttttttatttaataaaatccaaaagtaaagctaaattaaattaatgaaattttcaaatcaaattttctttaattattttaagcaattaatcattttgngctaaatgatcgaatattattagaaattcagatttgcttttcacatcacattttttcggcgcgcttttncccaagactttttgggaagaaaggggtccgacggtgccgataagcgccg

SEQ ID NO: 29314 - DNA, 1062 bp, Heterodera glycines
  misc_feature (45)..(45): n is a, c, g, or t
caagcaaaagagaaagtcgctgggatgagatatgtgttggatacncatcagtcttgatttcaaatatttccgatttcattgattttcagggtgtccgtgttgaaatgattgttcgttaccgaaatgaaagagcgattataatttttctaactaactatagatctacgggagcgtgactcccgcgggatttgcgatatttctgcgcgggattcccgtcccgcaacaaaattaaatttctcgagatttcagatcgagccccaaaaaaccaacacttttctcgaggtagagactcgagaccagaacttttttttcaaaaatttttctgtacagttaaaaacggattaaaatattaaaaaatcaatttctgaggcttttcataacaaatttttcttttattcgaatttttattcattacataataccaatcaatttttaatttaaacaaattttttacttgcgcttttaaaaagtacgagcaagctcggcttagcactcgaagccgaaggcgaagcacgaagcacgagtttcgaagcccaaaaacccgaagttttcgaaccacgaagtttttcaaaaaaatttcataccaaaaaatgtattaaagatgtttcattggcgaaatttagtcccattaatcccggccaaatggctgagaccgggcgccgggacttggaaaatagaccgaggcgggaccctgggaccgggactcccggtcccggtggtttatccaaaaagacgggaccgggccaggagtcccggcagggccccggtcccgtctagtctctaattattattttcatcattacatttcgctaaaaaagccatttgattattaactttttgttggttactttatcttggcaatttctctgtttatttaaagaaaacgatagaaaataaagtgtgcgatgaaataggaaaaaagtccgactacggtatgtttgatgaaaatgcgcaactgtagtccaatacagtatccgcaacaaataacgacagaactcaggacactcataccacacagtaattaatgatcactaaaagcaacagttagtcatcgccaaagtg

SEQ ID NO: 29315 - DNA, 1199 bp, Heterodera glycines
tttttgggtttttgtttatttatatatatttgttcatatgtatgggatgctcaattatttctctttttttttgataattatttttttaattttatatttattgcgattctttcctttgctccttggccataacttatcaataaattattattgacttatcatcttacttacatatcattctaatgaaattccatttgatcaataatgttccaaggcattttatttaaaaaaatattattttaattttaatttattctatttttaatgttagaaactaaaatattatcattaaatatttttggaaaatcttgtctttgaagttttattcatttaaagagcactatgcaatgttataagggttttcgcgttgaaatttttttttgtctattataaaattattattttccagaaaaaaagaaattttcatttccaaaaatttgttcaaaactgtttaattttattaaatttttacaaaacttagcagtttcattcgattggtccataatccgttgaagtcccctaattagctgactgatccttccctcgtctcgtttcatctctcccccctcgcctctgctgatcaaccaaccatccaaaagcaaatgctgttacttttaattcaaaaaacatgtccgacgagggccacccaagtgttgtccatccgcaagtgtccgagcccccaacaaatgtctgggcatgcttttaacgcacccaattttttttaaattttcgtctgctttttgtcggccttacatatgtaaatgcattttcacattaaatttaatcagcacacatattaacttccccacacaatttatttctgtctcccccccccccccttttactgatttcatttcaattcatttcttccgtcttcttctatccctcctcctcctcctccttttcctccccggtcttcttcttcttctgctgctgctgctgttctttgtgctgtttggcgatgtgttgtcctccgttcccaacaaaaaatgaatgaatgaaaatgaaatctctgtaccgtcagtcaccactttcccaccttttcacacttattcatccattctttcacattcagccaaactctctcttctcttcccccccccatcgttcaccttttgcttttttcaatttcaattttactcctcgcgcaccgtcgcacacaacaaaaaggcacaatttttaatctatcgtaattcccc

SEQ ID NO: 29316 - DNA, 1431 bp, Heterodera glycines
  misc_feature (17)..(17): n is a, c, g, or t
  misc_feature (61)..(61): n is a, c, g, or t
cccagtcatgtctcgtntacgaaattgctccctccgcgcgccgaatctccgaaaaaagttntgagcaattgtggcacatccgtcctgctgttcgagttcccgaattagggcatttccaagcccctggaaaacgtgaaatggcgcggggatgatccggtcaaatccaatggacaggagaagcggtggtttcgtgatccccatcatcgccgatctgaccgctgcgtttgccttttcgccattcaccatggctctggagaattgctccgcgaattgcacagtttgatcaattgtccggagttcgcaaatttcgccctcctgcaccaaatgatcacttctgcaactgcaaattggagacggaaatgttgtcactgcagaaccacaatgcccgatcattgaccaaataaaactgacgtctccgcccataaaccttttgaattcagaaaaatggaaaaacaaattttaaaatttaccacttgactcggttgcccgccaatgtgcctattccgtcaatttgttcccaaagtgtgcttccatagcgctccaagttttcgcggctatccttggtagggaaaacggcacagacgaaattgtttgatggagaatttgaccgagcagcctggctgaatgagacggtaatcttcgtacaactctggccatggtcgccgctcagctttatgtagatttcgtcgccaaatctgatcagattgtccttggcagatgaaagacgcgcctccagagctgcctcaacatcagtgcacacaaatccaacacctgcactagtctcaattggtgcgtattgcaatgacccacagatgcggcgtttgatgtcaagcacctaacaatattcaattgaatttttaaataaatataaatgctaaaatttgtttttactttttcgagtggcgggaacacatcaaatttggcattgatcaggcgaatagtgctttttagtcgtctgtaagccttctgtgtaccgacaagcccgaggatcagaagagcatcctctggatcaactgactttttttgtcttgacagttgttgtttcttcttctgtggcgtgtaatgagcaaatttgtgccgaacttcccgactgatccgttcgagggacgcccggctggctgagcgtgatctgtcccgttttattacagccgcgatttcatcggccaatttgcgacgtgaggtgcgctgcaaatgatcgacattcatctttggtcgtcctgttggggttgctaaaattaaaaaagagaaaattatttgaaaatataaaaaggggattttagtttcactcacttttgctggtggtcggtgtctccatcggtggtgccatctttccctccaactgccgccgaagcgcagtgatcagtgcgtctctgttgcggacctgctgtcgaagaaactgatcgtttgttctgctccttcgctgtttgtcca

SEQ ID NO: 29317 - DNA, 1982 bp, Heterodera glycines
taaaaaattacatttttgaatattggaggggaggggtgctgcaaatgtaaagttcaaccggaatgaatgtttcctaccgcgaacgacagtcgcctgcggcacggcaggtgggcctcggcgcgtaagtgtacagactgtccgtgtaggagttgctcaacccagctggaacaggggacaaaaaagcaaattaagtgactgacagactgacgaaatgggcaaaatgagaaatatttgcaaaaaaataataatcttgtttgtaacaacatttagaaaacggtgcacccctttgaaaaaatcgctggaaaaattttgaaatttttttttcttcgaattttctatgaaaaaatttgaaacgacggtgggggggggggggggcgagctgcttccgataaaaggcataaaaagaattaaacacaaaattgtgataaattgaatacaattattggacatgcctcggttgagcacgacggggtcttgaaaagggaacattgtcgcactgagcaggtaattctgggagccagcgcactgcaaacacaaaatgatcaaaattaatgcaattaattaatcattttgttggcaatgactgaccggcacaatttgcgagtcgggcggaaattgcgtctcgcgctgctgccgattttggtggagcagtcgccactgttcccaaatctgtcgcaaaaaataataaaatataataaattaaaggcccataaaaacgaatgaaaaagccaagagttgaaaccccacacctcacggacattttttggccattttctcagggtatccctaaaaagttttttttttggacattttaaaaatccatgggattaattacgctctatttattattttcaaagaaaatgccaccccctaaaagatggaatgaacaaggttttttctgtattttgtttgtttgtttccttacgtaatcaatgaaggaatggtgaaggaagaaaacggggtcctgtggcgaggtggtcaacggcaactgaaacaaaacaaaaatacacttttacaatttgcacattatttgtgatggaatgccaataacccagggggtgagcttattgttttcgcaacccagaaaatttgataaaaaaattcccgatggaattcgaaaaagtaaattgcgtttttatgggtttatgtcgcgggtacacgccaaaacgtcgtcggccgaaacgtcgccgcaaaaaataataataataaattttcaaaatttcaagaaattgaaaagtattttagattttttgaaaatctaattgttaataaaactaaatttagctgattttccggaaaaaatgaattttcttaataaaaatttctttttgagtttttctagaattttcttcgtattaggtaggctagaactaaattttttgacaattttttcttggttttttcgttttgtccggcgacgttttgtcctgttcccttatgtcgcatgccccgccaaaaaatttcgaaacggggaatccgaagacatttttttttgctgctaaaacttttctttttctccagtgttttgttcgaaaatttcggcaccggcggaaaaagtaaaaaaatcatttagccggccgtttttcactgaaaaagacgaatttttttgtcattttggatttttttaaaaagattactaaacggggattttcgacggtgccggaattttatttttgaaaatttatttgaatttgttaaaataaaagtaagaatttcacaaaatagcccataattttcttgaaaaagtccattcaccatgtcccctccaacccaggcgtgcactccgttgtggatgaactcgagcacactgagcgggtttggcgtcggttgcgtacaggcgccgctccgtgcctaaaaacgtcgaggaaaaacacaaatattggaaaaaaaattgtttttaaacaaaattaccctcgacgtaaatgccaaaacgttctcaatttggggctgtccgatcagactggccactcttaagcaaaaaa

SEQ ID NO: 29318 - DNA, 1773 bp, Heterodera glycines
atcattacatattgtgtgacaaaaacataatgatgccaaccatttgtttacccttttaatatgcaaatgcattaattcattcctaaataatatgaaaaaataaaaaacaacgaaaggaaaaaagataaatttataataaagaaattaaacccaaaggaaggaaatcccaaagaataaaattcgtataaaatggaaacaattggaggcttttaaggtttgatgctttcattaataatagcaaaaagtatgggcaaacacagaagagcacggaaaaggtcacaacgatgaaaagaggtgaaagaattgaaaggagagaaaagaaagaaagaaagaaaggagagaaaagtgaattaaagcagcggaaggaaatggaaaatggtaaacttggaaagagtgagaagggatttaaaattggaaaaaagaatttaaatgggcaattggcgagacttcctggaaaatcctctatttaacagtgagaatcattgataatgagtaggtattttcttgaaagaccaattgctgaaatttgtcaatggatgcgcagaatttcaacaataaaaactcattttaaaatattaaattctgaattccacacagctcagtgtctcctgctgctgctgctgtccttgagcaataatcgcataaaacttttgtccactgaccgtaaaacatttctgccatttttcaccttcccccattaaccaatgcccccccccccccctctgatcactcgcaatttgcttccaaagaatgctttctttcctcccttttctccccgtcctccgcccgcttcgccaattcgcctcatttttcgtcccatcgctttccaatcaatcaaaatcatattattttgatgcttattatttgatagcgtgttcatgtgttcctcccttcctctcttaagccggcagcaggcgaagaatgaattcgcaattcattcgagtggaaacaatgggccgacggagggggggggggggggggcaaaaaattcccacgacaaattgccctcaattttcgcgacacaacggagaaatctttccgtttttgtcgttctgacataagaaaaaaaggaagatgacgacgatgaagatctaatctaatccctctcctcaacccaccattctcctcatattttcctcatttttttgcacaaattacgcaatttgaaacacaccatcaaaaggatgttgagaggggggggggggatggacacggagggacaattgggacacaacagatggaggagagggaacacaagagggaggaggggacattggcggaaagggtacaggggaatacaaaacattgggcgaggggacggaattccgaaggaccaaaaaacaaaggagaaaattggaatgaaacagcacacaccacaaagatatgaaaaaaggaaaaagattgggtcaaatgaggaggggggggggggggtaccataaaacgggatacgcttttaagtcgagatttaagcaaacggtgtttttcaaaaaaaggttcagtgcccgtctcattcaaaagagaaaagcctcccttatgatgggctccccaaggggctttataaacagtaatgttttaatatttcgcaacaattataactgttttaaaaacaacccacaatggatttgttgcgctccatgtgaccacttttggactgtttgtcagctgctgtctctgcgtctgtctgttgttggccgtcaaaagacaaaggcacgggggagggaagcaaaatgaaaggaagaggaagaaaagcggggaggagcagcggacgaaggc

SEQ ID NO: 29319 - DNA, 1314 bp, Heterodera glycines
aaaaatttctcgtaaaaaaagagatagccatttttctggcatagagaataaatttaaaatttccctgtagaatagaatggccattgctctccgccccccctctgcccatgctgggaacatttgtatggtacaaaatttctcgcaaaaaagaggatagccatttctctggcatagagaataaatttaaaaattccctgtagaatagaatggccattgctctccgcgcccctctgcccacgctgggaacatttgtatggtacaaaatttctcgcaaaaaagagagccatttttctggcatagagaataaatttaaaaattccctgtagaatagaatggccattgctctccgcgcccctctgcccatgctgggaacatttgtatggtacaaaatttctcgcaaaaaagagatagccatttttctgggcatagagaataaatttaaaaattccctgtagaatagaatggacattgctctccgcgcccctctgcccatgctgggaaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatagccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaattaaaaatatcagtgcccaaaacatggtatttagaccaacatgtccatctgaatgtggtcgaggttggatgaagtaatacctcacgcctgaaaacacatggattgcccactggaaaaggattcaccttctaaattcaaattcaaattcaatatttattgacaaaaagccccatgacttatggacataggctaactatatcaatgcacaatatctcttcatcgtctgagcacgcatgatgaaaatttaaatgggctccacacgaccaccacggagtgcatctttttcgtgggatcctatgggaaccgggagaaatactgcttccaaactctgtttgatgtccaatcccccatggaggcgttctttccactcacaaccccat

SEQ ID NO: 29320 - DNA, 1737 bp, Heterodera glycines
cttcatcaagacgagcacgggcaaggagcgtgtcaacgccactttggacgccgcttttgtcatgtgcttggccatccgtcgttactcgcaactgaccgctgttactgctgcggtgccggacggagctaacggcgggcggctcgtcggttttaaggcggcgggcagtgttcgcaacgcggagcaggcagcccactacgcgttgttgacaagtgaactgctcggggaacagtggacggagccggcactgttccgcatcggcgccagcgtgccattgttggacgacatttgcaatcgaatccaatcagtcaaataaaatgattgttcgcgcttggtgtgtaaatgtgccatatttaattgtctgcgattcaattgcattccataaatcttccaaggaaatttttaagaataaatgtgtcctttttcttttttttaatttcgagttttcggttaaatgtcaccagtttctccgctttttctcattctttcaccattttttctgataatttgccttgttttttgtccaattttttgttatggcattgcttaatcagccttcttcctccgctactcatttgaccattgtcacaaacagtgccatggaacttgcccgggtctgtgtcattcgctcttcccaattttcccattttaaatccgttttccctttctcaggagttgcgtgacaatcccgacaccattccgccgtacaatgggcgcactgttggccaaatggtgcgcagcaaatcaccgagttgtacaacgagaacatggccactctgatcgggtgttttttcatttccggcatagtccaacaaataagatttttttatttttgaaggccgaataattaggcggttcagttggatgtttcaaattaattttggaaagccatgatttatctgtcaaatagctttgccttttttagcttgaagaacggcactttgcatgaggaggaggaacaagcgattactatggtaaaagagcagcagatttactcgtcccggggattaacccattttgcaaaataatggacaaatcactccctaaaattaatccttcgccataccacccaatactccctaattttatgtgacgaagagagggatttgcatcgctaatattgccattagaagagtcatttttggtgctgctggagggagaccgacttaccatttatttaacaatgggtggttaaaaataagttttttcctaaaatcaaatgccataaacacgaactccgtctttcaggttcgcattcgacaggcagccattgaccagataaagcgctgctgtaagcaacttaaaaattgctttaataaatgcccggttttaatccctttttttgtatatcccttccttccaatggattgattacttatttcacattattattccaattcaaaattgttttttcttttgcattttaccgctttcccccgttttgccttccctcaggctgcacttacctcgtcgagcgaatgcagcgcctgcggcatctccgctggacctccggcggacaagtgcccgaggcaatcaaagaggcgctttcggcggaggagcgcacttggctggccacctacaaccagttggtgttcgacttccagaccaagtttggccaagatgatgaggacgaggaggagccaggacaagggcagggcgaaggacagcaccgaggcgacatgggcagcacctcgggggacggtcagtcagtcaagggagtagcgaagaaggggggggggg

SEQ ID NO: 29321 - DNA, 998 bp, Heterodera glycines
taaattagccctctcaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggtcaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggtcaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaatttttcttcgggctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatcactttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcttgcaaatttgtaccgatcaaagggaaaatgg

SEQ ID NO: 29322 - DNA, 1108 bp, Heterodera glycines
  misc_feature (1091)..(1092): n is a, c, g, or t
  misc_feature (1100)..(1101): n is a, c, g, or t
tgaattttgacaaataaacaattaattctttcatttatttttgtgcctttataaaacaattcgatgggattcggtgcgacggccaattcgtccaactgcgatttgggggaaatgaataggcaaactcaagaaactttctcggaagcgttttttacgagttccgccagccgttccctcgtcataatgtctccctcttcgaagactctccccgtttttttgtccacaaaaatgcgcctaaatccaattgaaaatggacaattaagtattgttattatttataattaagtccaaataatattctcagtgtgtccgtttcccacttcaaattttggtcctcttcgatgtcgtcctctttctgctgaagaaccattgccaaatttgaggagacctaaagcggaacaaaatgaatgccattggcagagattgcagcggacgggaaatccgaagcgggccaatttaattgccggttcgaacagccgtttccaagtgacgcggccgctgccgaactttgtgaaagcggtccaaaagccgtgcaattccccgggcacagcgatggacctaaatgaaaatgaaaaataaattaaataatttcacaaatgtttttgtgccctttcgacctgtatccgatgaccgagtcgcgtggcgtgccaacgtacatcgtcgaattggtgcccagcggcgcagtctctcgcgcgtcaattgtcgtgcacctctgaaaggcttaaaagcaattggcaatcaaatgagtgaacgctttgcctgcgtgctggtgttgtacaatgtcattatgaagccaccgccgaggcccgacgactgcggattgacgacgccaatgcacagcaaactggctgaaatggcacattgggaatggggaaaaggggggggaagagtgccaatgccaaccgatcatcgaatcaacagaatttccgccctccagcaaaacatcccttaaatgaagcaaaaattaaaacaaggaaatttctccgaaccttccgatttcgctacaaagacctaaacgaagtttgagttgccacacgccaatccgataggcaacaatggttaattacattcaattaattaattccagaccnntgcaggcnnatgcaag

SEQ ID NO: 29323 - DNA, 133 bp, Heterodera glycines
gggtatctccttggacgtctgtgaaagttttttcgggaataaaggtgaccaccacttcggtgccacctgattcacgacggcggacgcggcaatcgcctcgtaaactttgcgcacgatcgcgcattattatcat

SEQ ID NO: 29324 - DNA, 1829 bp, Heterodera glycines
  misc_feature (923)..(923): n is a, c, g, or t
aatttttaaaaattatcagcgatttttaggccgcttccagtgattagaagaggtacaaaagtgattagaagtggtacaacagtgattagaagaggttcaacagtgattagaagtggtacaacagtgattagaagagtgattagaagaggttcaacagtgattagaagaggtacaaaagtgattagaagaggtgcaacagtgattgaagaggtgcaacagtgattagaagaggtacaaaagtgattagaagaggtgcaacagtgattgaagaggtgcaacagtgattagaagaggtacaaaagtgattagaagaggtccaacagtgattagaagaggtgcaacagtgattaaaagaggtacaaccgcgattagaagaggttcaacagtgattaaaagaggtacaaaagcgattagaagaggtacaaaagtgaattaaaaaaggtacaacagtgattagaagtggtacaaaaggattagaagaggttcaacagtgatcagaagaggtacaacagtgattagaagaggtacaacagtgattaaaagacgtcaaaagtgattaaaagaggtacaaaagtgaattaaaaaaggtacaacagtgatcagaagaggtacaacagtgattagaagaggtacaacagtgattaaaaaacgtcaaaagtgattaaaagaggtacaaaagtgaattaaaaaaggtacaacagtgatcagaagaggtacaacagcgattaaaataaaagtcataaaatgcgccgtatttttcctcattttttaattatttgattgtgaaaattcaccctccctaacccgagttacgaatttttgaaaattacaccaaatataatttttttgacaatttctaatttaaaaaacattaaattctttaatttaaaaaaataattatttttaaataaaattttcaccanaaaaataatttaattcaaatgaaaattttttatttattattaataaaataaaaatattttaaataaataaaaattaaaaataactcaaaaataaatagaaaaataatgttacaccgtccggattcgaacctgccccccccccccctcagaacatgtcccagaatccccaatcacacagggattctgaggtcttgacgatgtcaaaagtaaaatctgatcacgtattcgtgatcagcggcccaaataacccctaaagacatatttttggaagatttttgtgagaaaaatttttccactcaaaaatcctggtcacccccctttggtctcgaatctcaaaatcacttttatttttataaaaattcttaaaaaagtgataaaaatgccaaataaaatttataaaatagagctaaaaattgcggatttttgtagtattttacttttcccgaatagcttttcagaaccgagttatgaatttttttctgaaaatttgaatttttccagaaattctggaataacttttttcctttttaagatagaaattccaaataaagtccataaaattctcctgatttttctctatttttaaggctttattgctgtaaaattgatcaacccttcgatttgttatgaattttcaaatattaggccaaaatcccgagggccaaaaaattgccaaatattttcgaatttttaaaaaattccaaaaaatctgaaacgaaaaacaaaggtcatattcgtgctcagcacctcaaaataccccagaaaaatatttttcaccctctttttcaacccaaaaaaaatttttgaaaatttctagggggcctagctcgaaaatttttgaaaatttcccttcatatagtataccattagatagagctttaaaaagctctacaattttgcactaag

SEQ ID NO: 29325 - DNA, 1481 bp, Heterodera glycines
  misc_feature (1457)..(1457): n is a, c, g, or t
  misc_feature (1465)..(1465): n is a, c, g, or t
ggggacctctagagtcctggtatcttttgaattcaaaatattatatggccttttgtttatttcttttattttgattttttccattttaaatgggttttggtgccatcgaatagtctttttcccattttgttttggttttcccaccctcaccctccacaattttcggcataatgtccgccgattgggtgcagtacaaacagcaattgttgcgtgcctatttcttctccagcagtcccattgctccccccgactcgcccttccacaaggaattcctcgcctttttggcgcgttgcgaggccaaagtcgtcgcttcatcagcgagtgttcagaggtggccatttaaacaaagaacaaaaaaaaggcagtggaaatgccgtgccaagatttttgaaattatttttaaaacattttattgcggtaaattccgtaaaaagtggcacttcgattgaattcatttgcatccgtttaataacaaaatgctttcctccaagggatgtcaaaaagtcggacgatgaccaattgtcttctgcctcggccgacccctccgattgggcggcggtgccgtgcaattccaacggcgtccccgccgggccttactccaaatatttcgcctcctccgtccgactgagtgacaaagcggtggaccgattccaactgatgcgaaatgtgagggcaaaaatagaaaaacgaaaaactataagaaatttgaaattgacaaatttaattggtatatttaaaagtcccaaattgggcattacgggggtttactccattcaaaaacagtcccatttattttcaaaaaaacggtggattttgtgctttttttcgcaggtgccggccgaagcggtgcgccaatttgagcatctcatcggcctttattaccgttttcggaacgcacgaaacttcaaaaagctgaagaaactgaagcagtcccaactcgaactgcccatttaccaaagtcggacggaaatcctcgaaaaattggaagaagtgggcggaaattaggggggaaatcaaaaataaataaatatgaatttccagaaccaaatcataatcattgcgggggacacgggctgcggcaaaagcacacaggtgaaagacatggacacaaatttggggtaaaagtgccaaatttttaaaaaagaaaggattccgccccctttaccttacgtttttctgtttttgctttattttcgtgtttagctgccccaatatttgttgaacgcgggttatgccaaaatcgcatgcactcagccgcgacggattgcatgcacaggtcgaaaatggggggggggggggagggagaaaaaaagcattttctcagagttcaaattgagactttgacaaaaacaaattgtggttttatcaaaaaaatgacttagaaagtctcgacaaatccgaaaaatcacgacactttttgttaggaatatagtcttacttttttctcgattgtcaanttttaaangtttttggcttttcct

SEQ ID NO: 29326 - DNA, 1341 bp, Heterodera glycines
ggtgtctctttgcgctaaaaacgaacaattttattttatttcaaaaatcagttcgtctccaaaattacgacctttttttcgcgtccgagcatttcgaggccggggaaggcgtttcgttcttctttcggttcttttcgcctctgtgctgcaaataaaatttgattgtctattgtcaaaaccacaaaaaaacgtctctcatcacatattttgctgtttggggtagtagggtaaaaaggtgcgaccttttcaaaaaatgaatccaaaaagttctcccccccctgaagaaatcgagaaaagcgagtaaattgcacattttgaacctaaattaaccctgaacaaaaccgtatgttgcagcaccggtggtggaggagtcggaggaacgtcgtaaaagacagaagagcgcttcgaaccatcggacgaggtcgacatgacagtatggtaaatgtgacccgggggaatgctcaactaaatataagcatgcatttgctgaaaaaaattcccatttaaaccttcttatgctgcgaatgggaatcatcggcggacgaggatgacgaaatagtgtcgtaaatgtgctccgggggagtttccgggccagcgatacctccaacaacctcctgaataaaagactacttaaattttgcaacgaccaaagttttagtcacaaaaacaacctgacgacacgtgaggcccgactgagaatggatggcggcggagaatggaaattgtgaggcctaaaagtgtaacaaaaaatgatttcgctaaaaaagagcaagcacgagagcaaactaatgctccatcataagaaacctgagaagtcccggcttgatgttgcaaaggggggttggccaactgagaattgggcggcgcagcagccggtggacaattcgtcggaggagcagaagttccctgaaatttgtggtcgttaatccgattaaaaagaatgcaaatctcgagtacttctgccgtgaggaaatccaacagtttgccaatgaatttggtcgtctcgttgtcgccctccgccgccacaaccaaaatacgccatgagtgtgcgttgactccaccgcaacggaaaaaggcagcccgaagcttaaaaaatataaatggaaaagaaaacattatccaattgctacagatgagcaacaacaattcacttcttcaggcgacactccagccttgtcctggtcgatttcctcatacggactctgaatattcacataaacatttaaacataacttttctttggactcggaaactcataaattttctgagtatcgaagaagaattgaaaagattcgacaaaaccggcttgggatatacgtaaagaaccgtctcatacaaaag

SEQ ID NO: 29327 - DNA, 1208 bp, Heterodera glycines
aaaaaaaattcgatttgttcgaatccctgtccggggttcggaattagtcgaaatggatgtcatattcgtgatcagcgaccccgaatacctctggaaacacaggccattttcggctccgaattcaaaagttgttaaaattaggttagggagttaaaatttatcagaaaagagccctttcaattaagtatgtaaaatatatattgctcatcgtctgcaactttaatcccacgaagcgacgtgcccggcgcaacaatggcaagagaggactactgcttcgatgcaacggcggcggagcagtctcgagcacgaatatgacatttacaaccaattcattttgaacaaaaataaaagttaattttggtttgcatattcttgaaaaaatgtttaacacagactagtgggtctggaccaatccacctaaaaacaaggttttaaccaattgggcaaaacagttccatatcattgtagagcatttgcgatccaacttaaatgaattgcgggcaaatttgctcttctctccttgctttcacgtgtttttctcaaaaatattttgtcttgctacaaaaaaggaaccaattcttttttgcctgttggtttaatttgtggttgggttgggacaagaggtccaaaatacaccatagtactttaaaatatttcccagcctaatgggtttgaaccataaccacaaaaacacaaatttaaccaacgagaccacttttcgctttaacattggaaactgactggcaatggggagggggcagagaagtggcgatagagtgtaggaaaaaaggagaacagattgttagaggaccgacgacagagatcgtttgcctccctccgttaatgggtcggtccaatgccaaattattttaaaaccgatttttttttccataattccgtcttccccgccttagggcacaccggacggatgaacgagcagagcagtcgttcccatgccattttcacggtgaccgtcgaatgtgcggagacagtgaaagccgctgacggacgccaactgctcacttagggaaaattgcacttggcgggtggtgattggaattacaattattgctgtaacttttatggaaattccaaaatttcagcgacattttcaaattgttttctttcccttagggtagtgaacgccaatccaaaaaaatgccactggcgaccgactaaaggagggggcgaaaaacaatttgtccctc

SEQ ID NO: 29328 - DNA, 1542 bp, Heterodera glycines
aaagcataaattcaaattttcgaatttctcgttgtttaaaatatggtttaggtttggtcttaggttcaaatcttccttatggtgtgtataatttaattcatttaagaaaaataaataaaataattaaatatagatcgtcaaacacatcaaaacatggatctgatactgttaatatatataattttatgaaaatttttaattcgcggccacagtcataacatttcctcataaatacttttgtcttttttttgtaggcaggtatgggcccggccgcttcgcggcctcgcacccttctacatttattagcattttactcttcttttttggcattttcttatggccaaccagcggcactcattctccaatttttagcatttccatctttgtaggcttaatcccaaaaatcttcggcatcccactcattgtgactcgattctctggcattccaaacaaaatcaaaaaccgcattttaactaacaaattcttttcaattatagtattaacaaattcaaatgaaaaaaaaacattaactaataaagaaaaaacttcataataaacaaaaacaggaatttgaaacaaacgttttcctctttcttttaccagatttttaaacaaataaaagatggggtataaaaaagggaagaatgagagacaaattttctattgtctctccctttcctttattttactctcgtttcttttctattgccatttactctccctttttccctcttccacacacacgcacgcttccaacatactgctgctgcacagcagtacgcgtctgcctttccctctctctacttttttcaaatcattttttaacgcaaaaacaatacaaaacgccacacaaattcaaaccgagacacatacaaacatacacacattcatctttttatataaggactgagagcccaaaatttactcgccgtgttaaatagtaccagtataacgaaaactttaaaacgtatttatagccttttctttagaatccctgagtcgtttaataattgtagtcagtaaagacaagatttatttaacgaaggacaatgccgcgccaaataactgatattaaggtaaagcgatacaagcaccgatttgtttatgctttaattaacgtcatttagcaatttctgctgactgctcgacgcaaagacgcgaagtcagtcaagatcaagaagaacaaagagaacaccaaatttaaggtgctaataattcacttttctcagtccttttttccggttaaggttcgctgtacgcgctttctttacactctcgtggtggatgacaaagagaaagctgagaaattgaagcagtctttgcccccagggcttcaggtcaaagaattgaagtgattgacgcacgaaaattgcatatggttttttgttttgtttttccattttattctcgataaactgttgtgttattaattgaaactgtttaattggttttcttctttgttaacaactcaatattttcaaattgtaagtcctttgagataacaaatccttttttctcgagtacgtccaaaatgaaaagctt

SEQ ID NO: 29329 - DNA, 1075 bp, Heterodera glycines
aaaatttcgaccgaattgccgcttaacattggcttttcgcccgccccgtcttcgcttcacttacacttcgcccaaagcaccggcaaaggccgggagagtgccgggaacgccggcgacgctggcggcactgagcggacacgaaaaaacggactgaacggcacggacagaaacggggagaaggaggggacaaaggaaaagcagcggaagaagcaaaaaagggacacggacggacataatgggaggagaaaaagcagcggaacaaagccaaaggaaaggaaacggcggaatttaattgacaaaaattggaatttaaaaaatgaaaaaacaaatttatgggaaagggaagggcaaatttgaattaacacatcacaaaaataaagtgttatacagagagagacaaataacaaatgaataatcatcgagagcagcgaatccccaaatatgaaggaaaaggggggggggggaattgcgcaacgcaacgcaacacaaccggacgaaacaatcggcgacggattttagggggggggggggaaattgggcaaaaacccccggggaattaaaaagaaaaaaattgtacagtgaataaatgagacaaataaactatacaaaaatacatggaagcacagaagttttttggaagattatatgaacatgacgcaaaaacatttaacaaaaatttgaaaattttaaatgataatttaatttaataattaaacatttaatattaaaaaaataatacaattaaatcctttctttaaaaaaaaattaattatcattttcataaccataaaaactcaataattgtcaaaatttaaacggttctgtccaattattttccatttcgtccgcccattcatttcatttttcgtcctaatattttattttcttctatttttttccgggaattccaatttctcaacttttcttcaacatttctttttttaaagcattcgcccatttcccccatccattaatctttaaattgacaaaagtttatttattttttattttcaataattttaaaatatttttaaaagccatcggtcgcaaaatttggtggacggacgaaaagaaa

SEQ ID NO: 29330 - DNA, 2242 bp, Heterodera glycines
  misc_feature (1006)..(1006): n is a, c, g, or t
taaaaaaatattttgtcatttttataaaacataaaatgaaaaaatgtttaatttattttaaaataatatatattatttataattaattttttttattaatttatatattttttgtttttttctctcctgtctaacagttaaagttaatgattttttctttaattttttcctttcgatttgtacaaattgagcattttcattttccctcccccccccattcattcatttgctgctgcatttcatgtggtgtgatgatgacggacagcagcagaacatttcacattcatttaacttaatcattcattttgatcggaaaatgaaaataatctttgccccgctactaaaaaatcttaaaaattttctataaaaaagttgcaaaatttcagttaaaacaaatatttaaaatttctttaaaatgcatataataattattattaatttttcattagtaatttctttcaatctttcaaataaaaaacaaggatttttagggtccggcgctgccgagaggcgcaaccagcaagaaaaaaaaaattgaaattgttaccatttttaacagcttttcacccaaaaaaaaaatcgctaagttttgataaatttagcaaaattttcggataaatgatgagataggcctagaaatagtatcaacaaggaaaatcgaaattttcagctaaaatactattttcccttaaaaattaggggtgccgatgggtcttcttcatccatccctatttgttctattgccaccctaaaaattttctacacaatttttcgagaaaaaattatttttatttttttttgcagattcaaatgtcaatttcaagcggcatttctttttggcagaatgtcaccaaaccggtgccatttgaaaacgaaaaatttttggacatttgactgcgacaaatttccggaggccgaagcgaagcaatgggttgacggacgttttccattgaccattcaggtgaaaaattaattacgctttatcagcataaaatttaaaaatatntgactaattttacaattaatatttttggccgcttaaattttgaactttttcccggccctctccgatttggcaaatcccttttccccaaccttgggcctctagccttaataagacagatttttacaaatattattttaaagttaccaaaaagtactctcaactctttataattgaaaaaatcgaaaccgagactcaagaccaaaattctcgagaacattaatgaaatgaagtccaaataattgtcaaacagttaaagcaaattaaaaatagtggcaaaaatcagccaaaagcaaaaattaaaaataattaattagaccaaattttcatggctcttttatgaatcatccttgatcagattttgatctggattcatttatatttaatcggtaaatttcgtccaaatacttttcagttatgaggccgcactttatttcttttttcccttagacagtaaaaatgaagacgcaaatttctcttatgtacgatagtttagcctccctctaccgtagtattatcgttcaaccaaaattcacattcaggaaaatttgatttttaaagtttcaaaatgctgctccgaaaaagtattttcatccatttgaaatttatcacttatttgccagacagaaaatctgattacactaatcattttactctctaaaatttgccacaggtgtccattgcctatgtgctggtggtgttcggcactcgttttttgatgcgcaatcgtccacccttttcactgttcattccgttaaatgcgtggaatttgtttttggctgtattttccacaattggctcattgaaattgagccgagaattcttctccaccatttggtaccacggatttcagggtgagtagaaatatatatatatatatatatatatatatatatatatatatatatatatatataatacatttttttttcatttaaataaaatcatatttttcatcgttcgaacgagaatctatctaaattttgatatatttagattcaaaagaaaaatgcttatcataaaaaattgtctgcaagacctttagttttactgaggctttaaaaattttttgaaattttttgattagattataatcaaaaattaacaaattttttgatgttttagtttagtgaaaaactgttatgcaatttcgggaatttttcaaaggtataaaaaatttctatgaaaaaaacacaatcttcctaaaaaaaattattcagaaataattaaaattccaag

SEQ ID NO: 29331 - DNA, 828 bp, Heterodera glycines
  misc_feature (816)..(816): n is a, c, g, or t
cgttttgcaatttaaaaaacatatatttggaatgcaattttagaccgaagaactttcggaggaaatgctgcaaaatgtccgtgctgacgaagcgtcgaaaaaggcaactgaaaagaaaaaggctgttacgagggaaatctcttctcgtgagcagcaagttcagctcgacctcagcctgaaactgaacgaagtccatttccttactttgtgtccattgcaaatttgtggcattttttaggttggcgtcgtcgtcaaacatcgccacactgcctttttgaggtgccaatgcctcttttccccatccgttattattcgctttcagtgcccgaattcaacggttgggtttcaatatgtgcaaacggatgtacgaaatggaagtccgtgcccacatggattcggtggcggtgcgtgcctcccccgcggctgttactttgctgaccaaagtcaacgccaaactcgcggaacaacagcagggaaaggtcggtccgaacaaattcatacacttccaaattctaaaaatcaaacagaaccaaccaaatgaggaaaatgaccgtccggcattgcgcgaatacccaaactattgggaagagaaacggattgaccgttcagtctattggtggttcagaccgatgaagagcaccagcggaacggacgcgataaacatgacggaattgtcggacgatttgcgcgaagcggcggaattgaagcggaaattttcggaaaaggtttgtctgatcgctattgaaggcattcggttttctactgctttttaggccgagttttcaattcgtcattgtttgatcactgtggaagccnggggttcgtgat

SEQ ID NO: 29332 - DNA, 1731 bp, Heterodera glycines
  misc_feature (8)..(8): n is a, c, g, or t
  misc_feature (1667)..(1667): n is a, c, g, or t
cgtgaccngtgaatcagggcacacctctaaaaaaacccatgccaacaataatcatttcttcagttgtttttgaatgattccattgcggccgtaaatttgcccgaattgtccaacgcgccccactggtaatggttccagcctggcgacgcctgcggctcccaatagaaaatgccaatgccgttgttccccaatgctttcacccgcttgaacatgtcgtcaagcatggatttgctggcacttggctcgttccatgataagccaatctcggccaccaccacctttttgccatatctgttaaaatggcaaagttcggcttttagaaagtggctatattgaggcctaccaaaaagggccgctgaaaattacataaatttttgataatttgttatgaaaatttgaaaaattgcctaattttatgttaaaatttttaaagctgtgggagttttgaatttctcttttaagaattacccatttttaaagagcaaactttaaatatcctagattacaaaaatttgaaccgaacctccaataaatctcagaattttttaaactacaaaacagtcgtctaccgtaccgactgatcatagttttcagcgttgtttctgcctgtccatttaaggtttgccaatttgacgaggtcggataatgtgagatgccaacaacatcaaaactgccaccagctttcttcagtccatcaaagaaccaggtgaaatcggcagtcttataaccattggccaagtgtataaccacctgaaaattagcaaaataaatttttttaattattatgaaaatattggagcttccccagccaccagggatggcattccgaggccccaaaaattttcgcaaatcggaattccggggatcaaaaaattttcggaaatcggaatttcgaccccaaaaacgtcggaaatcggaaatttttcaaaaaataaaaaatataataaaaaattttctaaatattttaataggctaaattttttaattattaccaagtaaaaggtgtttcaaaaaggtttttggttatttgaatattttgcttgaaaaattattcaatgattttatcaaaatctttttttatgtcattttgcattattttagaacatttttgggaaaaggagtgactaatttacacgttttttacggcgcgcttttttcaaaaattttttgggaacatggaggagggtccggcggtgccgacaggcgctgccgggaaaattttgtaatttttaatacgattttttaacagaatttgtccaaaatgacaaaattttgctcttttgagcaaattttcaagaaaataagtatttttagtgtccggcggtgccgataggcgtcgccgagaaatttttaaaaatttcagttcaatttattaacagaaattataccaaaattattaattttttgaaaaaaaatttaaaaaaaatttccgaaaatttccgacttttcatcaaaaatttcggaaggcggaattccgacgactaaaattttttcggaaatcggaattccgaccccaaaaatgtcggaaatcggaattccgtgccatccctgccagccaccatcttaaaaaaagagatgaagcaataaatagagagagagtacgttgaaggcgctttcatatgatgcttaaaatttccaaattgatctggaaaagccctcgaaaatanattttcaaaaaactgccattttggatcaaattaatcagaaaatataatgacatgaagcggatcc

SEQ ID NO: 29333 - DNA, 1371 bp, Heterodera glycines
gtgattgaaatgctggtggattgagtcccgttgatcggaatgttggtggattgagtccctgcgattgaaatgcttgagggttgagtcccagtgattgaaacgcaggagaattgagtcccagtaattgaaatgcagaagaattgagtcccagtgattgaatgctggtggattgagtcccgttgattgaaatgcttgagggttgagtcccagtgattgaaatgctggtggattgagtcccgttgatcggaatgttggtggattgagtccctgcgattgaaatgcttgagggttgagtcccagtgattgaaacgcaggagaattgagtcccagtaattgaaatgcagaagaattgagtcccagtgattgaatgctggtggattgagtcacgttgattgaaatgctggtgggttgagtcccagtgattgaaatgttggtggattgagtcccagtgattgaaatgctggtggattgagtcccgttgattggaatgttggtgggttgagtcccactgattgaaatgctggtggattgagtcccgttgatcggaatgttggtggattgagtcccagtgatttgaatgttggtgggttgagtaccagtgattaaatgatggtggattgagtcccagtgattggaatgttggtgggttgagtcccagtgattgaaatgctggtggattgagtcccgttgattggaatgttggtgggttgagtcccactgattgaaatgctggtggattgagtcccagtgattggaatgttggtggattgagtcccagtgattgaaatgctggtggattgagtcccgttgattggaatgttggtgggttgagtcccagtgattgaaacgcaggagaattgagtcccagtgattgaatgctggtggattgagtcccgttgattggaatgttggtggattgagtcccagtgattgaaatgctggtggattgagtcccagtgattgaatgctggtggattgagtcccgttgattggaatgttggtgggttgagtcccagtgattgaaatgctggtggattgagtcccgttgatcggaatgttggtggattgagtccctgcgattgaaatgcttgagggttgagtcccagtgattgaaacgcaggagaattgagtcccagtaattgaaatgcagaagaattgagtcccagtgattgaatgctggtggattgagtcccgttgattgaaatgctggtggattgagtcccgttgattggaatgttggtgggttgagtcccactgattgaaatgctggtggattaagtcccgttgatcggaatgttggtggattgagtcccagtgatttgaatgtaaggggattgagtccccagtgattgaaatgttggtggattgagt

SEQ ID NO: 29334 - DNA, 1775 bp, Heterodera glycines
actcaacccaacagcattcaaacactgggactcaacccaccaacatttcaatcactgggactcaacccaacagcatttcaaacactgggactcaacccaccagcattccaatcactgggactcaacccaacagcatttcaatcactgggactcaacccaccaacatttcaatcactgggactcaacccaccaacatttcaatcactgggactcaacccaacagcatttcaatcactgggactcaacccaccaacatttcaatcactgggactcaagccaccaacatttcaatcactgggactcaacccaacagcatttcaatcactgggactcaacccaacagcatttcaatcactgggactcaatagctttttacactaaactgaccaaacaaaaaagcaaaacaaacatttcattttaaaaatcattattcaacaatgtgctatctctaaaacatgaaagacacagtagtgtgcatctcaaaccaatacattttttaaaaaacttgacaaatttcagttctgtgtctcatggatgagaggcacaatagtgtacatctcaaacaatatattttaaaaacttggacaaaatttcacacttctgtgggtttacaaaacttttagtgtacatcgcaaaacaattcactatcaaagaattcttttgacaaaagttcacactctgtgggtttctaaaacttggtaggcacattagtgtggatctcaaaacaattctaataattacatataacaggtaatgtgattgactaacataagccacacaccacactaatgaattttctaaccaataataacaaataattcatttaataaattcaacatttttctgacaaatcaacaatttaaagcggaattacaaaatgaaaattatatccgtatttgataatgtgtgaggatcacaaatataattaaataacaataacgaacaaaatatcaaaaatcaaacataaactacgtaatcgaaaaggtatgagtcacaaatcaaatctaagcaacggacaacaaacgaaatactacccatttttttgagacttcttaattggctccaaagtttccgaactacgacgtttaattggtgtcgtcaaaatcgcctcaagattaacgcgcccagcatcaattttaacggatgaaatctcgcaatgtagctgaaggcattcatctatgataataaaaaaacttgaaaactcaaattaaaaccaaaggtaatgccgacacaattacaattaccttcaactttcacaaaaaaattttgaagttcgatctgtgtgttcttaacgcatgaaccaagacgttctaccaattcttcgccattgacgtacaaatcagccctcattcctttcttgtccgcaacgactgcagcgaaatgtttcccgaatggcgaaaacgatgaagcgagagcacaattcattgctttaaaaaattaaaagtcaaaaacatttatttatctctcacacaaaagtcacagaacaaaccactaatgttttatcaaaagcatgacccacattattgtgtcacacgaaagtcacacaacaaacactaatgttttatcaaaaacatgacgcacattattgtgtcacacgaaagtcacacaacaaacactaatgttttatcaaaaacatgacgcacattattgtgtcacacgaaagtcacacaacaaacactaatgttttatcaaaaacatgacgcacattattgtgtcacacgaaagtcacacaaaaaagactaatgttttatcaaaaacatgacgcacattattgt

SEQ ID NO: 29335 - DNA, 1132 bp, Heterodera glycines
tcatcaaagacaattaaggaagtactttatccgcagcattcaaattttttttattttgtgtacatataatgtaagttgccctactttatcccgacccaatcccgtcataaacatgtctgtccgttcgtctcatcccaaccaaatcatatccctctcatttccaatgttatcatgacttctttatcccattcacctcttgcatatgtcatccatttatctcttatttcctttgtgtttatgccgtcattacccctcatcatatccaaagtccattcccattgtgccagtatataaatcctggcaattccccctcgggggctgtgagagatgtctgcggcaaagcaatttccttgacaaattgaataaaatttctcaaaaaattttcccggcgaccctaacggaaccgccggaccccattttaccatatttaaaaagaagtagaccaaatttagaaaaagtcaatatttttggtaaaaaacagctaaaattttgtaaaaatacacccctaattcgggatttcaaacccattgaactgacccactcaagctctgctggtgttgctgttgacccaaaaatattcccggtttttaacacataaatattttgtaaatgccccgcagcgaggggttaggttacccggataaccttacccccaactcggggttgctcttttactacgggtaacgggtaaggttacccgcagctgagagtaaccttacccgtaactcgttctttttctaagggcccaggaagtaattaaattaaaacaattatgaaatagaatgtgaatttttttaatgcattagtttttgttcgcaccatcttgcccaattattattttttaaatgtgcagccataaatcaaaaaataagtgaaattttactaaataattgtgctaattgatgagaaataggaaagaaagaaaacgaatttgtcaataacagaatgactaatgtaaaataagtttaaaaattcatttcccatccattaattacatttaattttccattaactaattactagggctgccaattttatgtaaatacatatttttttcctggcttctccttgctctaaatagaaggaaaaacacttttttttgtgtttgtgaacaaaaaccgggacttttatt

SEQ ID NO: 29336 - DNA, 2165 bp, Heterodera glycines
tgctggtgacgactcgcagcggaaacaccgcagaacaaacaaaaggacgtttgacttcggacttcttcaaagatagccgtcgtgctaccgtcgcgttgtccagagcaagagatggaatgttcctcattggtgacttcaggacccttcaggaagggccggtgtggcaacgatttctcaccaaagcgcaagaatttgtgcccatcttcaccgatgaatatcttggcttaatggaaagcacgaagataagaagagtgaatggcatccttgcaaatgttcatggctactcgccaattgaacgacttgaagagccaaggcgaaaaagagacttccgcaacccgcgagaagagacgacatgggagacgcagccaagaggaagtcgtgccccgccaaacaaaagcttcggctttgatcgaggacaagggcaatctgtgcaaaggaatccgaatgagaagccattgattagaaagatgagaatgcgaacgtgtcacaagtgtggagaacaaggacacattgcgaagaattgccggcaatgagaaagagtaagtccgtggaaatgaatggttaagtatgagtgtgaggcccggggacggtccctaaggggtattggaggagagtagaccgttaagccgtgttcaaaaacttttggcagtgggctatagcccaatacgtattttgaggtctcctgcgttgtctttcttttctcaaaatcttatttttgtccactattgtacctaactgtcttcttccgctttattttctattgtaaaataatacatttaacttttcttaatatgaaataatgactagtgagctacggcccaaaagtattaaaaatgacgtcaaatatttcagcaatggaaaattacttaattcctggaatcccttttcttcttgacggccaaatcgccataaaattcttcactttgcgatatttcactagcaatcatcatccagcaccgtttgagatggatttcgatgactggggagtgagacacatgcactcgtccgagcaagggtatttcgccttgcgtgcggttgagttcggcgaccaacaacagttcgaatatgttcttaatttggcttcggccagagatgtgaagaaccgaggaaaaagggtccgcggctataattatgggcattggcagacggtcaagagagaacacatgctgcgcgtggtcttggaaaaatttcggcagaatgaaccgctgtgtgaagccttgctccggacgggctttgtccgactcgtggaagccagcactgaccgttattgggccgccggattgctgataactgatgaagctatacgcagttcaaataattggatgggtctgaatgagcttggctgggtgttgatgcacgtcagagaccaacttcgaccattgccgcaacaagtccacctgatccacaagcactacatcgtatgccaggcggcagcgcctgactacgttgtggcactcgcagctgagccacatgttcagccgtatgctgttcggattaacaacgaaactgtcaatgctgcccgacaactgcaaattggcgatactttggtgatagaaagtgtggagtggagagaaggttttgagcagcttggggccgaaggaatgaacgacagaccgtgttgggtacaccaggccagactcaactggcaagctacggcttcggccgtgtacagtgtgtgtatgcaccagtgggttcctgccagagccaagatcttgcgttgcgtccgcggagggccaagacacaaccgagctgtctgttccatacgcatccaattagacggcattgaatttgtagtgacacagcgaaacgtcaatggcaacatcggcttggcacgacagggccaatggattgatgtttgggcgattgtggtggcagagcattggcacgcagattggggattcattttgcccccggacgctgtgtttagagggagacaccagattgtgtcggatgggcgtgtcagaatcccggtgtttgtggggtgatgcagggacgaagagaaagagcgtacgttaactgaaaatgtatgaaacaggctagactagaccgcttgagaaatagccattttagtgggctaggttcgagaaacaaatagaaaatgacatgcaggcttcggcctgaaccataaaattgcagaaaagagtcagcaggccatggcctgaatt

SEQ ID NO: 29337 - DNA, 1644 bp, Heterodera glycines
tcaacagatcgcagtgtaaaagctgctctactgctaacaaccccctgaccagtagtcaagtcgtatacaagtgattttgcgccccgacgttccaccatggcacacgagtgctacggctttggcaatgtgcgagcaattaagcacgcacatcgggccagatgctggggcatttgtgctgcaccgcaagcggcgcataagtagtgcctcccgacaccggggagcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcagggggcgtgtggagcgcacgagacaccacag

SEQ ID NO: 29338 - DNA, 1339 bp, Heterodera glycines
gaaaattctctttaatttacaattattttatttttattttttcattatgaaatttcctacattaatacttcttttttgttttagtcaacaaaacgtattcggaaaaagacaaggaaatgttgatgaaaaaatattccgaaattaaaagtgacaatccaaaaattagcgattctaaaatagctaagaaactgaagatgggccaaagcacattgaaggaatggaaatcggagaaaattagcaaaaatgacagcattttctgtaagttaaatcaaaataattcaagcattttaagaatttctcaatcaaacggtctcattaaatatataaggctgtaaaaaccgtttttcttactgtaaaaaagcgccggactgacgccgagctacatgactaatttgagtcgatcctaactgttgggtttcgattcagttcagttttcattttggatttttcggacattttcccttttctcatttttgcccaaaacatttcctttgccattcatccacaaatccatcactctatttgacccattttcccatttctctttggccaaccattttgtaatgtcactcgcttggcccctcccattatgtcagtatttaagctccccaattgcctcttgcttttaaccattcttttcccattctcatcctgacccttactcatctcacactaaaccaatttactttacttttcatcctttttcctttgcttaattcttaaacacaaataaaccaatcgcattcccccttttgtggacatttggaaaagttaatatttggtgaaagttggaattaaataaggcacatcggagtctaagcttagtcaaatacacaacaatttttggtgccacgacccgggagaaggtcaaaaggctaagcaagactagctgaagcagttcagctgtggtaaaggctctgtgcccaaaccaaatccatcaaatgagctggtcttagttgtgtactaccagccgggctgtttgtgccaatcaccaaatttaaaggagctggtcaagtgtgttttccagccgagctgttgtgctgaaaaaaggactaagtgtcttcaaaaaaaaaattgtttaaaaaaaaagaattttggaaaatggctgagcaaaattcttttaattctcaaaagggcgaaaatgtggagggaccaattggttcggatttcgatccaattttgtttacccctgaggagaaccaaaatctgaacaatgtactgactcgaatgcgaacattcgaatccgctatttgccgtcaatttcgtaaattggagcgagaatttgcagagttgaaaattgtggctcacccaattagatgataccgatcgaatggtcaaa

SEQ ID NO: 29339 - DNA, 1353 bp, Heterodera glycines
ctggacaatgacaggctgatgaatgatgatgatgagcatcttgagaagtcggcattgcccaaaaggctatgtcagtgccgtggcggtttggtgccgatggacaatcgtcgagaatgcactttccctctgctcgacagtgccgttctcgtccacgcgtggctttttctcgcttccaattgtgccattttcggcgtcctcctcttcctcgtcttcgtcatcatccaaaatgacatcgctaaattgattaactcatatatccccctataatctccctccactcacatattctcctcctccgcgtccccctcgttgctcgtctgttccgtctcgctcattagtcttaatcgtctcccatcatttgtgttaattagttaattaatccccctccccccgccaatttacaattcgtattcggacagacagaacatttcccagtcgctgagttctttgtcctcgtttgtcttaattggcactttggtctaagcttatccctaattggcaccttcacagacgctctttccccgtccgacgattcttgatccacgtattttatccaattgacaaaagtgttgaagaagcgatgggccagcccggacctaaaatggcagacaaacaaaaagtcccaaatgatcgatgtgatcggatcaacacccaaaaggaaaggccaacctcttcaagtccattctcgtgacggaatgaccatttgcgggtgaaatggaatcgaggagctgaagcagttcgattaagcgattaattttggaaaagtgtctcactgacattacaaattacgtcgcgaagggccaacgtttccattcccttaagcgcaaagttataggaactatgaaaagcccaaactttggccagcagcttctgttctatcgcttcataaaagtattccatttcatagagcgaaatttggccgtctccgtccaaatcgacgcatcggaaccaatattcaatgcttaagggacatttggatggaaaagtcggcacaaatgccaacaaaaacctggtcaggtgccttttgtcttcctcggcaagcaaaaaacagacgaaatctgaacattcggtccaattacaaaactgtcgccaaatggacggaccttcgaagccaatggtttcgatgggctgttgcctaattggccccgtcggttgcggcaccgtccgttgttcgggcggagttcgaatgacggcggcggagaatatgcgatcgatgatccgatcggtcagagccctgaaaagccgaaatgcttcttcattttttggcggataacgtgcccattgcaatgtcggcgcatgtcgtcacgcgaaatgatcatgtcgtggtctgaaattggccactgatttgggttt

SEQ ID NO: 29340 - DNA, 1214 bp, Heterodera glycines
ataagggttaattagagagaaatgattatgaaatggggctaataaattaggaggaggaaagttgtgtcaatttgagacattattagctatttcaactggcgaaaatgtccctaactttcggagtgggaatgtcaattcacccgcctttgtgacaattgttgtgaaattgctctcagacaaagacacaagcacacattcaaaacatacgctgttcaattggacaaattttgccgtaatacatcaatgcgaaccaaatttgtgcaaaaaagattcaatgatctctgacatatatgtgaaagagccgaagaagaagaagaagaagcggataaacagatgaaaggggggggaatttaacaaaacaggggggggggataaattgggggcgggaattgatcaaagtggggggggggttccttttgctttacttattgacgccgaattgcaccatttcacagggcaaaataacggggatcagaagacggtaccaccagcggaagatgcgttggcgacgcaaataattcatccaagtgcaatttcgttcttccatttcggaaagcgctaaaataaaagtaattaataataattatacaattaattggcccaatttaaatttgtccatttttcgccccgtgttcaattagtctcacatttaagaatggtgttcggcaacggaactgaggagaaacgaggcggaccggcacggtcgacatgttcaaagcagcgattgcactcgttccgcctgattgtgggggtaattaagcgataattttgaattgcatttcgccgttgcctttcccttgcaaattgtgcctaattgacttttgtcgatcatttgcttttccccttctcacaaattgctcattctgctcactgacgccgtctttcgccaccgcttttcctcctccgtctgccatttgttcgcccgaattgctctgcttctgatcggcttttcctcctccttttgctgctgctgtgtcactgggatggcattcgattggaccgtcaaacatttcacacacggagccatgccttggcaaagtcattggaggaggaaacattttgaaaaatattaacatttttggtcagaaaacgaagagtgtcctccaaggcctggcgacaaattcgggagcaaatttccgggcgaggcggaaaaagagtgacgaccattccggaacaaattcttgaggggtgaattgaatggacgggccggaaaa

SEQ ID NO: 29341 - DNA, 1044 bp, Heterodera glycines
agcctttgtgaggatgagttagagtgggaagaagatttttatatgtgctaaatatattgaaaaaaagcagcgagatagctaagaaaaaagaagaaaagaaaggggaggagaaagttgccagaggaataataagaaggaaacttacggtgaaagagaaagaggaaaaagccaagaaagacagtagcgaggcagcaaaaaaagcggaagataaggcaatggatgaaggaagagaagaaattcggaaaatcgtgagagaagcagaagaagaagaaaaagaaagaatgagaaagtagctttgaaagggccgctgatagggcaggactcaaaaaaattgattttggacacaatggaagaagaatatgtgccagggaaagtggtcggctacatagaagacccgcgagaggaaaaggaaggggaatgggacatggccaaagcgttgcagaaccgttcaaaagaagacgaagtgcgaataaaaaagagagagcaaagagaagaggggtggaaagagctaataagcggagaaagaaaagcgaagggaagagaaagaccgaaattggtggaaaaattcgtgaaaaatgtgttgggcccagctgaaaacgacgtcagccgaaatcccggccccccccccgaaggtagccgcagaggcccgacaccgattccttgttggaaccgctacaaaaaaaggcctcgcttcgtcagtccaattcgaaacatcagtccggtccgaacacgccaaagcacagttggaacgcagacgacaaacgcatggcccagctgcataggagacgtggtggaacaaatgcaactgatgaagacgaagctggacgaactgatcgccgctctcaagaaaaaggaggaagaaaaaaacaatggaaacaacgagcaaattggcgagaaggaagaacaacagaaagaaaatggaaaatagaaaaaaattaattcttttatctcttatttaaaccattttactcaaaattcaaaaaatagataaatcccttttcgcatgtccaaataacatcatactcatttaaacaattattttgt

SEQ ID NO: 29342 - DNA, 1505 bp, Heterodera glycines
  misc_feature (182)..(182): n is a, c, g, or t
tcccatttttagtactttgaaccaggtcggtctggcctgctatcactccccggccctttagtccaatctgtgcccagcccctaccgatacggaatttccaatcccgcctactttggtcttgagtagtccgttttttttttaaaattttgatcgctcccaaataacaaaaatttattgaaatntcaaaataagaaattattttaaaaaatccgagccatccctcagcttctcagtgttctgctccatgctactatgaaccaggtggggcctgttatcacaacccaggatttttgtcgaatctgtgcccaggtcatagaccgatacggaatgtccaatcccgtctactttgatcttgatcagattttgatcaatcttagtctcgatttatttgtttttaaattttgatcgttacctactctttcaagaagttatttttttataacaaatttgttaaaaagtgtattacgaaatccattgtccatatgtccgttcaacttggcaatgccgttgttgtccacgccgtgaagaacactttccgcccgttttcgcttcgaagtttccgataatggtgcgcatgcgcaaagttggatcagtgccagcacaaaaatgagttttgatgacaaaattttgttgaacatggccaagacgtccagctaaatgcaatgcaaatgtttttgcgtttataccgcaaaaaagtgggataaaggacatgggagaacccataaaaacaggatcgggatcccgcgaattttctcgggatcctgcgggattaaacacgagaacacgacctcgggatcccacccgattttccaaagtcttcgggacttatgaggtattaatcgaaatttttataccggtggttgccgttttatgcttcttaaaatgatgcagttgaaatcaatgcgattttccaaatttttgttcagccgaaagaaagactgattcctaaggtcgatgagaatagttgtttaatgatgctaaaatagaatattaggtaaaacaatttttaaaaaattattaaaagtagattggcatttgtcgagatggaataatattagttaaaataattttttaaaaataataattattaaaaaatgatttactgccaagagtgtgtccatgtccttcctacccaaatgtttatatacaaatctcatcatattacacatcagcatggatatgagctatcatcatcattagctaatttttacactaataagtgtagggtggaagagaagctcgagagtttccgtctttccgtgtctgatgaaagaaatgtcactaaaatccatccgtacagaaatcacatttttttcattttttggcaaggccaaaacattaattaaacaaacaaaaattgattggagcgaggaattaaatcaatgaaaacattgaaataaaattttatttcaatcaacttcttaggtatgggatgatttaagattttttttatatattattaaatatgtattttttgtggcaactttttaacagaaataaagcca

SEQ ID NO: 29343 - DNA, 865 bp, Heterodera glycines
ttgaatttcgtgaaagttttaccgaaatgcaattcaaaatcgtaaaaatttcgagtttttggcacaaattttgattttttttatgaaatttcaaaatttctaggccccccccccctcgtcggaaagacctggaaaaattttgtctgaaatgggatgaacgcgcagccaattcgtaggtccaactcctgccgggcgtccgccgacagcgactcgttcacatttggccgaccaagcgaagccatcgcatttttaatttctttttcggtgatggccgagaagcgggccctgggcaattagggaaaagtaattagttaattttgagggcgaggagggggttaaatgggcgatgaaccatcgcccagccaattgaagattaaaaacccgtaaattttgagaaatttttgcagacggcgggggctaaaatgggcggcagtgcgagtccctgtccctctccaaagaatgccatccgggaaaaagtagggaaattgggggaaatgaattgaaagaaaaaattaatttaattgaaaaataatggaaattaaaaaattaacttaaattaaattggacgattttccgaaattacatttaaagaggtaaaaatggaaaaatttttttttcaatttggttaaaattggaaacaaattaagatttataaatgaaaaaataaggggaatttttgagctttttaaagggggtggaaaaacgggaaaaaaatttaaacactcgaaaatttgaagatttttattaaaagtttaaaaagaaaaacaggaaattaaatgcatttttcggcactggtgcagttttgtggtttctgcgtaaaattaatttaaaaatttaagaaccattttttctaggataaaaaaat

SEQ ID NO: 29344 - DNA, 1788 bp, Heterodera glycines
tagggttgcaaccccgacgtcggggttggaaaattcggggttcggggttggaagtgtcggggttcggggtcggggtttttcaatttttgccttatgccaaatagtcaaaatttttttaatattttttcggaaataatatttattaatttccataataatatttgtattgtttttatatttttttatttcttttttatcagaaattttgtatagaataaattttttttcttgaaattttaaaattttttattacttttttgttttccaaaacatcttttttcacgtcgctcttttctaaagacttaaggagaaaggtacggcgtccggcggtgccgataggcgccgccgggaaaattttgaaaatttggttagatctgttaacagattttgtccaaaatatgctaaatttttgcgattttgagccaatttttttaataaggtttatgactttttgggccctgtatgccgataggcagcgctaaattttggaattaagctctattttctaagatttttcaccaaaaaaatttatgaatttcggtaaatttttgtttttcttcgatatgtattttgtcaaaatatgccaagattgtcgatttctatgagtatttaatttaaaaaaaacaatttgtaataaagaaaatgactaaagaagaaaacgtcaaacggtatcgaactcaggacagaaagtaatgtcaatgtggtgcattaacctctacaccacattccaaatgtccaaatcgagcaaattttctttatttaataaaaatttggcaaatggttaaaaaaattcaaattttgtctaacttttttgcattttctcccacgaaaatgccattcttaggggtgtatatttaaccccgaccccgatcggggttaagggtcggggtatgaagcgtcggggttcggggttttccccgaaaatggccaaaaatgtcgggggcggggtcggggacgcaaccctatttttattttaagattggcaactcatctttcgctggcttttattctctacggcattttcctttggaacggactttctcatctttttacgccaaataatgtaattgttacgccaataactaattgtagaccagctcttccaattatagcatagcaaatctccggccattaaaaaattccgagggatggtacacggcaacaaactgatgatttttatgactatcataatcggttccattcatttatttgtagaaatatattcacgcgttctttgattttgctcattgtcaggtgccttcgttgctggtctcgacgctggactcgtttataattcatggccaaaatacgccgatcggtggattcccgagggagttttgtcccatacgccgaattggaaaaattttatagaaaaccctgccactgtgcaatttttgcatcggaacatggtgaaaatgctatgtgtctttgtaattagaccggaaagatttaggcctatttgacactgattttggccactttgacatggattaagggcatccgaactccgctggggtttcgttcccgtttagcacttcattcgcttttagtgactgcatggctgcaacttgcgcttggaatctcaacactggtatgaatgtattggaaaatattttcacctaattcttttttagttacaccatgtccccgtttcgttggcatcgatgcatcaaaatggggcgttgctcctttatagctcagttatttggctgtcaaatgagctcagaaagataccaaaataaatgaaatgtattttaaaatgaaatttcttaaagtacaatttttgtt

SEQ ID NO: 29345 - DNA, 1048 bp, Heterodera glycines
ccgggcattcgggtctaagtccaaccagaaattagtacacgtctaacattacgtttaaaagaattaactaaaatatatgattgccaggttcccatacttaaattttttaatttacaagaaaaaaaatttaagcacaggggtgttaaaattaactaaattttaattgttttttataacattttacagacttatttattttaattttttgaaattcctccctctggtgcccaaacttcccggtgcccaagcgtttttagacattggacggttcagtcccaaagccatttggacacttcagtgccgggtctttaactctgtttgaatcgccgccgacacctaaaaataacaccattcgtctcgtctcatcgagacaaatcgaattttctgtcaatagcacctattttggcatttttcgagttttagcacctgttttggcctttttccagaaatttcatagcaaaaatgcaataaaaacgaaaaatacacccataagaatggggccgggccgttttcgcgtggagtacgttttcgcgtggctgggggtcgttttcgcgtgagtgcctatttaagactgaaattggcggatagtgccgaatatcgatttcgacttatttcgaatcccgaacccgaattcaaataattttcttaactttttttttgtttttttctttcttgcggcttgtaccttctataataatttgtcagtttgttcgaatgtgcatcagacggaaaaaataaataaaattttataaaaattcaaaaatttaacaaaaaataacaaaattcgggaacaatctaaggtcgaatctcatagtttcgggaaatatcaacggggaaattgataatgttctaaattaagtcagaaaacaatttaatgatctgaaaaattcaaactgacaaaatgaagcccagggctttcatttgatgggcccaatccgccatagaagattttccataaatgagaatccttaatacagtgtcatgatcaaaatccgaaagaaaaataagatcaaaacaaattttgctaaaatataatagagtaatgaat

SEQ ID NO: 29346 - DNA, 892 bp, Heterodera glycines
  misc_feature (18)..(18): n is a, c, g, or t
cattcatgtccaaatatnttggaaaggcagtttggcgtgttgcccagcaaagcgacacttttcatggggtattttattatttattcaatcaattattttaacaccatgtctggcgaaggtgggggggggggtggagaaatatagtacatccattaggattacagaaattctagaaatcataatcttaaaaattgaaaatttgtttatttagtgccgtcatggtgccaatggccggctttggcacaatgttttccgggctgatcattcatcattttcgcttgagttgtgtgcgaactttgcagtattgcattgcgtaattcctaatcattaaaaaaatattttttcctaatttttaatccattttatataatttacaatacacgtgatgattgcatttagcctggtactgtgctcgcttttgctttcaccgatgtacttcatctactgtgaccatgaccagttggttggcattgaacgccattatccagttgatgagtgagtcattttggagcagctcgttcttcccctttcaaattttttttaaaattcttacaattagtaggttttcaaaattattcctttcaactagttttaattttttttatgaatatctaaaaataatcgaacatcatgaaataaaagaacgttttttttcgaaacaaaatttttttaatcttttcgttagtaacgcaaatttttatttttaaccatttaaaaaaaagtgctcctggcaaccattaacacgcaaaaacggacacatttgtctacccatttggacgccgttgcaacgcgcaatgccactgttctccaactgagtatcaccccgtgtgcgctgagcacatttgacgctcacaaatggcctactattcgccctgctatgccggctgcccat

SEQ ID NO: 29347 - DNA, 1029 bp, Heterodera glycines
  misc_feature (215)..(215): n is a, c, g, or t
ggaatgccggagatttgagtcccagcgtttggaatgccggagaattgagtcccaaagaattgaattgcttgtgggttgagtcccagagattggagaaaaagccaagaaaatgatgcgaggccgcgaagcggccgagccaggtcgattttatcattcataattctataacacaatcgtactgcctagcgggggatgcgccgaaggcgctgaccccngctagtgcataaaaaaaagaaatggacaattatttgacatcggaacatggtaagaatgggaaccggccactttggcgccagccattttggcgccaaacgctataacatttttatttctcattcaaattaaataagcttgatatcattttaaagcgctagatattccctaatagcctgcaaactttcaaaaaatttaattgaaacacaaaaaagttatggccaaaaaacctcaaaaaactgactttttctggccattttggcgcggcacgctatatcttttgtcaaacagaatttattttttctaatattttgcaggctaataaagaacacttaggcctatttaatggtatcaaaattattttatttggttggataagaaaaaagttataacactttaaagttcgcggcgccaaaatggcccgcgccaaagtgaccccgacccaaaaaataattgaagaaattgttggagaaggcaaaatttttgaaaattataaaaaaaaacatccaagtttgaaatgtctttttttaaacaggcaaaaaatccaaaatcaaaattcctagtgaccgggacacccaaaatacactgaaaattggggaaattttcgaaatccctaaggggctgggaatttttttctagagaaaatgggcaagcccactggaaagggcacaaaattctctactgatttatcttttgaataatggggctatgacttttacataaaagctatacttggttgaatatttgatcaccataaaaatgatcaatttttgatcagcgccataactttttctagacgcattcaattaaacaata

SEQ ID NO: 29348 - DNA, 1320 bp, Heterodera glycines
  misc_feature (14)..(14): n is a, c, g, or t
tcaagtgcgtttgntgctatatcatcgcttatcctctttcagtgtccaccggcttcacttatttcatctttcttttcacttgcaattcgctttgtctgtcctttttaaattattttaattgtttttttctatttttattttttttagtttatatgcttttttcgctggcggaatatgtggtcgtggggacgaattgtttgttctattttttgatgatttgggagatgaacggctgcaaattggagctgtatgtgaagagatgaggggaaaacaaagacacttttgttggactgttgagatttatttgaaaagaaacaaaagtgaaacaacgaaaagggaaattcgcctcggggacaatcggaaaaatcagtggaaaaatagcgaaacggacgaaagggcgaaaaataaaatgaaaataaattgggtaattaatggaggaaggaaaattgattacaaaacaatcaaaaaaagagatgatttatattattttattgtgggagaagatacggaacggaagaaacggacccgaaaaaatacggaaaaaacggacattccctcggggcttttcttttgaaaggccccgggacggtcacaaagaagaagctcatgccaacaggagaacaacaaaagcacgaaagatgctcaaaatgggagaatgagtacaagaaaagcggaaagaaagaggtgaatggcggtgaattcaaagcgaacactgactaattaattaattaatggtcggaataatcgttaattaattaattgattaatatttgtggaggaggaggggactaagcttaataagcccaattttgaagaagtaactcccttattttctgatgatatgttcgcctgtttcttgggtatgatgaaatattgaaaatgcaataataccaattacttaattaattagcaaattaatttgttaattaattatccgtctgccccctgtcccccccccccacttaaatggccctccgccgttcatagatttgtccttttttgtgtccccaaatttttctcgtcgatctctttcccccttatttcagcctttggcccgtctctctgtactgcttcccgttgatgttccgcgtcttcgcatttctctccgcctgcgccgatcggccgaaacagcacagtctttttttgtaacaaagggcgactgagaaaagaacggcgattgtaagcagcgaaatgagcaacacattgcgtagcaattgccaatcttcttcctccgcttcgtcctcacttccgtttgggcccaatcgcttctctgtccgatcgtccgactctccgccgtccctcggcgaagacggactcggc

SEQ ID NO: 29349 - DNA, 1583 bp, Heterodera glycines
tgctgaggaaccttctattaaggggcagaattgaaggcgcaaccagtgctatactacatgtatagtgcaaagaaaaatattgttaaatcagctgcagaaaactattttcattagaggggatgaatggctaaatgactttcatgatgaaaagaagaaaaatacaaaaataaccaaatcattacttatcatgtaaaagcaaacataaattttcggacattggaaaaattccaaaaagccaaaatatatggcaaaatcaaaaaatattaaaaacataagcaacagatgcgattcaatcatttgaaaatatagattaatatattaggcaaacatttattttccttcccctttagaaattgtccataaatttttgtcgtaaatattcacaaaacaatattttattttactgtaatcttgttccaaggtaagtgaaatgcaataaataacgcttggagataaaagaaactggcgaaaataattgactcaattaactgtcgtgaaacagttcgggaaaaaacttgcaagaaaaggcgaaaatatttccaacggctcatgtgcggttcaacaagtgagcaacaaaacatgaaataaaagattctaaaaattacttgacttcctttttcgaaattgtcattaattttttgatgtaaatattcattaaaaaaactttgtttttattgacaatttttttcgataaggccttgagcttaaacaaataatgcatatgcgtagagataaaagaaatcagtgaaaaaaattatcacaaaaatctgccgtgaaacattacaagaattctggagcagtgcttcgtgattatgcgtcacactctgctttgattggccatatctcgcctgagagtggcgataggcccttagttgatacgtctgaatatgaagagcgcgccgagctctttcgaacctgcaaaactccatatttttatggccagcatagtaaaataagcactgaatgaaacgggcaatataaattgagatgaatggagttttcaaatttaaaaaccttctgcattttctgggaaaatagttgagaattttttattcgagatttatcacaatactaaggggtgggcgcagcgaattcatttgttgagaaagtattattttttgctgaggaacctactattaaggggcagaattgaaggcgcaaccagtgctatactatatgtatagtgcaaagaaaaatattgttaaatcagctgcagaaaactattttcattagaggggatgaatggctaaatgactttcatgatgaaaagaagaaaaatacaaaaataaccaaatcattacttatcatgtaaaagcaaacataaattttcggacattggaaaaattccaaaaagcccaaaatatatgggaaaatcaaaaaaatattaaaaacataagcaacagatgcggttcaatccatttgaaaaaatataaatttaatatatttaggcaaacattttattttccttcccctttacaaaattggccataaaatttttgtcgtaaatattcccaaaacaaatattttattttacctgtaatcttggttcccaagggtaagtgaaaatgcaaaaaataacgctt

SEQ ID NO: 29350 - DNA, 1852 bp, Heterodera glycines
aagtacaccttttgaaaaaatagaaaatttcgtcatagaaccgtccaattcgttgccgactgtttcatcgccaatgtcataacgtttaaatccaaaaccagtaatttgatagattcggtttcgaaatctcgtgagaagttggttgttagccttgtaaattccaaaattttgatggattttattgtaaattatggccaaaattgccaaagtgaagttgactctttttgtccattttttattcgttttcattcattagaaattgaaaaaaaaacaatatgctaagcgatagcgttaattatgaccaaatctaatactattcgactttcgaatgctatcaaaaacaatttgtgattcggtttctttcgagaaaaatagaaaaactaaaatttttttgtcggcagttaaaaatgtgtcgtaaaattgcccaaaatataggaccaacgatgccggcattggcttcgtactcgacaaaattcgcccctttttgtccccgtcggtctacgaacgcatggaatgggcgcaacaatttgtgcaaagcaaattgagtgccattggcgtcggagtggcggccaccaccgccgctgcggggaatgcgacagcgataaatggcacggcgaatgcgaccgccagcgcagtgaatgccacgattttctccgggcttttgcaaaaggtttttgtttgagttcaggattggcatcagaccggcacatgtgccgggattcaaaacccggttttgtcaaggttccaatcccggccctttaaaaaaagcgggatcgtgatcccgtgaaaatcccagcgagatcccgacaactacgctggctcttttgaccaacacaaagtagaaaattcacaaaaatatctttttagcatgaatggcatggaatttcgacccgattttcgacattattgcggtcggaattccgatttccaaaaaaattttgtgatgccactgattgctgaaacttacgctttttgtggtaccttataagaaaaaagaaatgcatttttttagatttttttccgtttgtcctccattttccgggaatatttcccaatttttaaacgcatttcattttgaggtgtccgactttcatccaattggtgccaaggctgttttgtggatgcccgaaatcagcaaaaccaacctgctctattttctgctgcttctgctttgctgggaaggtgctgtgcaaaattttacgatttttttacgaaaattctttttttttaatatttttttgcaaaattttgtcaggttgcattgcattggccaccattctgaagccgttcctgtcctttttcctctcccggcttccaattggcgaccgttggccccgtcggaatgtgccatggcttttggtgatgaagcgaggcaaacgcgaaatgaaggagggacagttggagagggcggccaaaaaggatgcggtccgtctttaaattttatacatttttcctgaccctcgggactgaattagtcaatttcttgtaaatatcgttacattttatgaatgtgctcagtttttggaatagatttgccattttcccgaaaatttgccgcaattttattgaacttcgtgactgaaataggtagtatactataaatttacggtttcatttttggaacaacataattttgaagagtatattggccgatatatcgtaaattttcctgcaaaattcaatgcaaaagctgaataattggactgaatggccgattccttatgaaacaattcttcgtccatttaggactattttctgttttccgaatgggactcgcattttgccatcgcatttttgttctgttcatcggtaggcatttcgcatttgtaccgtcggcattggatcaccaacg

SEQ ID NO: 29351 - DNA, 1131 bp, Heterodera glycines
ttgtgccgtttgagaaggccacgcaatctcccatcgcgacgacattggatttgtcaagcgccccaacaaaagtcaacacaattgatgaacgtccccgtcatttcaaaatcggtgacactgttcgtgtgttgaactatggaaaatctggcaagtcaaattggtttgaaggcaaagtcgtcgctggtaaaggtctgatttggaaagtcaaaattccacttttaaatattactgtcaacagacatgtcaaccaaatgcgttcttttgtcccttatcaatcagaaacgacgtttctgaatgatacagttgaccaagttccgcaacaaaaagtccttgccacagcactgtcacgactactccgccgaccaacttgccagttcaaccaacgcaacgtcctcagagacaacgccgtccgccgatacgttactcgccgtgacgacaacattatttaagaagggatatgttggattttaatttaagaagggagatgttggatatgatggattttaattattatttgaattagcgccaatacagtagaaatgatgctcctgttgtttttggtcgccatattcttcagtcaatattctcccccgctgttttgttttcattcattattattttcattatttttatcatcatttttcggttctaaattaaatctgttttgctccttccatttttgccttcctctgactccgtcgtcatcattattttatttgttttgttttattatttatttctttgttatcatttgtcttccaacaataaatttaattctgttgttccttgcggacacaacaatggcgacgcccgagtgcatattttgtgcattaccgtgaacttaccaaaaagctactctgacggccacctcacataacccataacactaaagttgttccccatctgacgcaagcctgaagagtttctcagtatcttgactgagtaaagctaagtgtgtgttcggtatttgccaaatattgcaagtggcataaatttaattttatatttgttattgtcactttgaattcattctctctataatggcgacgaaggaagagctcaaaattattttggaagcgcagcaaaaacagtttttggatttaatttcaaaaattttgcctcaaaattcgg

SEQ ID NO: 29352 - DNA, 1175 bp, Heterodera glycines
  misc_feature (1166)..(1166): n is a, c, g, or t
ctcagggaccatttggtattttatgtaaaagaatttttagtttagaatttaagttgttagtttttccttgcatttaatgttgggttttcgtgtagagagctacaataataaatgtataaatagtagcttcaactcagaatttagttaagaaattattttgtttaaattaagtataaattttcttaatttatttattctctatatgaaaaatcactttcttgtttatttttaattgtttttatattatggattttcaattaaatttaatctaattattttagtataattctttagatattaattgttttatttaaaaatgatatattaagttattttaaattatcattgaatctatgttttattataaataaatatttttattttttgtgtgttcattggaaaaaacacaaaattactatttctactttcagcctatttataccatgtcatcttcatcgatgattgcgaaaatttttggcttttcttaattaaaaaaacactatatggcaaatcgctcattttaattttcaaaaattgtttattattttgttaaattatttatgtatgttttggtggtaaactaattaaaatgattgaaacactgaagatgatggccctgagcatctaggactaaaactaaagactagagaccggacaactggggtcggagggatcccgagtcgggatcccgacttaataccgatcaatcccgaacatttcgtaaaaacgatcgggacggatcccgactcgggattccgaccgaatcccgatcccgatcaatcccgagattttttttcgggatccctgcgggattatcgggatttgcaaaagctcaatttttttacgttttgtgtcaaagttttgttataatgtttctttaatatttataattgatcaattttattgaagaaaaataggaatgggaattatatcagatttttagaaaattttcaaaattcgaatatcatacataaaaaatcagattttaggattagaacatttaacaacatagctttaaattgttttttacaattcaattaatataaatttttatattttcgcctcctatgatcagttttaacaatttgaggaaaattagcaaatcgttaagtgcatcggagccaaaaaatcagatttttatgatttttttgctgtttttttttcanaaaacttta

SEQ ID NO: 29353 - DNA, 1379 bp, Heterodera glycines
tttgaatttgaattttataccgactgaaggcaaaacaaactaataaatattttcgtcggaaagaaacatcaaattaacgagaagagatcaattgtccattcaataatctccaaaagggcgatcaatccgtcactggttctcccacatcttttcgcacgtccagcatctggtctttggagatgttaatgtccctgagcctttttgagtccgcgaggagtctacctgaacgggtgggtgtttattgttaaaagcaatttatgaaatcaaccatacgtgcgaagtaaagcaacatttgagccggcactggcgtcactggccacgcacgatggatcttctcttttaccacggctattgaatcgtccatgtcaaaaatgagctcgcgcgcattggtgccaaattgaacgttcaaattgataggcgtaggcgctccctcaacttgttccttgtacacctaaacaattgaaattttggccaattctgtctaaccccaaccaaacaataagtcaaaacaacttagtttttcaattttgaagaccagcgacctcaaaaccccatatttttatcatccacccaactgggagcagttcgtttcccaccccacccctctccggacagttttttaaggggggaccgcgatgggtaaagggtgtaatgcacaccaaccaccttcgtcctcggcatttgaattcatcgcgctgatgttcacagcgccaaaattttacgtcacggtcagcattgaacatatggaagacatagaggcatccttcatgttcgagttttttgttgtttcgtttcgttattatttgattgttttccattttcgggctatattaaaagatttaaaacaaatgaaatgtataaaaatgcaaaaacaattttctgatatgggtgcactatgtttccaccccgcacaatttcagtccgaattagttaaccccgtattgagacgcaaccggccccataagtactaagacgcaaccggccagacgcaattggccagacgcaactggtcaagacgcaactggccagacgcaattggccagacgcaactgacccgtttcgccatatctacccgaaaaccccctagaaaatttaaaaacaatttttatttttatggtctgtttgcagttttttaactaaattttgcgaaattaatttgcatttatatcgaacgattcgtcgaccactacctgcgcaccagggatgttgcgaatcgaaaaataaaatacgaataatacgaaactaaaataaaatacgaaacacgaacacgaaacgtcctaaaaacacgaaaatacaaatatacgaacacgaaacgcgaaatttttttctaaaaattattcataatgaaaatcgtaaattttgagattgtggtgcaaaaa

SEQ ID NO: 29354 - DNA, 1254 bp, Heterodera glycines
  misc_feature (1200)..(1200): n is a, c, g, or t
attaaaaaatttagaaatttttttattatattgtatattttttgaaaaatttccgatttcttgcaccgcaaaaaagtggttttgaaaagaaaaaaatagtcaaatttatgaaccgttaataatttgatttccgatcaactttttaccgtcggatccaatcgaaaaatcttagtcgacccatcagccccttttaatgcatcccgccagcccctaaaaatttatttttcagcattttttgatttttggaaattttttgaatttaattgaaattttttcgaattttccaaaatcccgcaatcccgcacgggatcccgcaaattttaaatgcgggacttgcgggattaatcccgcgggatcccgtcccgcaaaaaattttgagttccagtcccgcagcgggatccgcaaatttgaaatttccggtctctactacaaaccacgtaaatagtgtttttagctttgtttgatgcttctaggatcctgttttacttccatatttttccatatttcagatttttgtccatatttccatatttgacaatgtgttggactcataaagtttaatagagttaaaatatttgttttaattaacccttattttcctaaataccaatattttaagtgaagaaatattgtaaattttcaactttcaacttcaaacgtcaaaaaccattgccagaaaatgaggaaggagaacaacaaaagcagtgccgcctcagcagattctgatgccaatgccaacagtggtggcgatgcttctctcaccgcccccactgaagaggagggcgaagaaatcagtgccaatgagcaacagaaggagcagcgcaagtcgctggacgcactgtacgctgcggcacgcgaggagttcgatttggacatgagccctttggacagtgcgatgaaaacgctgcgggagggccgcgagatacaaaagttgtccgtgctgcgcaacctgtggtcgagctggtggagggcgagccggacgaggcgttacaccgcctgttgcccatgatgcaggcaatgttttggacctgggccgggcggattggactttcagtttgtttccgtatatctaaataaagtatgaacaaaagcatgagtacatcaaaaatttcgtcgcagaaataaaaaaaaatttcaaacaaatttttcaaggaaaaaattctttgaaaattttttatgagaaaatttagtgaaacgtgnggggcccttcccaggatcgctgtagtccaatattatccagaaatactttattgt

SEQ ID NO: 29355 - DNA, 1524 bp, Heterodera glycines
attttatgtcgctttccgcgacattctccgggcctcgaggatggcgacaattctgttgtcgtcatctgtttcttttttgttgtcgacatccatcggttcttttcaccatcggttcattggacgtcgttggaccacacgttgaggacggttctccaggtgtccatccggtgattgggctcggtaacgtgcaggaggatgaagttcatcctcctctggtgctctccaagcagctctgactcgatgtctgatgctgataagctcgatcgggtaaagatcgactaacatccctccctcgtgagggctgaagcccacatattcttgtgtgcacggtattaatgggtctacttggagacccaaccgcacaaaatggtcaaagactgttaaacccggagaaaggtagagaccctccggaccataacaggtgagtccatcgaaatgaatatcgacagctctgccaaaatgttcgccaattagagtggctccttcacgaagcactctgcaaaggtcctcatcgacagcacggcgatcccgtgttgtctcataccagtgcggtccataagaccgctcaatccatgaactcaatgactcactttggcgatgagcgcgtggttcacgtcggataggaactctctcctcctcctcttctctttctgggtcgccaaactcaaaaaagcgatcgttgaaaatctgcattctcgggtatgttcacccgacgagccgagaagaaaggaccttctcgaaagggaataggcatttcccttatgtttgaaaaaaaagtggttgggtgggaaggctcccacccttttatacaatcatccatcacgtaaatcacgtgatcagactttgaattgaaatttttcgatgaatcattcgtgtgagttggataggctcgtgccaacccaaacatgcagaaaatagtgagacagctaagaactgtcaccactttggctttgctgcgagtaatcattccatgttggttttggttgaccgtttcatcaaccgagtgagaatttttgtcctcatttttcttctcatttggcaatttattttcccaaggaaggaattgttttttcttttgaactatttgtagttttttcttcgtttcctttcaagtcttctttgccattattgggaggattttctaatcctacctctaatgggaagattttgttgactggtcgtgtaataatgacttttcgaggcatcgttccatacctctttgatttaatgccaagaattggcatttccaattgaacgcttctaatggcacctggactgccattgagctcaattatttttcccaaagtccactgattccaaggagtaaattcctcatggatcaggactatcattccttcttttggctctcctgtgtcttgtagatgagaacctttatgatcaccacttagacctttctctaaagaggagaagggactcattatgccatttattccagaagatttcatgggcttcttaggtgctttgaataaagagccaatttctccgaggaagaaatttgcttat

SEQ ID NO: 29356 - DNA, 2254 bp, Heterodera glycines
  misc_feature (13)..(13): n is a, c, g, or t
tacacataccccnggtggcatcccgacgccatgccgttgtttttgttgtgctgcagttgttacagcgagacacggacggggacacgcagccttcactgtcataatcctgaaaattttttttaaaattttaattaaaaatttagttacttaacacacctgactatgaccattttagaaataaggatcagagtttcgatatggagtcgggattttcaaactactagtaattcaaaaagctcacaatgaaaaatctaaaaaaaacatctcaaaaaatttccgctcctggccttacaatttacgggcaacaaaacatgccaaaaatcccccagctttgccaactgagcgccaaccgggattttcaaaattggattttctccattaaaacttgtttaaaattatcggattttgttcacttttggatgtgtcgaagactataaaacacgcgaatatcgagagtagttctaccaacacaatcacaaacatgacgacattattccttttttgttcccacctgttgattctcacgtgagcccggcgggcttgcctccatcaccatggcattatgatgatcactggcgtccagcttgatactgttgttattgttgttgttgttggtgtgcttgaacagttggaagtcgtcgccaaaaaagattccgccgcccccgtcgggtggactcgtcgcgttggcaccgccgcagccaatcataacaatgccgccaccatcattggcattgctaccattcttcaacagcaacggttgttgtgccaccgctgttgcagttattatgtgctgcgattcagcagcagcagcactaagcaagttgggcgaggttgtggcatctgttgaattgctactaacaccatcacaatttgttgcaccgctgccgttcagttcggcaccgacaccggtgacgccgccgtcagcagcaattgtgccaatgccaccaatgtccattgccgtcgtcgtttccgtggtcggtgtcgccgccgcgttgttgttgttcagctgatgctgcaacagaatggaatagagagcggccgcctgctgtgttgatgccgccgtcgcagcagcaactgatgaagcggcggaggatgaagcggatgaggcagcgctgcacgtcgacggagcagcggcatgaacagaggacgacgagacggcagttggcacaatgccaaacaggttggccaacaacagctcatccgtcgtggttacggtggtcgtcgataacgccggcggcgatgcttcaacacggtagccgccatgcgtcgttgtactcgttgccgtcgtcgtccacggcaaactgttgttgctgttgttggccgtccgtgccggcttccgcttcctgctgccaaccgcggttgtcgttgccgatgttgttggcattgtggtgccgccggtgccagtcgacgacgcaaaagttcccgccgccacggtattgatggcaccaccgctgccgccgccattgtcaccgctgatgttgtgccgctgctgttggtgatagtaatggtcgttactaccgatgatgccaccatcgttggatgccactacaatttcctcctttaccgtaatccctcgcggcgatggcgacgatttggcaccaccgtcaccgttcgttgtgatggcggcgccattccacgtggcggatgatgtgtaactgaaattatttacacatttatcaagccctaagtttgagttcaatcgaaattttcggaagttctagtgactaaaaaaatgctcgttttgtcgtgggactcccggcgggtgccatccgagtctctaaagaaaccaagttggcacggctcaagattggaacccaagactttatctcaggtcgagactctcgattatgtcgggacttttctttttgcgcttgtccttttggcgcttccacctcggtgtcggcattgttggcatttccttgacgcccatccgtttggaaaattgaccatttgtccttgttggaatgccttttgtctcctgctgttgctgctccgttctctcctccgcctcttcagcggttggcaccaccaccatcccggcaccattattcgttttccggccaacaacaacagctgcttcaacgcgagccatttgctgtgccaatctgtccattttgccgttcagttgggcgaccgcgtgacgcatttctgtggcacaatgaatggaaattggtaaaaaaaaaattacaaaaaattttaattccggaattctgttaaggtctattcaggaaattcgagtcctggtccggatttt

SEQ ID NO: 29357 - DNA, 1113 bp, Heterodera glycines
aataaaaataaacatcttgttgcaatttcgtttgaaaatttagtatttatgatgtgattagggtgggtggaattgcatttccggtctaatggaaacaacggaaatttttctgaagcaatggagaaaaaagacaaaatttaatggaaagtggaattccacccatctccgccaatttgctgtgccacttccaaatcactgctttcccactcccccattggttcattcgcttttctccggcaattccgcttgtgccacacttttgaaggacgagcgcaccaaacgcgagttcaacggctgcaccgcacggatgggctgcattgtttcctcaacttcgtcctccgcccgactctttcgcagttggcgcagcctttccaattgtgccgtcgaaatgggcaccgccgatcggcacacgacccatttgacctgtcatccgttggcattttcattggcacttttccgcttttgcctaccgtttcgcggaaaggctccgccgtttcggagccgtcgtacagccaaaactctttgctcttctccacgggcatcagttgggagaggcgaagcgaatgcattgggcactcggcgccgcggaaagtgacgcgggccaaagcgtcgtccagcggcgccagcgtcgcgttgtcctcgaggttttcgttgaaaaacaccgccacggccaacactccgtccggctgcttcaacgcttccccaatgttcggccatttcacgctgcggtgcacaaaatgcaattcgccggcgtagccgacgccgccgacggtgtgctcagacccattcattggctctgacaaagcgatggcaacggaaaatcaaatgaacggagggggcgggggggggggagggacggcacctgtgccccatcgaaacacattgctctccatgtggaactctatcggaaatgcatatttttgtactggactgtggaaggcctggaccgtccgtgaaagatgcctttaacgtggttcgaagcttctacggatggatttctatatccatattttgcatatttttctcatatttcgcgatttatgtccatatttcgatatttttccatattttggcattttggtccatattatatgtccatattttgggattttt

SEQ ID NO: 29358 - DNA, 676 bp, Heterodera glycines
gcttgctttttaaaattaaactactgaaatcctccgttaatgctataaaaatttctcacattcatcagaaaatgttatcgagaaacacatcatttactatgtagcaatagatttcaataataaatttttttattgttttattttttattatttgcgtagcgtgccaaaaatacattaattcttgaatatatttccataataatcgtagaagaatgaaatatgcttgataaaatttacaataatgcctgtggtatgactctctatttattttctgcgattctctaatccttctcacgagcaattttgatgctttcattttgtaatgaattaaaaaggaaaaataaaatattcttttatgctgattaatttatcagaatcgaaattatatatgcttgctttttaaaattaaactactgaaatcctctgaaaatgctataaaaatttctcacattcatcagaaaatgttaacgagaaacacagcatttactatgtagcaatagatttcaataataaatttttttattgttttattttttattatttgcggagcgtgccaaaaatacattaattcttgaatatatttccataataatcgtagaagaatgaaatatgcttgataaaatttacaataatgcctgtggtatgactctctatttattttctgcgattctctaat

SEQ ID NO: 29359 - DNA, 1792 bp, Heterodera glycines
tagtttttctttacatttttgtaattgaaatttcaattaaaaaataatatatcccaagtttatttttatttaattttcaaacaggctaaaaaataaattaaccaaatattggtcattttttgacaaattctgttaacatatttcactcaaaatttcaaaaattttccggcggcgcctatcggcacagccggaccctgccgccccctcactaatgttcccaaaagtttttttggaaaacagcgccacaaaaacagcgattaaaagcaaaaaatttaagaaattttaattcattaaaaaatccagaattttgggacccagaaaattgaaacagagaataatagaaaattcttcgaattcctccccaaaagaaaattttaaaatcttctgggcacatttttgaatttaggaaattttcgtaacaaagtgcactcaaattttcaaaattttttcaaaaaattttttcttgggaaaattcccggttggtcccggcttttctcgcggtcccggtcgaaaaacttggtcccggtcccgacttttctggtcccggttgttgtcaaattcccggtcccgaccagccctagtgtccccgaccctgaatcatttaaaaaaaaagatttcgctaaaggggcccatcgacaaaattacctcaaatttcttaagcataagaattttatttagattacaaattattctatgggcatataagtctgaaaagctcaagtttttttcatcaaatcaggcctccagcaatttctcaatttccttctcaatgttcttcggttctttggtcggcgcataacgctccaccactttgccgtttttatcgatcaaaaactgaaagacaaaaaaaatttaatgcaaaattttattattgtgttgccttggtaaagttccatttgatcgcatcaaagccgaggatgccgccttggacgctcttgagataggcgtagatcggatgctcattgggcccgttgacgtcaattttgtcgtagagatccggctcgaagttgtactttttggtcacaaagtctttgatgtcaatggcgcagcccgattcctaaacgaagaatgtaaaattcaaacagatataacaatacggctctattgcactttaggcacccaatcgaattagttggtaatttattttttaatcttattctttaatcgtttgttaattcagtgattaattaatatagtgcaaattagttaaatatcgaatgggttttcaattcacatccatttggcaacgtgcaatgaaaaatggattacgtcaccttcatactaataacctcaaactcttgcagtatcaaatacatgttccgtctctatcacaataaaaatactatcatattcttgatgaaatgcggtcatataatgctgtgaatcaaaaatttttaaactaaattttttaaaattattttcatcaaaaattactcgtaaaaaaagctttatcggacgcctgaagtgcagtagagtcagaatacaacctggttgttgaattggttgcacgggaaggccgcgatttcgagtcccttcgacttgtatttgtccagcaactgcttcagctgactgtagttggagtcggtgaagccgcagttcgacgctacgttgaccaccaacagcactttgccacggtatttgccaaagctggtctcattgccgtcaatgtctttggccgaaaattcataaatgcttttttgctgcgggtccgatggggcggcagaagacgaagaactcattgcacccataaacttgatgttgagtggtgacaagaatttaaaggcaatacgaa

SEQ ID NO: 29360 - DNA, 847 bp, Heterodera glycines
acaagggaaccacccgaactgtaactgctcaaatcaattttaaaccacttctatcgggtagagcataggcgatttattattgtaaattttaaatcagtaaaaatgaaaaattttttaaaaatttctaaaaaattcaaacattttgataaagtcatcaaactttttttaaaataatcagaaaacaaattctctatcaaatagaatctaaaataaaatacctgaataaaagtatgctaggtgaaataacactgaaaaaattcaaaaaaattaatcatctgcccagcggatccgaacccatgacaaatggtgaagaggaaaaaatgaatcaaataaacaattttttgctggatttttcatttgatcacttttttctgatcatttagcgactgcaccaaaaatgccgaaattttacaatagtaaatcgcctatgctctacacgatagaagtagtttaaaattgatttgagcagttacagttcgggtggttcccttgtgagatcaaaatattggccagattttttaagttttaaaaatttgcttgtttcctttatttatttttatggatttaattgttttcgctctcttttagcaatgcttcgaccgtcgtcacttccaacaattcatcctccgccaaccctccggcggtttcttcgtcaagcactgccaatagcatagcacagcaaatggtaaaaagaagcgtgagcagtttgttccacaaaaaatatataaaatagaaaatttttcgttttaaattttaatttgtaatagagggttttttctagtaaaaaaataaattgattcatttttattaggtaattgaaaaaaagagtttagaaattatttttatt

SEQ ID NO: 29361 - DNA, 926 bp, Heterodera glycines
  misc_feature (916)..(916): n is a, c, g, or t
tttccctttgatcggtactaaattgggccgaaaaagtgatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcagtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccatttttctgaggcccgaaggaaaatttgagagggctaatttatatgtaatattcgaaagtgccaagctaattagcgattcaggcgcacattggggcctgaattaagccattntccctttgat

SEQ ID NO: 29362 - DNA, 1087 bp, Heterodera glycines
tttaagcagaagtgggaaaaagcggtgatcactcattaatttgctaatttggttattaattttggcatttaagcgcaacatttcctcctcctccaccgccaatgcgtctctgatcgattttgaacgcattcggatgatcggcacgggctcatttggccaagttttgctggtcaaacacaggcggacgggcaaatattatgccatgaaaatgttggagaagcaaaaagtgctcaaactgaaacaggtggccaaattgaaaatgggagcagaaattccacaataaaaagcattttaaacatttcaaccaaaataaaaatatttcaaaaatacctgtaaaaaatttttcgaaattaatttcattaattggcaaagttttttcttaggtggaacacaccatcagcgaaaagcgcattttacaggccaccgaatttccatttctcgtaaaaatgcactactcattcaaagtaaatgacataaaattttgaacaaataaattaaattgtatcatttaattaattatttcgggaaataaattgtcgctttttaggacaccgccaatttgtacatggttttggagtttgtcagtggtggcgaaatgttctcccacctccgtcgcattggccgcttctccgagtgccattcgcgtttttatgccacccaaattgtgctggccttcgaatatttgcactctttggacgtggtctaccgggacttgaagccggagaatctgctcattgacgtcaatggatatttgaaggtgcggagcattgggttgagaaattggggacaaagacttatgccagagagtgaattttttaatttgaaaatattttatattttcaattataaattaaactgattagcaatcttatatttttcaaataatcagtagctttcgagaaacaaattgctcggaaataagccattaaaatagaattgtgtagtagcaaatgccaagaagcccgcgaaatgactttttaatttcactttttatacaaaaatagaaaaaaacatctgcagtaaaaaaaaaatataaattacgctttattccatttccttgtcaattacttaattgattttacatttt

SEQ ID NO: 29363 - DNA, 982 bp, Heterodera glycines
ctacatagatttcgcaaaaataaacacgattaagacgaggattatgtgaaaatattgtcttggatatcgaatcagcagaaaaatttatttgacttaaattcccatccctaattatcaggtttgccaactgaaaattttcaaaataagcatttggtcgacaaaaaaccttatcataaatatttaaatgtaatatatgcgttgtatgtttacagagagaaaaaggctaaatatggtctaattaagcataataaaactccaccaaatgattttttaaaaatatttggtagcaaaaatgccatcatttaaatttaaaatattttcaacttattttaattcccattggattgtttagtgattttccattgtctaatccatctattaacattttcaaatttacccattttcaaaatcaccaggcgacaaaaaatcattgaatcaaattcagcattatggaaaattttattccaagtctaaaaccaaaaaaaaattaataaaatttgtcaaaatattgattacatttaaatttttttaaactttttggtttatgtcaaaaataaccaaaaagtttatgtcaatattttatggccatattttgccattttatatccatattttttatgccctaaacataagcaataaaaatttctaaagaataaaaagttacacacagaaaaaaacaaccccccccccctctctctctttctctctctctctctatctctctctctatcttctcctctttctcccctctctctctctctctcttctgcttgtgtcctatctctctccttttctctctcaatctctctctttctctgtctctctctccttgtgtcttatctctctccttttctctctttctctctcttcccctttctttctatttctctcgctctctctcgctcttatcctctctttgtcgctctcaccttttctcctttctctctccttttgtctctcaccatttccttcatcactaatt

SEQ ID NO: 29364 - DNA, 981 bp, Heterodera glycines
aaattgagattattaaagaccggaattttgaaaaatgcaggactcgaggacggggttggtgaaagtgctagggcccatttgaaatccccctttttaggggcaccgtccccggaatttggtgcgaactttcaaaaattaggaaaaaattatttttaaaaaatttatttaattcaattggaaatgcccaatcaaaattctaattaatttcaaatcttgattattttttgctcataaattcaaaacatggattaaagtaattcatgttgttttttaataaattaatgattcatacgcaatgtccagtcaaaattaaaccaaattaaaaattcttcgattaattttttgctatttaatacgcggattgataaagtagtaattcattttaaataatataaaaaaattaaaattactgaaaaacagttaaaatctgacaaataataataaaatatttaaatgagtaacaaaaatatttatttaaaaaaatgattgaatttcccaaaacgacattataaacattcattttaaatattttggcaatgccagaattgtgatctctgttggtcagaaaaaagatcgagaaggttcttttattcacctaatgcattatcaagatcaaacttataaaaatatcgatgcaataaaaaataagagtgacagattcctatatttaaaatcaaaatttccaaagaacaactttaaatttaaaaatttgtactgaaaaataataaaaattaaaaaatgcctatcaaaaacaacattgtacaaactctttattaaaaaatcaaataaatggcaaaagaattataatttaaattgaaaatttttaaggcaatgcaaaattttttgccggattatttctcttaaactttcaatggatcacgggacaaaagggaaaaagattttataaaaacgtagtaatattatttgtgattggccgacacttgcgccgcgacagttgcgccgcagacacttgcgccgccc

SEQ ID NO: 29365 - DNA, 1797 bp, Heterodera glycines
  misc_feature (12)..(12): n is a, c, g, or t
  misc_feature (77)..(77): n is a, c, g, or t
caaaataaaatntaacatttatttcttaaattttattaatttacttctttatatttctaagtctcgtattttcaatntaatataataaattaccaatttttattttaaatcttatttctctttattgcgtataatttttgaattattattttgatttttttattatttggtctgcatttttttccaatttggttattatgcaggcaggcagtttattgtaatttgatcaaatatttactgcgaaatttcgtagtcttgttgggtacttctttctgttatcacctttaaatgactttacatgtttactatttttgaatttataatatatgtttgacatttttgtaaattaatttaaaatcaatttatgttgattttgaatatttttataaaaaatgatttaaaaatattatttatattatagaataaattgtaattattacgaataatttcttataatttttgttttcaaataaaaatatttatttatatacttcttcatttcttaatcaagggaatgtacatacatgttgtggttggaatttttggatattaatttaaaattaatttttgtagatttttaatattttattttttacaataaaataattaattgaaattaaaatttatttaaaatttctatttgttttcctttttgtctttaatttcgtcaggttcttcgttaatctaacaaaagtcatatttacgtataaaattaaataatttataatacaatttgtacaatttaatacccaattattcgttttcccattaattccggtataaaatttgtttttttaagaattaataaattaagtttttagtacgttcacagtaatatcataaacaaaatttaatattaattatattaaatttgattttttacaataaaattttacttcattttcattatcatttataagaaatgattcgtatgatattaattcttcttttaaagttcggttttgttattatagaaaattttatataaatgtttggtaaagttttagcggaattaggtttttaatatctaatggttttatacaaaaattgtttagaaaattttaattctatcaaataaaattctttttgcaattattgtcattattaacataccatttaatacattttgtagatcactattataaactaaatcgtccacgacccccgcattttgtaaaaatccttactcttttttgagttaaataaatcatccgagttcgtttttacattaattcttaagtaacgttaaatcgaattataaaaatacatctttctattccataccttttttacccttctgtttttgtttttttttagaaaaaaaatcatttgaggagctttggaagtaaaatttgaaatttaaacaaaagatttgcctaatattttgattatccctttactttggggtaaatttatttatttgttagtaacaaaatgtttgtttgatttttgttcagattattacttcatcggatattttgtactaattttactgcgataatttttgataaagtttataatcgtttctcattcttatactaaatttaagaaaaataaaatttaaaaaaaaaatttctaaagagagcaaaataaaacaaaaaactttattcaaataccttatttaaccaaaaaataaattcttcaaagacaaaaaaaatacggaaaaaagttaataataataaacaaaatttttatatataagaaatttctagtagttaaaaaattaataaacaaacaaataaaaaaatgttacggaggcacatctgcgtaaaaattgatggcacgcttgagcatttt

SEQ ID NO: 29366 - DNA, 973 bp, Heterodera glycines
taaattgtttcttttagtttttttatgaggtaatttaatacgatacgtccttcagagttcgagagtgctgtccagctccatttttggttgaagagagatgagatcactgcacaaataaagcgttgggctgatgaatggagaagccaggctaagcaggacaaacgattcgcgtcatcagccaacgaattggaggtggaattttataggctattttgaattaaaagttagtccaatttgtggtgtagtttcttccataatacttgaattaaaccaggcatttaataaccctaattgattatataaaaaaaaattcagaaattgctgaagcaagtgagcgaagaattggagaagcttaagaaattgaacctgcccgaatgaatcgcggccttgcgattgacatcttattgttagggcagaagcgaatatattctttcttttattgttttataataatcgcggaccttcttaccatttaatgggttttaccactgatctgaaattttggcaattgttttgttcttttgctgctataaatgaatgtctttaaattagagatcggtattttgtaaaaagcctgtacctgtacctgtacctgtattccaaaaatggcctgtacctgtattttctgtacaaaaatacaggaaaatacaggtacaggaaaaatacaggccactcgaggcctggatccaggctgtacctgtattttttaatttttttataaaaaacctttttaattaataaaataacgtaaaaatacctaaaagtatttattattaattaaacaataaatattgcttaataataatgtatttaaactttttttgtacatattttcatttttttaaatattttgagaatttttgaaaatttttgaaatttttcttgagaaaaaaaacaaatatttttttgaaaatttaccccattaaaaaatactaaaaattaatttttcccaattactaaaagaagattataa

SEQ ID NO: 29367 - DNA, 1798 bp, Heterodera glycines
tgaaaatgtggagtgtggtgtttttttttaaattccgtttggatgagaattcccaacctctctctgcttcaccagcagcaccatgttccggccattggcttgtcgtccgtctctcattcgagttgcatacatacaatttgggcaaaaggccataaataataggacagaagcgaaagagcaaacattggcgggggaggggggggggcaggggacgggggaggaattgtctgatgggcaaaatggaataaattgcacttcgaccgcaccgccgatgtgaggggactgggcaggaggggaggcgaagatgacaaatttattgttttgttcgacggtttgatggtgcaaaagtgccaaaattgggagggactgctcccccctccctcccccgaagggcaaatgccctcggggaatattgcctaagtgcaaaatgaaaaaaaaattaattctttttttttgccattggtgctgctaccgaccgattggaatgtatgctaaaaagttcgaatgccaatgttttttaaaaaagaaattattagtgtcgacatccggctcaaatatattgggttgggaaatgtcttaaaaatggtgcaagattttcaaggactaggttagagcatcactcctaaatgaaataatatgtatcacaacacacgctaaatatccttggttggcatcacaaaatgcaaacaaagttagaagcgagcacttttagccattctaactttttgccatgtttggaatgtcaaaaatggcaatttttattaccagtgctcgaatggcagaaaattcccgagactcgagaccaaaacgtgtggcctcgagactatcgaacagcactaacaatcacttccactgcagggaagctgttcaacgactgcacaatgagcgcaacaccgtgttggacgagttgcgagtgttggcgggcgagggaaagctcattgagcaagccgagaagacgaaaaaagagttggaggaagagcgacgcatgcatgccgaagcaattcagcaaatcaacaaggtcaatggacgaacattaattagtatttcatctaacatatacctaagacaaatctcgagagattttcctaatttccggcacgtgaaaaaatcaggcataattacgtggatggcatggcatggcttaaaaaatgagacaactctattagagaaaaattgaaaaatgcctaagatttgataagcaaacccaataaggggagacattttcaaatgttacggtatcacagtatatttttgcaaaaaaaaaaaaaaaaattatggcaaaatcttaatttcaggataaggatgaattggaacccgtgctggccgaagtgcgccaaaaaaggcgtcgaacggaaaccgagttgggccaacgatatgccaaagtgccatttctgtgggaccaactgagcaaacgagcgcgtgagctggaagtgccgtgcgcactgatgacaccggagggactgttgccaaaaactttgctgtccgagtgagcagtcgtgctttactttcgcttgatgaaatttcttagaaaattttattattcggggccggggcctggacatgtcggcaatatgggtcatgaaaagattcccaaaaatgggacaaagtaatcatcattaataattcttttaaatccatggattttgttagcgtgtaataaaacacaaaaaattttttgtttttcgctatgccaaatttatggcgctattattcagtggccgtgaactgttcatccgatcaacaacatttgaagaagcggcaccaactgttgtcagtagtgatcagcagcagcacaatg

SEQ ID NO: 29368 - DNA, 639 bp, Heterodera glycines
aaacaaaatatagcgtgtgaagaaatatattttcgccatttctttatgtggagcattcgattgattatgatgtgggggggtggaagaactggtgcacacctcagttgaaggagttgaatggtacggatgactgtttgtgcagaggggagagcggggggggggcattgacgggcgaaaaaaaagaagaaatggatcaatgatatgtggataatgagaatatatgaaaagattcggaaaatgaaagaagaattggggaggggggattttggaggaaggaagggaagtgggggggggggttacaacggattaaggtgccatacactactctcgtcgcctttggcgtctaccaaatttggcagtgccttgtcgaggaagtgccggaggcccgcgccggcgtgtgccgaattcggtgcgcatttgcgggagggagggacaaacgacttgggggaggggaatccaaatcggtgcagaatgaaatctctaactaaaacgccgcggggaaaaatgccaaacattttctagtcagcttacttattagcatttcccattgattctaacgctatctgtctgttaacgtttttttgcttccatttttcaattttctcctctcttttagcataggcggcggtgtgtcgcgca

SEQ ID NO: 29369 - DNA, 989 bp, Heterodera glycines
tgcaagtataagcgcagaagtgaatgaatgggaagaacaaataccaaggaaaaatgacagaaaataattcagatgaaaaaacaattggaaggaaagacgaaagagtgcgacagtttgaagggaagtgtcaacgagttacaaaaacaactgatgaccatgggcacaacgacaatgccaagggaattaaacgaactgaagaacgaaaggaaggacctcatgaagaagaacaaagaaaaggacgaaatgattgcgaagttgaagaagaaaatggatgaagactcacgaaaaatggccaatttgttgggacaggaaaagaaaaaggaagaggaacacagaaaaacagtgaacgccttaaaggatgagtaccagcgaaagatagaggaagtgaccaagaaaaaggaccaatcgatagagaaacagcgaacagagaacgatcgattgaaggcggagttgagtaagaatgagaagacgatccaggaacagaagcaacagttggtgaaagaccagcagcagaagacggacagagtgggcagagaggaggcactccgcgagcagaagagacaattgacggagcaacaccggacagagaccgaaaagctgaagactgagatgcgcaaaacggaggaggaggcaataactcagcaaaggaaccaaatgatggaagaacagcgtgaaaagaacgacaaactgaggacggaactgttcaggaagaaggaggaagcactgctcagacagaaggaacaatttgaggaggaaagtcagcagaaaatggacgagttggaggcgaaactgcgcaacgaatacaaactgaaacttgaacagagcgagaagcaattgaggagcgaattcgaagctgaaattggccaattgaagcggcactgcaaccaaggcggcagagactgacaatgagcaggtcgctttgaaatcgcacgttttcccccttatgccattggcattttgtaaactgcaaaaaagctactgatgcaaat

SEQ ID NO: 29370 - DNA, 1064 bp, Heterodera glycines
  misc_feature (996)..(996): n is a, c, g, or t
attaattggcgattattcattaatgaaattaaagcataaaattgttttagaatttagcaaagccaaaatataaaagggcaaaaatttcttctttttttactataattttaagataaaaatcccttctcaaaaaagttttcgtcattttattatgaaagtgcgggaaatccattttaagatgaaaatgggcttcccattctgccgctgaatgaatgcgtgccaatgccaatgccattttccatttacgcccctcccacacgctcaatttccgtcccgcgactttgtgactttttggaacaaaacctatcaaaaagtattagagacattttgaggacaatgaacgaatgggcacgaataaatatttaatttagacaatgaaaaaagggggaaatgaattttgaaggaaccaacgaaatgattaatttgctaaaattaaaagcaaaattacggtatgaaaagcggaatatggtaataagtaaggagtccaaaaatatgcacataaaaagtgaaaaatatgtacataacattttcaaattgatggtgtaatttctcaaaatttctttaaattcgctaaatgcaaagtaaaacttacaaaaatggctaaaatatggtaataaaaatcattttagaaaaaaaaacacgataccagcttaaaatttactcattttagcgaaaaatcaacctgaaaagcaaaatttcgctttttatcttattttggacataaaacgatcaatttttaagaaattttaatttagtcaatattttcgacaaaattttgctaaaaaatgactttttcggaaattttttcggtcaataggggtcaaaaaggccaatttacctgatagggccgttctaataggggtatcttgaaaaaatgcccaaatatgcacataaaatatgcatgaaatgccaaaatatgcacaaatatgcacataaatcgcgaaatatgcacaaatatgcaaaatatgcatatggaagtacggcctagaagcgtcnaaccagctaaaacatgtttttcgtgtgttcaggcctcccagatcccagaacaaatatgcatgtgcata

SEQ ID NO: 29371 - DNA, 1254 bp, Heterodera glycines
  misc_feature (1244)..(1245): n is a, c, g, or t
ctcacacagctccattcaattgcattttacacgtccaaattgattttgagccaattgttcgatcaaaacggggaggggagagggaatgaatcggggaggggagggggggggaaaggaaaataaaaaacattggataggtggtggccatgggcgtcgattttcaatggaaaacttgtccaacaaaacaacaataattacattatattgtacaataatatgtataaattttacagcatttgttggtcctctctttacattttttttcaaaaaactcctcagtgatgacgattttctgatcacaaccaaaaatttttttcaatgatgcatttaaaatttcattaggctgttccgctacaaaattttttaaatttaaacgaaatcctctccaaataagatcttttaaggatttctaagcgttagtggcactatttcaaataagggcaaaatcagaaaccaaatttcccagtttttttaacctcaaagaacccaatgatgaaaggtgctggatcattttacttgtcaaggaaaacgagacccccccccccccccgatcgatcaatctttttttttctgacggcacggattgacgccacagcagcccactgactgactctattcatttcatagcagcggttcatcatcatcagcagatctcattaaaacaaatgagcttaaatgtgcgcgcgttcattccgatcaatatgtagactatgaccacaaaaatttaaaattaggctattttttcattataaattctattagcaggggtgtaaatttagtggtaaaaaaatttttattgcactttacgagtcctattaattttatgagtccaatcaaatattttgaatccatcgatcaaatatttatgagtcaataaattttgcgattaactgacacttatttttcattttcatttttacgcttaaaaatggtttacgacaataaaaaataattggactcaaaatttgatttaattaattaaataactcataaacctgattggattcaaaaaatgcaattattctcataaatatttgatcggaatcataaattccgattggactcataaactcgtaaagtgcaatagaacccaaaaaagaaaactagattaataaatgagcatttttatatcggtggatagagagaggagagctctctaatgatccctcattgctgcattttattttatttatttactttttgcattttggagggtaattttttttcaaaaaatggaaaaatanngcgctagaa

SEQ ID NO: 29372 - DNA, 700 bp, Heterodera glycines
aaaactggtcatcattggcataatttattgacaaattaaatccaatcttcctttcgttgaaattaaaaaattaaattttcctttagtaaatcatgaaaagttaatatttttcaaattattttttacaaaatataaaaaattacacggaaattcacaaattttgggtgaaaaactattagaaaatataccttaaatttcaaaattcgcccggcgctgcctatcggcaccgccggacccctttctcctaaaagtttttagaaaaagagcgccgcgaaaaaagatgatttgaaaaacaaaaaaggtgatcagaaatttttgggcattttttgaataaaatccactatttttatttgggggccggcgctttaggaaaaatttgaaattttgactattttttacagattttgactgaaaattggccattttaaaaatgccttatgcatttttaattaattctatacaaaaatatttatgataaaaagaaataaaaaagcacataaaataattattatgaataataaaaaaaaatgaaactaaaacaatataaaattttttgattatatggtataaggcaaaaattgaaaaaccccgaccccgaccccgaacgatttggcaaccccgacccgaaccccgacgctgctaacccccgacaccccgaaccccgaattttccaaccccgacgtcggggttgcaaccctaa

SEQ ID NO: 29373 - DNA, 1047 bp, Heterodera glycines
aaaagataaaatatgcgaaaatgcgaaagcgaaattttttctacaactttttaatagttaaaagcataaagcaaaaatcattttttaaattttattccaaatttaaaaatcaataaaaattagggggtgtgtattttacaaaatttttagccgttttcgccaaaaaattactatttttgttattttgttctctatttttcaaaatatggtaaaataggggtccggcggtgccggcaggcgccgccgggaaaatttttgaaaatttgattaaaatttgttgacagattttcactaaaaaatgatcaaattttgtgatttttatcatttttctaatgagaaataagagttttggggcgccgctgaaaacagtttttcatcaaattaccaaattttgcgattttgggccattttctaagaaaaaataggagttttgggggcgcggcggtgccgataggcgccgccggggaaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctaggcacatccctggtttatatggttgccaagtgagaaaaatgattgtgtaaatcagtagtaatctgtgaattttgttaaaaattgcatttttttttttactttttgttcgggttcgtggtcagaatgattgtgtcataatttgattatccaatcgtgaacagcccaaaagtcaacttcaactcgaaaatgattttagttttttttctaaaaacagggaccgaccaccaccttaactattacccagatttttaactatttttagaaacaggaggccaatgatttgtctggcacttcattctccaaacaacaaaatgagtgcgacactcaaaatcagcaaatcaaaatgggaaacgaatttgtcccatg

SEQ ID NO: 29374 - DNA, 2106 bp, Heterodera glycines
  misc_feature (747)..(747): n is a, c, g, or t
  misc_feature (1954)..(1954): n is a, c, g, or t
  misc_feature (1962)..(1962): n is a, c, g, or t
  misc_feature (2007)..(2007): n is a, c, g, or t
  misc_feature (2037)..(2037): n is a, c, g, or t
tccccccccccccccaaaaaaaaattatttatcgttagcataacgattaataagcaggtatttgactgatgggtttttcttgtttaaattgggctctcaaaccaaaatttccttatttttctttgtgggtaaattcggacaatgccgtggtattggtcggatcgcacaaaataccggccctatccagagaaccgttttccccggtacacgcaaaggctggccattacagaaaatcaaaccgctgtttttcacgaccacaactacaaccagcagcaaccacaacatcaacaacatgcggaattcgggccatgggggacacaaaacattccgccatggcaatattatcaacaacaacaacaataataataaatgtcacacttttcgccatggcaacaagcatttctatctgatttggtccatcatcagcaacaacaacaacaacaacaacaacaatccgtacaaccgcatcaacaacctgggccagtacagccccatcctctacagcaacaaaatcaaccagcagcagcatcagcagcagtacaaccccaacaacatcagctccatcaacaacaacaacaaataactgcttggctccaaagacagcagcagcagccagtctatcatcaacttcaaaacgttcagggggcgcatcatcaacttacctcccactcagtgccagacgaaatttttatctacgatgactttgtaaattaaaattaaaaattaaaaaaaataaaataataaatntaaaaaaggatgcgcaccccacgacgagtacggcccccagcggtggcgatgtggcacttttcaatgccgcacctgggtccagcagtgcccaagcaagtgccacgcggcgaacggtataggtataatgaaatttgcatttcactgataaattttttcgaaaattaagcgcaaaactactagtcgtggaggtggtagtcgtgccagtcgaggacgaactacaacagcaacaacaacatcaccagcagatgaggcggttgaaaataatttaaaaaatttaatacttataatggatggttaaaaatttaaaaaaatgaaatattttaaaattgttaatgtaagtcttttaattgtatttttttctctaatcatttttaaaaatatgctaaaaaatttattattcacaaatatttatatcaatgtttttttctgattaaagtaacataaaatattattttatatttaaaaaaatcatttcatataatttcaattttaaaaattcattttttattctttcattgtttggcattatgttttagattactatatatgattgtgtttttttggtctattcaaatttaaaaaaatcagagtcgcttgattttttaaaaaaagtcaacgcaaaattgaccaataaatatgatcattacattttttaattgattaattcgaaatttcgttgtttcattgtttgacattatgttttttttattacaatatatgtgtgcgcgtttggcaattcgattttaatggtggagtcggttgaaatttgttaaaatcttctttaaaaaatggtcaaggcaaaaataattgattaattcgcaatttctttaatttaaaaattcattttcattgtatatgtgtttggcaattcaatttaaatgggatattcggttgaaacggtttaaatttttgaaaaaaaacaacgcgaaatgcccaataaatgtttttccccctctattttaggagaaaaaataaaaacaattatatgaaaataatgctataactggttgggttattggtggccgaatggttagtaacctccaatctaaataaaaattggtcgttcaagtacctgactgaaaagttaaattactatgattattgaaaatatctataattgccacgaaaacaatgtaaaatgcaataaatgcatgaagtaattaatgcgcaataaaacatctgtaatggtcacaaattgctatgtgcnaaggctanaaaaggtctaaaaaaagtataattaaggatttataaagccattanaaaagtgaaataatgaaagcaaaacccagnccgtataaatattatgtaattagtacgcgatagccagaaatgaaatatagcgttaaattattttaaaaa

SEQ ID NO: 29375 - DNA, 1470 bp, Heterodera glycines
tctttatttatttatttatttttataaatgaataattaattttccaaggccggaaatgcgttgggattaatttccggcccgtcagtatccagcagatatcatttaaaagaggaggaaaatcgtcgtaaaaacagttaaattgttggggcgaatattttttctgcataaatcattaccaaataaaaattttacaaatttttaaagagttcaaaaaatgtttaaattgccatgcattttacttccattttttgcactttttctcagtgattttattgtgggacaaccgatgaagagtaaacaatttgattttttaataaattaaagcgaaatttattattatttttaaatttgcagatgccgcagaaactgctgatcaaggaaaacagaaagaagaacatttggtgtgtccgcattgtaatggccacataaaacctggagaattgaaaatgcaattaaagggtaaacaatcgccagccgaacaacaaaaagtgaataattaattaaatattatttttaaaaaatataaataaatttaacaggaaaagccgaaagtggcacgagagcgccacccttggcacgtgatggacgatgtgcaaattggggaggaacatttgccgatgaataaaggggacgacgatgcccatttgagaatggaaaaaaagttgactcgcgaaacgatcggcgaacaaccaaagttttggacggaatcttctgattattgaaatttatgaaaaagcgatcaaataaaaatattaatgtaatttcattttcaattgtattgtatgggtttatttttttaaacttctttggttattattagggcacggatttttatgtatatccatattttttttcaacttatttcggcctaaaaatgaagtaaatagtatttttagcttggtttgatgcattggatgtctttttatttccatatttttccatctttcatattttgttcatatttccatatttcacttcattatttaggcatttccacaaaaaattcgaaaaaggaactcctaacgatggaaattttggaacgtccctaaaatcaaaaatttttgaaataaataccaaaaattaggaaaatttttgagaaaatatcgcgaaaatttttttttttttttttttacaaaaattacgtcaattttttctccgtacttaagaaataagaggtctcaattatctaattctatattcctgttttaaaattttttttcttgacagaaattttatgggtttggaatttttttttcaaaaattcaaacctattttcagaattttttgtccattttttcgtattttttgtccatatttcaacgttttggtccatatttcgtccatattttggatgtccagcatataaatccgggccctagttattatccttatctcatttaaaaaaaaaatttccattaaaacttcaataagcagcgaaataaaagcacatttcattttagcagaatttct

SEQ ID NO: 29376 - DNA, 875 bp, Heterodera glycines
aaactcttgagtaaattgacttgtagaaaatgctaaatttaataaggaaatgagagattttaaaaaatgccaagatttaagctgaatttttttaaaattccgctaaaatttgtttaaaaatgcatttgtacaacaaaaaatgccaaagcgttgcataatgctaataaaaatgggaatcaaatgccaaattaaaacacacaatgccaatgcttttgcatttaaaaattgcccacccgacgcgctgctgtgcatactgcgcatgcttttgcccgtctcgctgttcaactcctccgcgctgcgcaactccttcatgttgcgcagttccgcgaacggaatcaggcactctcgggtgaggcgatcgcgctcaagaaatttggcacttaaaattgtcgttaaattgatcaaaattttcatctaacaaagcgcttaaatgcaatttgatcaaaaatatttccaatgcccaaatgaacccgatcagagaatcccgacatttttcacgttccgaattacgagtcccgacccgaaaaatttgagccatcccaaccagaagaaacatgacatttttcacgccctgaatccgtagtcccgacccgaaaaatagcattcctgactcgaattcggcattttacgttcccgaaaaagttagccgccccaatccaaaaaattttgcctgacagaatcccgtttccgaatttatcccgggtcccgttttttctcatcccgcggcaaaattgttcggcgaggcgcgtttgcgattttccggcaacaggaaaaagcaattcccattgggtttctcagtttttccttgatcaaaaaaaaatgacaaaccttgaatgatcattttgtgataaatcccgaccggatactgataaatg

SEQ ID NO: 29377 - DNA, 920 bp, Heterodera glycines
accccccccccccctcggttctccaaactcaaaaagtttttggaaaaagaaagcgcgccgcaaaaaaaagcggatctgaaaaaaaagcaccgcgaaattgtttctggttgcgttgcctgaagaggacttagtaaattttcgtctccgaccccccccccctggacttcgttcgtatgaagtcgggtagaccccccccccctactatttcatgtatgtgctgaccgacccgatattaatattcaaaacaattgtaaacggattacgtcacccctccttagtttttcgctgtgttaattcatttgaattccttttctgtgttagtctgcgtcctctcctcttttccttctcctctttttccccatttctcctttttttgtgttagtacaattcttactctctgctgatattcaaattattattattgttttttctattaagcttctgttattcctttttccctcatttacaagaaaatttaaattgggaaaactgatttgaccaaatcaacaaattttgtaaaattaattctaattaaatctcaaaaagaaaggcaccaacaaaaagcattactttcaaatagccattatccaagcttattatattatactcattaatgtttttgttttattattgtatgtataactctaattgtaaaacaattaatgtaataaagcagcattttcaatagaggacaaagacaatttgataataaacagctaaaataaagggcgggggagtctaagaaaggctaatgaccaaacgaacgaaatgggagggaatgtgggacaattgttggaggaaacgaaaaacgatggggaaacaaaagaaatattaatactttatttggcggtggagagaaaaaaaatgaatggacagcattataaataaacaaaaataaatagcgacgaataatttggaaa

SEQ ID NO: 29378 - DNA, 945 bp, Heterodera glycines
tatttttttatcaagaagaaagaaaaaatagtacaaaactaataaacacattaatatgctaataactaacggatttatcaaatgtaataaaccattaagaaaagaagatgtttttaataataaatgaattatagagaatacaactattcatcaaaaaagtaaataattaatataaataatttaatcgccaataatttttcaagggcggacaagtacaacgcgacattgcgcttttgaaatatcatttttttcaaattaatttcttattttatgataaaaatttaaatgttattaaaattaaagaaaaaatttaaaaaaaattcaactattataaaaataaccattttaattgatgcataatttattaaatattaaaaaatatgaaaatcaaatatttaattattgattttaccaaaaacataatcaaacaaaaattcagaacaccatacattcacttagattatctacaacatcagagcaagataattaataaattaaattttaaattaaataggcaaagcacaaaagatagagaccgatataatctgaaggattataaggacttcacactttttatgttagttaaacaaaagagttttcgcaaatcttgcaaaattggcagcaaataattaccgcaaaaaggaaaattaaattaaaaaaattataaataatacaatattaaaagtttttttaggaaaataattattttattaataatttgaagattattaaataaaaacaataaagtaaaacacaaaaaacaaatatcagaatttttatttaaagaataagagcaatcaatgatggaaatgtaacgatattgttatatcctatcaattgatattctgatacagaaaatcataattaatttatttttttcggaattaaaaaaagtaattttcaaaagccgacatgaataaataatgaaccttctcaaacaaaaaa

SEQ ID NO: 29379 - DNA, 1263 bp, Heterodera glycines
  misc_feature (39)..(39): n is a, c, g, or t
caaaagcagaacgatgaggacgatgatgaccaccaccgnaagtgaatgagtcggacggagggcaaaattagcacaatttggcggacggccaaggaacacattttggcatcagtggaaaagaacgaacacgcggaacaacggggagggacaaaacgggagaagaagcccaaaacggggggggggggggtgccatgggccaggattcgcaagagaagatgccttttaaatacatcactcctttttcttcacccatttttggccaatcatttgcactctttctttgtcagttcagttttttgacttttccttttggtcactctgctgtatttgttgaacttctcaagtgccttccaccggccgccgattgtcgcttatttttccgtgaaggacacttttcgtaatgtaatgggaaatggaaagagagggggggggggggagaggacggaacgggccagttccgtctgagccaagtttagagcatcacaacttttttaaaatatgcaaaaattctgactttttggtagtattcatgttgcaacttttttataagttgttcattcgcttagaaatagcttatcaaaagcttctaaacatgtagatctttcgaatgatgccaaatttataaatttggtcaacaacgaaaagaagttatgatcttttatgcttggctcagacggaactgacccctaccggcgggggaggaagagacgaaacgaatgaaatatttggctaaagagaatttataagattaaaattattttttatcttttttcgactttcagaaataaaaacaataaaaatgggtccattctatgcaggttctaacgaaattgagaattttagacttttgttcgaattcgggtccgggattcgaaattggtcaaaatgagtttcagattcgtgctcagcgaccccgaaaacccttagaaacgtactttcagtgacttttaaaaagttatatttaaaagaaggggggttttgaaaattttttcactttttttttggctttaattttttttttgttttttacagcaataatgaatattaagtattaatagcataattatggtgaataaaaagtatattcacgatgcatgctcccttttgcgaaattttgcttttaaattgttatttcccgtttattatttttcggtactgaaatatccattttcactgggactcagttatcccggtgcttagatggcgtcagttcgacttttttctttggtttttagacttaacaagccaagagctttcgaatga

SEQ ID NO: 29380 - DNA, 1404 bp, Heterodera glycines
  misc_feature (71)..(71): n is a, c, g, or t
aaaaaaaagttttgcattttaaaattatgggaaaatggcaattcgcgaaggaaccccccctcccccccccnccccctcctacaaagccaaaaccatatctacaagattataggcttaccaaagcataccttggcctttttggctattgacttcgattaattcagcttcaacttttagtggtatccatttacaacaatgtgatcagtaaacatgccaaagaagcgacatgcggctttttcgagcctattctcttcggtcccaacattattcaacgggcacaacattcgcatattgagctgagactgaggttatgttctttttgtcctttttactgaattttcttattttctgtttcgttttagtgccattttttctccgaccaatgatccctcgccaattccgatccaatccgtctcttcaaacactgaaaatacttccgaggcctttgttgcgggccttagaatggcggcgattgattctcttaatgacgcgcaagggacagtggacgagataagccggagggatggcgaaaaccaatcgacgggtcaaatgccttgtgccagcgaagcccaagcgggcgaagagcgacctccttctctcgaggtatttaattccaatgaaatggtgagaccgaaaacgggagaaaggttttcgtgattattttcattctttttttctaaactatttgatttgtgcactaattttttattttgatttagcgaagtgatagtgtggcgaacagtcttccttctgtcaacttcaatcagagtccgcaagatcattttgaagaaaccaagcaacagacaagagaaaaaattgcgcaggaaatgggttcattttttttttttgattttgtcatagaaaaatatttaggcttaagcccggatgaccctgtagtggaaattagagttcagcgggaaatggccatttacaataagagggcagtccaacagcaaaatgtttcggctactccgccgcctcttacggctgacatttcccccgctaccgaccaaaacagacaaaacattccaatggacacggtcagcagggaaatggacgaactgcgccaattgtgcgccgttagtcaaacgagacgacaaattccaacaaacgtggccagcaaggaaatggaggagttgcgccagcgattggaaagcgcaggcaatgcccaacagcagcagcagcaactccattcggctaacattcgtcaaaatgcactctcaacaaactcacaatcgtcaaatccagatacgctttctaagctgaaacggaaattggggagaagttcgtcaggggatcagttgtcagtgggcgtggagcagaaacaaccgcggatgaatgtgcagcagcagaatcagccaatgcttacggttcacaatccgaacattcaaatttcaatgcaac

SEQ ID NO: 29381 - DNA, 1162 bp, Heterodera glycines
ccacttcgtgcattgcggaaatgggcagccacccgtgcttccgctgggccaagtccaacacgggaatgagagcagctcctttatgtccctccgggaaattgttcaacagcaccgtaattttggccaaattggcttccgtaaattggaaaggcgtgttcggattgttccgctcgttgtccctgtgcacctgcagtccatgggcttaatgaaaggaatacgtatgaagaaacaattaatgaacgaaatgctccacctgagtatcgcctcaagggacgcgcagcaaaagaacagccaaaagggaaattgcgcaaatgcttagcaaacataataagcaaaaaaaaaagggaaacacactttaacagtgaagggaagtgaagtaaaaatgaacaaaacataaattgggagaaacgcatttgaataatttaccttttttttattcataattgctttttaacgataacaattgagttggacaattaacgcgggagaattcacatggagatcaaagggtaaacaattaaaagcacaaaattatggacccttattaatgttaaaagaaacgcacgaacaaagaaaaataaataaataaattctaaaatgaataggccagttttgaatgagttgccatgcacaaacagtcagtgtaaattgttgccaaagttttagcactcttttcaaattttcgccgactgctgctgactttgagcggctttttgacaactttctaaatcatacaaaaagcattaaaattagttttttaaaaaggcacgaccattccacaactgctcttcagcagggtcggggttgtcagagcaaaaatcgtttgagtcggcggtgtcgtgatcggaaacagggtaatccgagccttaatgatgggggggggggaagcggttaatgtgccaataagtagtcaattaggttaatgtgcaaatagtagtcgtaaaagccatccaaccttcgctggttgtctcctcctcttcctccttcactttttcctttccttcctccattccgttttgcccctcacttccgttggtgccgctattcccctccgagccattaatttcgttctcctttcccattgcaaattcggtccttcctcccccctcattcggctggtaaagggcacagttctgtggagaatgaacaccatctgaagaaa

SEQ ID NO: 29382 - DNA, 945 bp, Heterodera glycines
taattatgggcaattaagcaattgatggaccggcgcaatggtttttacaacaaaaaagaggacaaagtgaaattggccattgatgtgtcaccctgaaagaagcaaaaatggaggacaaatcataaatacaaaatacgatctgcgaaaagcctcttcattggattatcatcagggctcccagatcccaagaccaaatcctgggaccgtccctgatggacaattaaaaatataatagttgaacattttaagcgtgttttgaataaattttgtcaaaaatgcggcttttttgcccacctgaggcctttgaaaattttaatctgggagtcctgattatcatcctatggacctatatttgcatatttcttattgtttatcttttggcttttaccaatattgatttatggatttgttgaaactgctttttgttcagcatcttcttcttgagtgccggcttataaaaattattttcagagtccatggactaaatcacttttcctgcttaggtcaatgtttttgaatttttttggacgaagtttaggcctgtcgttaccacattatattttctttgcagcgaaggggaacatttttgagattttgctcaatttgttagtcgggtttgtacctaaaaattaattgtttattatttttagtgctaacaaaattcaattattaaaatttgaaaatgctttgtttgttttaagaagtgtctacaaatatgaaaatgaaattttatttcgtgtgttgagatggaacaggggtaaaagtgaaaactcgagaaatggttggacattttcatttcgcgcatcgcctcaaaagaaggttattttggccacttattttcattttaaatagttagtaaaaataataaaagctattaaactcgcgcggactcgaaccatcagctcagtcgctgtgactacagctatttttattttatacattttt

SEQ ID NO: 29383 - DNA, 1270 bp, Heterodera glycines
ttcgtttcccgccggcgtttggtccgatgcgattaacattactaagatcggacgaaagacaaagagagagcggcgccttccttccgttctccactccgtccgtcgtccgttaattcattcattcattaacatgcatttgttcgcccgccgttcagctcatccgttcccatttgatggccgcttgaatttgtgcgatttggcgccctttggcgttccgttccgtccgttcaattagcgacgcaataaattttacgccctcccccctaaggcgatggatgtgatttggcggcgatgacgcgccccgcgggcgatcgctcgcccatttaaattcgcgcgtttttcacagtgcgaagggagttttttgaggaaagaagacaaaaaacggaacggacgaaataacgggcggaaaaaccttcaaaaataattgacacttttcgtcagaattttttgacggcgtttttctcccaatttaaaatttaaaaaaaggagaaaatgcaattttcaagcaaaaatcataatttttttattaaaatgacagtctatttttgattttttcccataaaattccttcagccctcgggggattattttctgcccctttccctgccatttccaccgattatttgaatattttagtcgctgtcattccgcccaaatcccatcaaacgcattttcaattctttatgtattatcaaaatttaaaccctttgcgtaggggagcaagcagcacatttttcgccactctctgctgcgcctgctctgatcagcagaattttctatttaaaatattttataaaatatattaaaaaaattaaatattaataaaccaaaaacaaatatccctgtcttttctgatcactttggtcgttcattttcatttgtctgatcattctttcattgatcagtctctccctctttcattttggtgattttgagttttcattttcccccattttcagtgttctactgatcactttgccatttctctctaagtttctttctttttgatcagtgatcacttccttttttgcgcttgccatgatcaatcagtccattcattccgttcacttctcccccccctttccgttgccctttccaatcagtgaatgaatggaatatattctcccttttttggtgttttgtcatccgatcatcatcacaacactttttctccatttactttttcattcgaatttgggcgtggagagaaaggaaaaaagggggaggggaggggtaacaaatgatttggggggggggaatgtaacaaaaa

SEQ ID NO: 29384 - DNA, 1049 bp, Heterodera glycines
  misc_feature (895)..(896): n is a, c, g, or t
cgaccatccgccgagtttgaggaaaacgcaaatgaattaaaatcgctaaagagcaattccaaaaatatcgaagtcgaattggtttccttctcatttttgcgaagagaaaacgcggaggcgagaagatgtttgtcttgagaaaacaaatggaaaacgaagacaaaagcgaaccaactttgatccccaagtaattccttcagagagtgacgcgcaagaactttgccattcaaaaggtccctcaaatcgaatggggtcaatgggaaaattattatataattcagagttcccatccgtactgtatttgaaaattaaaaatattttaaattggaattttgctcattatatatttcatggaaaattttgactttttggtgttctattaaataattctaaatttttacaaggtgccgtctgtgcatcgtcgggtttttccatttaaaaatttacacaaaaattcttaaaaactggcggcgctaccgccactatcggatccttcgtgttaatttcttccttaaatgttttgaaattggttttacccacattttcaaattgaatttggtcgatgagaaccacttatttttttaattttacaaaagagagagaaattgttatcaaaatttcaaaacactcaccacagtgcaaatgaacccgcaattccaactgacaaacagagattttgctcgagttcaaggactgcaagaggttcgtcaaggcaaagttcaaattgaagccgtccagtttgagtactgagcacgtaaaaatgtgcgtcgaaagaactgaacaccgtccaacgactgtcaaagaattattgaaatgattatagagataataactggttattaatacttatgaaaattgaatccacttttgatattctttttttgtcactgataanntattagttgtttttgggacttgttacctattggccgagagaaatgctactgggaatgaaacaaaaaattcccaaatatttggttgattttggccgcggacattgagccaaatttggaggtcgactcactaccgaaacaacagttgagcacttc

SEQ ID NO: 29385 - DNA, 1875 bp, Heterodera glycines
  misc_feature (756)..(756): n is a, c, g, or t
tttatgggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccanacggacacttgaaaaaatcgatttttttgtttcataaatatttttttcagaaagtcatgcgcacccgtccgatctgcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaagggccccccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagacttttacaaaataatacccctgggagaagggagagggaaacatgatttcaaaaatttcaattttttctagt

SEQ ID NO: 29386 - DNA, 863 bp, Heterodera glycines
  misc_feature (843)..(844): n is a, c, g, or t
tcggggtcgctttccacgaatcccacaccaattttgacgaaatcctaacccaaattcgaaaaaggcaaattttcggtttttgttcaaatccgggtttggggttcggaataagttgagatgggtgtcagaattgtaatcaacgacctccacaaaaacccttgaaaagaagctttcacggttttttttatttaaaaatttttgaaacaaaagctctccctttcggtttttaataaaattacaacgccaagcgaagaagtgtaaaaatgtataaaaatgctaaaatatgtatgaaatatgtacaaaaacccccatgaactaatcaaaaagccataaaaggaccaaaaaagacttagaatcactttagtattttaaaaactaatttttgatatctgatttttggaaaaaacccgattttttaggggtacaaaaaattgtacatatgtaacagggaagtcgttcgtttcgtattttcgtgtttttagggcgtttcgtatttcgtattttggcacgaaacacgaaattttgagcactggtaagaagggagggataagtgaaaaattaaaggaggaaattttggataggagaaatttttgagaaaaattaagctatttatttcttttaaagtacattttcatgtgcttatgtggtctagtggataagccttgtgactttcattacaaattttatttttctttctttttaaacagcctaaaaacccacaaattaacaaagatttgatcacttttttgacaatttcttttaacaaatctcactcaaaatttcaaaatttttccggcggcgcctatcggcaccgccgtaccccacccacccccaatgtcctannaaagtttttgaaaaaaaca

SEQ ID NO: 29387 - DNA, 1352 bp, Heterodera glycines
aataaataaatcagttcctgtcatgacagaacttacttttcaggtaatataaatttgcatagttaggtctgcggtatctatgaacgcggaaaaaaatcagtgaaatttccgcctcgagaagaggatcgatgttcaaagaagcaactcgaagatcccgaagttcagaataaaattcaacaatatgttgatgaagcactcaaacgagttcaagatgactttcaaagggaagaggtcacaaatgttatcaaagcggtaaagcgcatcgcatttcatttgcaaaaaagtctattttagcttgtcagcaaaatcctcgaatctgacttattgactttgacaaaacctgaaatttacaggtaaaagaaatcattagagcctggattttaatgtacatgttttttactgtcttgctatggcctaatacgcatgaaaaacgcgtttttaacttggttgcgtttataacttggcttgaagatttctagcttgaaatttattgatacctaatccggcacgtaattttggtgccttttttaagtttcatgcatttttcgtgcatttttttctaaaaaacaattagtagtaaaaccagcgaaaagactacattaaacattcttggtatcattagatagcccttgaaatcctcatcttaatgaaaataaatataagaaaatttattcggtttcaaaaaagatatgaccaaaattgcaaaaaaattaaggctatgaaaattaacttttttcattccagaaaaccttgtggtatttatttatttatcagtacaaaggaaaatagagaattttttttggttgatatgataaaaaaactttgtcaaaaatttttatttttttgctgtctttttccagttttttttgtgcgttttcgctttttttacgcattttccatctttttcgtgcctgcctatgttaggtgcttatttgaaaatttttcgtacctaatagtccaggctctagcaatcgcatactaaatactcagatacctttttcctagcgttttcgacaaacttccacctcggtgaaaaatgctctacatctctctctactttaagatgagttttcccctttataggcatgcaagcatattttggtttttgaacccatttagtaaaagaatagtttcaacattgtaactaatgaagaatttttgataaaaattgtaactgcattttttcagaaattattttgtatgatcatttgaattattaaatacatatccttttattgcttagatttaataattttgaagcctacattttttgcggaaaaaactagggttcgagccccgtgggcgagggtggcttttcgcgggggcgggggtcagagtcgcgggggcggggg

SEQ ID NO: 29388 - DNA, 1793 bp, Heterodera glycines
  misc_feature (721)..(721): n is a, c, g, or t
  misc_feature (826)..(827): n is a, c, g, or t
  misc_feature (844)..(844): n is a, c, g, or t
caataggcttgggttatgccgtcaccacctcttggcactctgccagccgccacatgacaccacacccctccaataggctttggcttctcatccccgaccccccaataggcttgggtttcacccaataggttttggttttctcttacccactccttgctactgataccggagcccagcccttactactaacgtatttcttatttttattaaaacttatatttattttaaaatttatatgctatctaaaatatattcatttcgggtttttcttcagctcatttttcgacttttagaggttcgtttatgattaaaattgtaattttcaaattaacttcattcattcttgcggtggcggttgttacaccttctctttttcacttgatgagttaaattatactatttcataatggcatcttgaaacttagtacaacacgcattcataataaaaggacattttttatgaaataattcacaaaaattatattaaattattaaaattctttcacaaattataatagataattttcatttgcttttctcattccaatttaatttatgtgttaaatattttgaatacccgcgtcaattgattaatgctgctcatgcggtttcgatcacaattagaaacatttgaacttttagcatttttttaaaaatattaaatcggatattttattaatttttatttttagaagtgctaatttaatatattaatttattnaaaaaaatatttttttattcagatttaatctattttatatatccaatatgataaatctatgtatgaataatttggtaaaatatttatttaaaattttatgttttnncatacaaaggtcagatntagttataaatatcgtgtttttatcattaagtttatttttgtatgggttttgtattagatttatattttttaaattataattaaataatatttaattacttttcacctccgcactaataccctaagaaggatataaaaagattttttcacagtaatcattataatattttaaattaaaaattaagatattatctataaataacttttagcatttattttttctttgctttattttgtatattggcgcaaaaatataagaaaatgtataatgacttctttcttgaatatggtatacttaaaatataagtcataattatttggatttattaattatttactcttttttatttataaataataatcacctatcatgaagccttgcccatgatctccacttatttttagaatgctcgctgttgaatagaattacttatttaatttttgattctaatttaatcttttatttaaatgttttctaattttgggtttttcatttaattgtgtttagcttatgctttttttaatatttttttaatttcataaatttcttattcgtcggtcgaccaaccacggtattatacatgtcggccaaagcagttttttatatttactaatatttcaacaatatatttgccaaaatttttcatctattttacaagtaaaaataattaattaattagtaaatggccaacttctcaaacatttttaaattattatgcgatttatttgaattttattttttatgtcgttaaaatatttataatatgatttaaaatgttctaaatttcaattttaaggttttaatttttttgttatttttagtcaagattctaactgcgtataattaatataatttttgattaaattatcagtcaaaaattatataatagtcaatttattaaatgaatttcaatttgttatttttgcatttttttttgataatttatag

SEQ ID NO: 29389 - DNA, 1879 bp, Heterodera glycines
  misc_feature (11)..(11): n is a, c, g, or t
tggcgcttaanttgttcgcataggaaatttagttcaccgtttttatggctgacattttattcagcggtataacataatgttactttttttaataataaattaaattttaatttttttttcttaggctaccgcacatggctgtggctgatgttgccctccatttatgggctgtactggtaattttttttgggtaccatttgcagcatactgtacataaatgattacagtatgaccggtctttccgtaataccgcccccgccgctcaaaaaatgtcatgattccgacaaatactcaattttctaggatatttttagacatagtctacataaaatttctatttttttcaagaaaaaattagaaaatatatctaggatttagggaaaagccaataaaagtctaaagcatagacaaaatcttgagtttttcgacttttgctctatttattaatataattgaggattagcgcctaaactctccctgatcagtattttgatttgtcgtgccgggcgactgtataacgaaaagtaccgtatggaggggaacatataaagggaaagtaccatatgatacatgggttttttttctcaggttcctctttaccatgccgcatccgttcagcggaatttatgtttcgtggttcttcaacccgcacatgggataccaggaagatttggacaaaattgtttgtcatactgttttttttcattattttaaatgttaattccattacagtactacaacaatgtgcacgactttcacaattacgttgtggttactgtaattatgggcacatacctggcgttcagcatcttactgtaattatcagcaaaaaaatttataaacaaaaataattaaaataattttagcatcatgaaaacgtacaagtttaaatcgtccacccagcaaagttattcccaaaaaatggtaaaaattccaaaattaaaaataaaaataaaaatgcattttaaaatttcagacattcatccaagttgtgctgatcagctcaatcaacgcatttgctgctggaatttatgtgtacatgcaatacttcaaaatcagcaaagcactgattgtgattggccaactttcatggtaaaaagcaaagaattacgaaaattgttcaaaaaaaattttttttcaagctaatttaggcaattagattagcaaagtataattgttgtcattttctttacttatataatgaagaaaaattttttggtaaattaattgccgagcaataaacaatagtagaggctgcagaaaaaacatttaaattgttgtcgatgaaaaatgatttctgctgatcacctgcgctagaatttatcatttcttccaaaaaaatcaatttcataaatatcaaaaaacataattcaccgattgggatcattttcaattagtgattgaattcatttaggccttagaaagtccaaaatcataaaatataagataaatcaaaacattattcttcctatcgaaaccatcgggaatgatgatcatttttaaaggctgttcgcccatggcattccgtcactgatctatctgtgcttgaacaaaacaattcgcaaggactgcttgaagatgaccaccggattgatcagtcaaatcactggcaaaagcatcatgcaaacgaacacaacccgaatgcttaacactatcaatgtgctcacaattggtggtggacgcataaacatggcgaccgcgtcacggcacggcggtatgagccgagttgtgccgacaaattcaaccatgaacacaacgccaacaaacaatggtgaacgccaagtgaatgaagggcaagaaaaaatttgaatttcgtcctaaatggcgtacgggagaacgatataatgtggtttttgatcggcctaatgtgccgtgctaa

SEQ ID NO: 29390 - DNA, 1085 bp, Heterodera glycines
  misc_feature (1004)..(1004): n is a, c, g, or t
  misc_feature (1006)..(1006): n is a, c, g, or t
  misc_feature (1015)..(1015): n is a, c, g, or t
ccaaaaaaggaaaatctagattaataaatgatcatttttaatatcggtggatagagagaggagagctctctaatgatccctcattgctgcattttattttatttatttactttttgcatttttaataataatttttttcaaaaaatggaaaaatagcgctagaatgattttattttattttaaaatcccaaaaatgattttacatatttcaaatttcatttattttgttttacaaaatttgccaaaaaggcgcattttggatggcaatcccccatcatcatcatcccaccactcacccaacacaccaacactatgccaacgctttacctccacatacatccacatatttttttatttttttgcgatgccataccaatgcaaaaactctaagaaaattgtgcattttaaattgtttgtaatattttaaaaattttcgggtcccaacgccgtccgtcccccgtcggatacgcgttgtgtcggccaccagcagcagcaggagccgtgccggagaataatgactttgctcagtcatccgccgtcgtccaacaaaaatgccaccaaaaatccgtcctcgtcttccgctgttgttggcaccgccaccacagcggcgccggcggcggcatttccaatcgcgcaaataatcccgggatgcctttatttcacttcttacaacattcgaactaatgaggcctccaccaccacctacagcagcgataaaaattttgttgtgcctccgaaaaacgacgcaaaaaccatttacattgacattgacagccacgtgcactatggtctcggggaaaacaggggattgatggactaattaggcgaaattaggctaattaatggacttacaaaaaaaattccagcggatggacggactaattaggcaaaattaggctaattaatggacttacaaaaaaaaatccagaaaattacgctttttacaaattagaaaacataaaaagggtgatttgctcgggaatattgcatcatgctgagtttcngncgaatattnttaaaaattaggtgaaatttggctaatttaaagatttacaagaaaaaaaaattcagaaaataaacttttt

SEQ ID NO: 29391 - DNA, 1718 bp, Heterodera glycines
ctccaaagcacgtaaaacaaaatcattcgtcacattcatttttcccacaattaattctaatagattttaatgataaagaaatagttcttggtatttcgaagttagttagcacttattctgatttttcttctaatcaacgcatttttaaaggcaaaaaataaaataatttaacatgaacggaaagaaaaattggtttacctcacgaatcatgacttttcttgttttcaaccaaatctatcaaataaaaaagctctcattttaaaagtttttatccaaatgtaaaatcagcaaaaaatgctaaaatatgatattatcattttttcaataattttgtgaagttcatttctttaattcgcaaaaaatgttctttaggctctccaattggttacttttttttcaatcaatggatgctaaaccaaaaaaattacccgaacaaataaaaatgctgttcaatacgcttcatggagcggacgtccattttttggtcgggaaaggcagcaaaaaaacggcaagattgacgaattgatgtttccattaattaacaattcataattttcaataaaccctttcaccacagtgtgtagagaaatgggggactaattgtaatttaaccatattaagggcttaatggcacacaaaaccattctgatgggggcatctgaggtttttgaggcaatgttcaaacatgatgagcaaaacgagacgaaggccggagattgtgcgaaaaacaaattgtgaatttcaattggaaattttcgtttcagtgccctccaacccaattgtggtcattgacattgaggcgattacgttcaagaagatgttacgatttatttacacaaatgatttaagttccattgacggagacggaattgacattctttatgctggtaaaaaatattttaaaaatattaaaatttaaaaaaagaaatatttatttatatacagtttttaattttatttttatttacagccgaatatatttaaattctttattttaaaaaagaaaattacaaggaatatttaatcttatatattttttcacaaatttaaatgattttccgtttttacgaaaatttaaacccgatttttccgtattttcggatccgttcacaaatatcggttgaccgtatgatctgtaccgccttttctcaccactaagctcttcaaatttgaccaaaaattggtcatcttttatgaaaatctgttaaccgatcaaactaattttcaaaacttttagccaacaaatatcacctttctggactgatcgatgcgtgccgcaattttccaattcagaaattacccaatgttttctacgcgtttcggcaagcttcatttcttgaagagacggtattttaaaatttaatttcatatacatatatggccaattctttttttccactgcctttttccgtgaaactgatgaaaagccaagaaaagattttcaaaagtttgacatattttgactggcccaatattttcaaaggcaaagaaatcgtttccagatttagaaccagggaacggatttatatgtgataaaacgccaaatatgtacatatatatgtgtcaaaaaacccccaaaatatgtactaaacccaaaatatgtgtcaaaaatttaaaaaactgctcaaaataagtgaatttctcaaaaaaaagtctcattttttatcaatttcgctagcacaatgctaacctaaaaatatgaaaaaagtcatgaaaag

SEQ ID NO: 29392 - DNA, 1767 bp, Heterodera glycines
cattctaatttctgtcctttttgaggtgttaaactcttcagctgtgtgccgttactgtcgttttcaagtaaaacatatttgtttacgcattttaattataatattattatgataatcaacaaatgttaagaaatgcataatggttggaatgcgaccagaaggtcagttgaaaaacatttaaataaaattataaaaattaaaataaaataaaacaaaaaaagaacaaaaattaattgttttaagaagtgcaaacgaaaagaagccaaaaaagaaaggcatctgttaatacggcattatcagaagcggaaattcaaacaaatgcaaaaaagaagaagcagcagaaaattggaacgaaaattgaaaatgagaaacaaatggtaaaattaacgggaagaaatttaaacgatggaattaaaaattaggcaaaaaatgaaaggtggataaataaaaatcaaactatttaattaaaaataaaaatgttttgaataagaaaaagaatttggcattggcaaaggatgagccaattgcttcagtcttatcatctcaacaatcactgatcacacttgtaaaaagcgtgagaaaaaggatcgaatttttgcgcttaaaacgacaaaaggcatttaaatatttaaatttaaattaaaacaaaaaatatttaaaagggcgaccaatgtcttgtcaaaaagttggacatttgccaattgtgtgagatatttgagcaagaaaaggcactgtttgaggaatgccttttgaacgacgcgacggtggacggagaacgattgtttatggtgagcatcaaataaaatatttttgattaatttaaaaaagtggaaaataattaattaattaatttcaaataaattatttgtttcaatttgttttctctcttagcaatgccaaatttcgctggatgaccgacagcaaattgtgctgagctggcttattttggaaagtgccttttgcacattaaactgtggaggaattcagacaaatcgtgcgtatttgccagaaaagggatttgtggagctccacgtggacggattaacggaattttacaaatctaaattcgccctcgaagcaaaaagtttggccaggtgtttgcgaattcagcagaactgaaatagttttatttgcctttaaatggagtgcctttgtttcagctttgctcttcccattggcaaattctttttggaaagtctgtgccggtcgctccaaatgagccattttaaagggcgggtatattctatttatttaagccttgcatcgcaatttaattgggcaattaattaaggagtgtacatttttcaggaaaaagatgcaattttcgcacttttactgctcaatgcccaacccaattttgcgagcacttctgatccaaaagtcgtttcgtgccgagaacaattgaaacggcaaattttcaaagaagttttgctggacgaaacggtatcgcaaaacggcggcatttcgagtggacaaacggtgcaaaatgagcagaaaaagaaaatgaaaacggaaaaagaggcgaaaaaattaacggaaaaaacgcagaaacaaaatggggagggaaaaaggaggagagatggcacaggaggagaagaagaagcggaaattggcaaagggaagaaggagaaggaaaagcaaatggaagagcaaaaggaaaaggtgggggcaattagtaattgtgaaaagaaagaccatcactaatggaccaaattagggttaacgagggaaaagccgggactggaaaaatggtaagcataagcatta

SEQ ID NO: 29393 - DNA, 940 bp, Heterodera glycines
tgctgatttaaggcttgattcaaaaaactaattgagaagagaaatattttttgcttttatgaaatttggtagaagattttgtccaccaaaaagtggacatccgaatgctcagctgtgctcagtatcaactttatcccatcaatcactgatttggacatgagaactgaaatatttgttagattatgataaataaaatgatgacaattatgtcatcatttattgtctcctcgaaaatctccatttttttaataaaaataaaatttttaaaaatggtaaatatacaaataaaagtacatactaaaaaagtgtatttggaaaaagagacaaaaatggagacatttttttaggggagggcacacataaaaaattacggcaaaatgatgacctaaaaaagaggctaagaccagaaaagaatttgatggattgaattaatctcttttttttctaataaaatgaattgaaaattaattcccttcatttttaacagtgtaaaaaacaacatttgcttcttctctccaattaacttttttaccatcaataccaatttgtaaacaaattttgcatataaatagaaactagcgggtgcgtgaaccgtcggctatttagctgggataaagcgctgcgcgctttgggagcttcgctacctaggctgtaaagcgattcaaattgattgaattggttggagattttttttgaatttttaaaaaattttataggtttttagtcaacatcgaggctcaagacgggcgcttcgcgcccgtttttaaatttgttggccttggacgggcgcttcgcgcccgttattcaaattttgttggccttacagagattagaagagatacaacagtgattaaaagacgtacaaaagtgattaaaagaagtacaacagtgattaaaagacgtcaaaagtgattaaaagaggtacaacagtgataaaaga

SEQ ID NO: 29394 - DNA, 1023 bp, Heterodera glycines
ctccgcgccatcagggctttttcatgattcataaagaatcaagaccattttcgagtatttcaaaaaccatatacaaaatcatatactcaaaaacttatgaaaaagttagaaaaaattgactaaaataatccaatcattttgataatattgctttatcagttgatttgtaatgattttcaaataaaatttgggcagagacttcgagcgccgcaatttttgtcggtttggttaaatttattttcccttccgaattttcccgccccttttggtctttctttgctcctttctctcatcacttttctcacttctcactgttcccatccttcccttttcttctgcccattggccatatgaattcattcatttttcgcttccttcgcttggatttgtctttccggacggaatcaatcattccgagggatcatccgggggaagggggggggagactgaagacacttccattcatcagagcagctgctgctcggatacgaagaaataggtaaactggcaaatggagagaagcggaagagggacaagcgggaaaaggggagaaagagagggaggggagtgaaggaggggaacgagaaaaggggatagagagagagcggaagagagagagagagagacaaagcgggagggagagagagagggagagagaggggagacgacataatgttgaatcgatcgggtcgatcagtgtggcagttaggtgtccccaagaaaagctaatgcaccgacctcgaagccgtagtgccaagcacccgcgtattcgccttgtccgtccggcccagtgcaaatggcgtggccatgcgcttttctaaaacacagcgaaaattttagacaacataccaaatttgcatagattaaatttgtgaaaatgcttaataattgctctgcttgtgagcttattcacccctcttcccatcctccgcagtacgttccgccatcatcgaagacaaatcggcccccgatcattttcagcccgaaattaatgctcaatccgcgatgggatcacttggaaaa

SEQ ID NO: 29395 - DNA, 1410 bp, Heterodera glycines
taggctaatagagggcggagggaggccctctcgactttcttttaccgtttgttctctcattttcacgcaaacattggccgttctgatctttctttctttggggataatgccgattggtcttaaaacttctttgatgaactgttttggttttcagtttttggtcgaccgaaatggcaatgttgtgcagcgttactcgcccaacacagagccaagggacatcgaagcggacattgagaagttggtggctgccgcagcctaatcgcaaaaaccatttgaaagaaaacgaaatacgacgatcgacgagaccaaaaattaaatgatgttcatttaagcaaatttctaatttactttggaataaaaaaattatgatttagtttaaaatgacgggttaatgtaaatgcaaattaagttggaaaattttttgggcactgaattatttcctagggatttgaaaattcattaattttattcaaaatggatacccaattaattataattaaaataattcgaatgatgatgcaaattaagttggaaaattttttgggcattgaattatttcctagggatttgaaaattcattaattttattccaaatggatacccaattaattataattaaaataattcgaatgatgtcattgaaaaagaacaaggaaaaggaacctgaggtgatgtcattttaacttttctattttgtgtgctgtgctgggcattttattattcattcgttcctccgcctttgccttatcattttgttcatttcattccttttcgcgtaaacaaaaattttcaatttattattgctgagcaagtgggtatttaagcggggtttccttttgcaattaattaattgtaattaattgatcgtctccccaatggcttcttcactcaccattgaaaaacgctgcaaacttttcaacacaaaacaaatggaatgccaattcggtaataactagtaaacattttaggggctaaattaattatttatcagatttaaatttgattaaatttaacccaattatttgttaaattatattttgattaaattttacttttagatggaactgaagccggaaaatgtgctttttgtgtaaagcttccgtgtaaatttggagcagttaattgtgcagaggaagtgagcatctcttgtgtaaatccgcaagaattggaaaaatgctgcaagggtaatttacatgtttaatgtctaaattaaaaccaaaaataaaacggaataaaaatgaatttgaattttcgaaaataattaaattgcgagattttgaaaaaagcctgttgacaaaaaaccaggaaaatccaggcctaggaaaaatctagattgcccaaaaatggcctgcacctggattcaggtaaatccaggcctggatccaagtccaggtcgaactctaataataa

SEQ ID NO: 29396 - DNA, 1261 bp, Heterodera glycines
  misc_feature (35)..(35): n is a, c, g, or t
agtcatttgcattcgctttaaggcatgcctaacancggctctttttttctcacataagaaatttcttcttcagtcattttagccctttttagtccaattctaaatctattttcaaaaagttctttttttttcatcgttatccattagctttctttgttttgcttttctttgcgccacatatgatttcatagtatgttcttcatcagaagtgtaagaaaaataattcatttcatcgagatttatgctttctttgttaccatttttttcatttgttaagttcgtttctgaccgcttttgtttaccggagctttgaaccggttcaatccgcttttgtttaccagagctttgaaccggttcaatccgcttttgttttccggagctttgaaccggttcggcgtctaaatcctggagagaagaagagcaacagggagaatcttttggaaaattttgtttagtgcggaccattattatctgtgttaaaaattaaataaataggacaatataattgataattaattaaattgaacaattacaaataattttttttgattttattgcactttaggtctgtgtttaacgaccgataaggggatataatgatttggttctacatgacaatcaattttagacaatccaccaaataaacaattaaccagtggataatccgttattaatggaaaaatgccaacaattttttaaaagataacatttttcgttttagagagcccgaaaaaataataaaaacttttctaagttgtaaaattttttgtgatgatgaaaatagtctattactaaacccttatttgattaaaaaccaatttcatggtatcttggaaggttttaaatgaatttgaatttaattcctattaccattttcggaaaagttttcttatttcctaaaactcagctataaattatgtgttcgaaaaattattgattaattcaccaaaaaaaaataaaattactgttgaattgtccattgaaggtttttccgctgacggattagccactggtaaatgtcgacggattatcattgaaaattgtccgaatattatggattgtccattaacattaacaataacaatatcaataaatttaattgttattgaaataattaataagtaaaaaaaattattaaaacttttctaaaaggggtaatatgataaaggcgcaacaatcaactgtttttaaaaaaaatgtaattaaattaaatgttgaaaaaactaaaaagtttatatgggaatttaaaacaaaagggatt

SEQ ID NO: 29397 - DNA, 966 bp, Heterodera glycines
cggcgcctatcggcaccgccgtacccactcaccaaccgccgttctcgtaaatttcttggaaaaatgcgccgcaaaaaaaatttgttaataatctgatttttcagatcaaacttgcacttaaacataatctgctaatttcctccccaaaattgttaaatcctataatgggagatgaaaaatataatttgatacatatttgatagaatgaattgtaaaaaaactgattctaagcaatttagcaaaatgttctgattttggaccccaaaatctgattttttggacttgatgttctgattttgaaaatttctcgatcacacccctgattttactggtccaactctctgctgcatgtaacaactcactgttagccgagatcagcaaagatgccaaaacaacaacaaccaaaaatagggacgatgaagtcgacattttaaatttttaaaaacactagaataaaaacaaaattaaaaagaggaaatttaaaatgaaatttttttgttatttttgctttttcactgtagagcaaaagtgagaaataatttttttttcaaaaatttataatgatttgttaccgttcaaatgtttctatgtttaaagccttccattttttaattaaaaaagcacaacaaaagccattttctttcgaaaacctccgtaaacattgttttcaattgaaataaaaattgttgctgttttttatattgcttttttcatttcctttgttaaaaaaatgatttcatctcatagctagaagcaaaaaaaaaaagtgaaaatcaaaattatggcttcaattagggccaatcaattaggggacctgctgagcgagaattttcagaacaagaaatttcttgctgttttatgatgtcatttcttggtctcgatcctcttgtaacttttcaattcaatcactgttgggtctatgtcagttgggccccagccaagtttctggactttaacttttttctt

SEQ ID NO: 29398 - DNA, 981 bp, Heterodera glycines
  misc_feature (24)..(24): n is a, c, g, or t
gggggcctagctcgaaaaatttgnaaaattttcgaacatgtaatataccattcaatagagcttaaaaagctctacaattttctctaaggcaattttttgctaaaaccgacccctgacgagttatgggcccgggactcaaatgtcccgcttaggccaaaaaaaatttctatttccggaaaaaaaccgaaatttttccaaaaatcccaccaatcgatagagctcgaaaaacggttgtttgaaagtggtctccgttttccccggaaaaatcggcaaaaaatcataaaattcaaaaaccccaaaacctcttagggggcctagctcgagaaatttagaaaattttcgaaattttaaaatttgaaaaaatcgggcttacaaaactctacaataagtccgctggccaccccccgctcagttcaaaccctggcgagttattcgcccggtactgaagtggacaaagttggtactgaatttctagccaagtctacaagctttcctattataggtagaggcctggatttttttttgttttttagaaaacacttcaacttaggttcctaccagcagacattttttggttcaggttttaggaaaaaagttatgggcgttcaaacgcacgcaaaaataggaaaaaagtccctggtactcagttgggcctcggaccaaaaaacctatagttttcccagatgcgccgtctcgagctacccctcggtgcaaaatttcagccctgtacgcttagccgttcccgagattttgtttttgaagatgagttgcctaatcgatataacatatatataatcataggattcatcactatacgcagggattctgaggctttcccgatacgtcttttttttccatttttcatatagggatggaccatccctttagtcaatgttaaagggatggatcaatcactttaacattaactaaagggatggctacatccctttaatattgactaaagggatggctactatccct

SEQ ID NO: 29399 - DNA, 672 bp, Heterodera glycines
  misc_feature (651)..(651): n is a, c, g, or t
ttccagcaaggtacttcccaattttttgtttggaaaccgttgatgtgcagctgaagtggcggcgttggcaccgctggtcgttccgcccaaacggcggtgccgttggtggtgatgggtgttgtgactgtcaccgccacccgcactgcgtcgatgttgcagatttgatgatgacgaggaggcatggcgcacggacgtggacggtgcagacgaagccgcatcgccgttctgctgctgcggttgggctagcccacctgaacctgacggactcgtcgacgtgccgccaatcagaatttctgtatgggggggggggttgattattgacaaaaattgaaatgacaatgagcggtgaaatatacccatcaacaaaattgactcatttttgaatgaaaaataaatatcggtcaaataaggacaaaaccaaatcgctgaaagagaggtgaaaaaagagtgcatttttttcaagacgagaaagaagactaagcttttccttcaaaaatggattcaattttaaaatattggctgtccaaatcagtgcaaaacactttcacttttcaaaattgatggcccgaaaaaatataactttgatctgaatgtgccatctaaacaaaaagcaacgattcgcctattctaaaaatgagcaatcatttcccnaaatatgcctttgccaaattg

SEQ ID NO: 29400 - DNA, 1860 bp, Heterodera glycines
agtggcggcgcaaaagtggaggcgcaaaagtggaggcgcaaaagtggcggagcaaaagtggcggcgcaaaagtggaggcgcaaaagtggaggcgcaaaagtggaggcgcaaaagtggcggagcaaaagtggcggcgcaaaagtggcggagcaaaagtggcggcgcaaaagtggaggcgcaaaagtggaggcgcaaaagtggcggagcaaaagtggcggcgcaaaagtggcggagcaaaagtggcggcgcaaaagtggaggcgcaaaagtggaggcgcaaaagtggaggcgcaaaagtggaggcgcaaaagtggcggcgcaaaagtggaggcgcaaaagtggaggcgcaaaagtggaggcgcaaaagtggcggagcaaaagtggcggcgcaaaagtggcggagcaaaagtggcggcgcaaaagtggaggcgcaaaagtggaggcgcaaaagtggcggagcaaaagtggcggcgcaaaagtggcggagcaaaagtggcggcgcaaaagtggaggcgcaaaagtggaggcgcaaaagtggaggcgcaaaagtggcggagcaaaagtggcggcgcaaaagtggaggcgcaaaagtggaggcgcaaaagtggaggcgcaaaagtggcggagcaaaagtggcggcgcaaaagtggcggagcaaaagttgcggcgcaaaagtggcggagcaaaagtggcggcgcaaaagtggcggagcaaaagtggcggcgcaaaagtggaggcgcaaaagtggaggcgcaaatgttccaggcgcaaatgttggaagcgcaaatatggaggcgcaaatgtggcagttcacctcgagcacccatacggacattgccgcgaagggggagaatggtacatctacatcacaacattaatgggccgggttcgtcatcgctatttcctatttgtagggaatgcagaaagtcgatgatgtgcactaaaactgtcagtttgcattttcaggtggactcttcgcgtgatgaccttgaacttgtcaacagaaccgcacgtgtccaccttgcagttgttttcgtcacttccatccatacagtcactgtccccatcacagcgccaacttttgtaaatgcattgaccagaatcgcaccttgagaatcaattggagtaaaagaattgattaatgagtgattcaccgaaactcagagtccttttcacattcaggcttcgtttctttagctgtacagtttgcttcgtccttcatgtccaaacaatcagcctaaatgaaagcagaacaattgaccctattcctctaatattagtcgagaattacctgcccatcgcatacccattcgattggaatgcacgaagtcgcagaatgcaagtcaaagcctttgcactcaaagtgtttctcgtcacatttaagctctgaaatatcaaaaacagaaacctgacaaatttgaaaaagtcatgagcagaaagcctgatcagagcaaagaatacacaaaaaagatctgtaatgggagcatcagtgtcagcttaactaagccttagcattcaatctcatcatccttaaacacgcagtcgcaatcccctaggcaaattcatttctttggaatcctcgcgtaagagacaacggtgtaggttacaagtgaatgagaccagacatgtcatatgcatcatgcaaccagggtcaagaaaaagcgcagaagagaaattcattagaacaggattggcggggggttgttgctcgaataaaaagaaaagtctcctgaacacactacgtagtaaacaatttccagcgattctctcccccctcacccataataatatttcgttggccgcactccgcacgatgtgagggaattatgatcagagaacaagtcaagcgcacgtacgtacg

SEQ ID NO: 29401 - DNA, 1088 bp, Heterodera glycines
accgatgacagtgtcaggcggggagtttgactgggggcggttcatctgtcaaagcgtaacgcaggtgtcctaaggcgagctcagagaggacggaaacctctcgtagagcaaaaaggcaaatgcttacttgatcctgattttcagtacgaatacggaccgcgaaagcgtggcttatcgatccttttgaatgtgtaaagtttccagcaagaggtgtcagaaaagttaccacagggataactggcttgtggcggccaagcgtccatagcgacgtcgctttttgatccttcgatgtcggctcttcctatcattgcgaagcagaattcgccaagcgttggattgttcacccaccaatagggaacgtgagctgggtttagaccgtcgtgagacaggttagttttaccctactaaagacctgttgctatgatagtaatcctgcttagtacgagaggaaccgcaggttcagacatttggttcatgtgcttggtcgatagaccaatggtgcgaagctaccatctgagggattatgactgaacgcctctaagtcagaatcccgcctaggcaagatagcaatattcttgctccccggtgtcgggaggcactacttatgcgccgcttgcggtgcagcacaaatgccccagcatctggcccgatgtgcgtgcttaattgctcgcacattgccaaagccgtagcactcgtgtgccatggtggaacgtcggggcgcaaaatcacttgtatacgacttgactactggtcagggggttgttagcagtagagcagcttttacactgcgatctgttgagacttagcccttgatcggatgatttgtcttctttttccccctttactttttgtgccaacaacattttaggtaaaggtacatgagaagagaagggtctctcttaagggagtcaaatgcctcgttaccaccgttaagtcaggtaggcaaatgcctcgtcaccattaagtcaggtagccaaatgcctcgttgccaccattaagtcaggtaggcaaatgcctcgtcaccattaagtcaggtagccaaatacctcgttgccaccgttaagtcaggtaggcaaatgcctcttcac

SEQ ID NO: 29402 - DNA, 1743 bp, Heterodera glycines
agggtaggcatttttttctcattaaattttcggcctttgcatttcgatttctggcaaaagaaatcgtaatttgtcaaaaacatcctctccaaaattgatttacctcggtgttgctggttttgggcaccattaatggcgccgactttggcgtgtccgcaagcgcatctaaaaagcgcaagaaatggtcacaaaaaaacattggcactcaaactgcacacactttcgaataacttttcattcggtcggtcaattagtgttccgtgccgaccgaccggaatttcccgtttctccccaagatctttgcgatttttgacagaatcccagggtccgggatgcgccatggcattaatttttcggtcccatttttaggttttgccaagtctaaaatccagtgaccggtcggacgtaggggccgagaatccctgacttttccgggatttcatggccccgttgaggttttgaaaactcccggtctgccgacacgtacatcgcagcgggcgcttcatctttatgaacagactgccggtcgcgttcacatcggtggccatttccacgtccttgggcatgaaattttcgaacacctgcttgatgtggcctttggagaagaatttgcgcagctcggccttgttcagatactctgaacaatgggacaaaaagttttacagtcttctaaaaaaaattttggattttgcgttttttttgggaggtgggacaggcccggatcagtttttatggtataattccttgcatacctgtctggatcaaatgaattcgatatcattcaaaagcccaaagtattctctatcagcctgcaaaatttcaaaaaattcggttggggttacaaaaaggttatcataaaaaagctaaaaaaaaaaacgatttccaaaaatttatgtctataaattttttgtaattcaatgaatatttttttgaaattttgcaggctaatagagaaaacgtagggctattaaatgaaatggaattcattcaattcggataactatgaaagcaattatacccaaaaaactgatccgtggccctgttggtcggggcccagtgacccgtttcgtctgtcatgacacaccgtcatatttgttgaagtaggttttctgcagttcaagcagcacaactggctcatgttccgcaccacactcggacagacagctcaaaagacgttcacgaccctgaaaatagtgaaggaattttccatattttttgtaccctcaagccggtggtcaaaaattgtttttaaatggctcagaactcctaaaaatttttcacaaattcggaccatattgttgcgttcagatgtgctgagcattacagcagaagaagccataattgcttgctgtcaatgtagacaaatcagagaattatatgaatttaagtaggctaaaaaaaaaaaaattaattttagagccctgtattttgagaaaaaaaaattatgcaggaacaggaacaggggatagtgaagctggtgggtgccctacgtttcccccccccccccgcatcgtttccccccgagaaatttaaaaaaaaatttactaacttagaaattttttaagaaattttcagcgattttttggaaaaatttttaaaaaaactttgtaattcaccataaaaatttctcaaaaaaatttttttcttagaattttcttgtaaaaaaactttctaagatttttttcttgaaaaatttttaagttagcaattttttttttttttaattttctcggggggggaaac

SEQ ID NO: 29403 - DNA, 1747 bp, Heterodera glycines
  misc_feature (1314)..(1314): n is a, c, g, or t
ttaaaatattttttattccatcggtcgcaaaatttggtggacggacgaaaagaaacgaataaagtcagctgtcacaggccgaaggcgccaacaaattgaatgtaaagcggcggccaacggaactttactttggtggaaacattaagtaaaaacagcgaattttctttcttcactttcgcagccgactttctttctttcttttattattattattattattttttattatttgagtaaaatcaattattttttatttttattttaattttaattttaaattttactttcctttttcttttggtcgcttttcattttcatttttccttttactttctttcgttttgtttgcccttctttgccttatattttcttcccatatacaaagcctaaaagattattagcttcgaatttcaaaatataaaaaagccattgtcattttaattcactaaaatttgctttttattttttattgttttttgctttatccaaaagaccaaatgaatatagaatccttttttaaaactatatataataatatgaatgagtttttttcacatttcgtaaaaccagacaaatccattagcaagggatttctgacaagcaaccaacacagttcatgatcattcattccttgttctccgactctccagttcactttccattcgtcagctgcagctttccctttcaatcggagtatagaatcccttccccctcccctcccccgccacaattcccccttccccccttttccccacttttgctgcgacgctttctttggacatcccgacggaagtaaaaatagttaaagcgacttctgttgaattacaaaatatgcgtgtcggctgatgggtctaatggcacttatcggagatatttctaaaggagaccggaagaaggcaaagtgaaacattcactcactaattaaatggaaagaacaaaattgatgaccgtaatcgaatacagtacccggttgatttttgattaaaattctaatcctttctgcgcttttttatgccatcgaatatttggcgggggaatcttatgactaacaagcaaatgaggaggactttatcatgataaaggattatcggatgaagaaaaagccattacaaaagtgtctgcccagttagtcgctgggaaaagtgtgaaatcgcaacgaaaaggccgcggggacggaagtgccaatggacgagacggcaaatccgcttaacggaaaggacgaggaggggaatgagcgacagtgggggttaaggagggaaaaagcgggaggagatgaagccgttggtggggagagagatgaagccgtttgggggngggggggggtgacttccccgccctgtcctatttcctgaacgattacgtcctggtcctgatgctccgataaaattcgttcgcaatttccgcgctttccgtcgatgcttcgagctctttgatcagagcatttccaatgcccctgcaagacatgaaaaggcgtcagaatattcggtcacatgattgatcgcaaaagtggctcttcaacgattcccatggtcagagctcgagcagcggcagtcgtcttctcaccattttccacgagtcatccaaactgctaagcttgtttcaccgttttcttccgtcggtcacattttgcacttttccacgtccatcaattggtcgcggtgacaatccgcaacagggcgagggcaaatgtcgtaacggcagagccccagtgtccaataattgcccccaaaaaactcaaatcaccgcc

SEQ ID NO: 29404 - DNA, 985 bp, Heterodera glycines
  misc_feature (41)..(41): n is a, c, g, or t
  misc_feature (51)..(51): n is a, c, g, or t
  misc_feature (68)..(68): n is a, c, g, or t
  misc_feature (74)..(74): n is a, c, g, or t
tgaaaaaaatcgattttttgtttcggggcagtccccccganccgatgcgcncagattatgaggagacngatccnttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcctagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcctagatttatggggagaccgaatccttcgggaatagcttccctatagcctgtactttaattctgcgttggatttttgctcccccataattgtttgagtaccccagaacggacactg

SEQ ID NO: 29405 - DNA, 1759 bp, Heterodera glycines
attattttaaaatgcctcatttttgccattgtacatcgacggtgcccccatcgctgtatgtaccgtctgtgaaaatatacgcaaatttaaaattactagggtttcctcagttgaccgttctggcaactctttacatagattagagagaagcaaagagcttttttattcatatttatttaaatttcgtccatttatcatttgcgatcccggcccattcctgcaaatccatgtcatcattttttttaaattttttatcatcaaattgttttgtgtcttttcccccccccccccattttttttatctgtatacaatcatttgactgatttcatcaatttttgttgttgatccatatattcctttggcatgagggattgatgcaccgctctgttgttgactttaggtgtttgctataaaagaattatttgaaaaaatggcaaaaaatgcgatgtttttgagggcgcttttccctcacttcagcttctgctgatggatgggttgtttttctgttgaccctttttagccacccaatttgaaggaattaaacggtggaaaaaacaactaaatttcaatgaatctttactaattatatggaagataagataattagtttttatttgtcaatttttgtctgtttgttttgttgccgattgggatgggaaaaccaaaacaacggcggatagggacggaggagtggccgaatcaattggcgagagagagagagaggagaatgcttggggtattcattcctcattttatccattaatttttattgcccaaaatgttccaaaaataacaattatagtgcaagcaattaatttaagattaattgccttttctttggtagtcgggcggcgggaggggcaaccgcgtcgaacaacaaacacacacacccagttctgctgttgatgtcgaacgcgtacaaaaacatacttttttggagtcggaattccggttttcgacattttcggtgttgtaatttccgtgtttcgacattttctataataaatttcgttttccgacattttaagagttggattccgattccccaaaattgaggcttcgaaactttctgactctgatatgtgccatcttcgttattgtccgtttgtccgcctttcccccctcctctttttgtccgttctcacattctccgtccgttcacttcgaattctgcaaattgtgcccggtttcaccaattcccatgtgctgttcaattatcggttggcccaaacgctggcggacatgggacattcggtgactctgtggacgcaaatggaaatggcaatggtgtaagggaaaggggggggggtcggaaaaatggggcaaaaaaagggggcggaaaattggggcaaaagggtgggagaacggaggggaaccggaaaacctggaggagaggggaatcgaaaaaggagaggggaatgggaaaattcggagggaggaaagtggaatcggaaattgtggaaaaaggggtttgggaatggaagggaatgggaaaattcgggaaaaccgaggggggaggggaatcggaaaattggaaaaaggggtttgggaatggaagggaatgggaaaattcgggaaaaccgaggggggaggggaatcggaaaattggaaaaaggggtttgggaatggaagggaatgggaaaattcgggaaaaccgagggggaaggggaatcggaaaattggaaaaactagtaaaaaattgagaattagctactggaaatccgagaagtttctcgactgcgtggagtcaaattccgt

SEQ ID NO: 29406 - DNA, 1225 bp, Heterodera glycines
tagcagaaaaaaaaaattttgggtggagcccaggttctccactattaccttttttgccaatttattcagaacaaaaaacgcatggctgatgtcctgaaagtatatatttgtttgtaaattttggatatacaaaattcaattttaggaagcagctttttctcttgccggtcgctcgttgtattaaatttattacttttttaatttgagttcagaggcgaaattcactgccggcgatttctctcacatggtaaacatttataataaaagcatttttatcacttaatttcccttaggttgttcaaaatgtgtcttcccaagcgcagtacacagtcagaatgaagcgcgaaaatgttgttggtacgttgaatggtttttcagtttttgaatatcaccctccccccccccccctaaaggtgtttttctgccggtgttcgaagcccaccgaaaagagggctctgacggagacgcgtacaatttgacgggacttggcaaaggcggggcgaacattgggaagctcaagcgcaactacaacaaagcggtggaactgctggtggagctggccacgctgcagacgtgctttatcacactggacgaggccatcaaagtgacgaatcgtcgcgtgaacgcaattgaacacggtcagtcgggggaatggacaaaaatgcaacagatacgggaaaaaagcgggatgaaatgaccgagataacccccgtcctgttggtctaacaataaagtccaagtggaatttacaaaacatgaccaaaacaaaaaacaaattcgtttttcgcggcttcatttttgtcacggttcgttttttgtgtgttatatgtataggctatatgacttctcgctgtttgaactcctaataattataatgacaaaaaatgaataatccgcgaaatgaattagggggtcattcatggaaccgaaatccatctccatttgcacattgtcattcattagatttaactgaaaaccgccattttcagtaatcatcccgaagattgaaaatacgctcacttacattgtcaccgaattggacgaaatggagcgcgaggaattctttcggtaaaaggcaaaaataaattatataaaaaaatatatgtacttttttatagcatgaagaagatccaagccaagaagaaacgcgaacgcgacgaagaaaaaagcccgggaaacggagaatgtgctgaccgaacggcagccggacgatgggagggcgctg

SEQ ID NO: 29407 - DNA, 760 bp, Heterodera glycines
tttttttttggctaattttttttttcatataatgatgaatacccgggggttttcgaggtcgctgatcacgaatatggcatccatttcgactaattcgggatcccggcaccgaatttaaacaaaaagtcaaaatttgaatttcgaattttagttcgaatttgggttccgggttcgtaataggttaaaataattgtcatattcgtgatcagcaacctccaaaaccctcgggtacttgttttcaggactttttaaagcgaaaaaaatttgaaaaaattagaccaaaaaaagtgcaaaaaattttcaaaacagggctttgtaaatagcgtcaaaaattttcagagggggggggggtaacaaaaagggtaagtgccccgctttcattctcccctcccccgtcggtttgccacctttttcggcaccctacgaacagtagcagcagaagcagctaatttgcgcatttcctctgcttcttcttccgctctttggaggtgttctttgagttttttgatttcgtcctcctgaaaattaaaaaaaaattatgtaaaagctgaatttgatttgatgggtcgaatgttgcaatttctatttgcctatactgaattttcagttttttgccgcctgaaaatttcattttttcgacgcctccgttttttgccacctttttttccttgtcccttttcaatgctttgatttctttcgcttgcgcctccaaaagttcgtttctttcttcgtcttctttctcaagcgccttaataaaatc

SEQ ID NO: 29408 - DNA, 1908 bp, Heterodera glycines
aagttgcgatcattttcggcatttggatttgaatttgattgctcattttcggatttgtctttcagcgcattaatcagatgagagaggcgagtgacatcatctcctttagaggcaagaaatagagcctcaagctcttctgcttgggctttgaccaattccaaattcttggcttgcgtaaggccaacaagacgaatgaggaagctcatgtttggcttgagtctgtccaaaaattcctcacaaactttctctttgcgctgatcaccagacaatgatggatttgatgactcaactagcggagtcatacgccttaaaaattggccaaccgtttcatcctcacgctgtcggcacagtgcaatggttcgcttcgccaattcccgtcgttgaggcgagtccaacttggctctcagggcatccaaggcgctggtgagagttacgatttggtcagcctcgagttccttgaacagggtcctcggcgtgtccttgagcgctaatttgagacgcgtgactttctctccttcggtcagattttttccggacaccgataagtagtccttgaatcgctcggcccaatcatcgaaagcgtataccgattcttctccgaataactccaaatttgaatttatcgataatgagttgctcaacatgttgatgccaaagaaagatcgggttgggccagcaggattgttggaagaggtcccgacgcctttctgtgtctgcgttgccgtgccgccacctgtgcttaacaagccacggtttgtgcccttgttatccttcgacggcatttcaaattgtgaggagtcgtcctgctcgcgcactgtgctgttggcatctgttccatcatttgatcgttagagatcgtcgatttggtcgaccaatgtttcaactatgggcctttattatgtcaaaacttgagttgtcatttgagacatcctccgaggcggtaaatttgtgacgcaatttgtcactttgtgccgtcgttgtgtctcggcacggcgccacaactacggcctgtcaattcattcattttctacaaccaaaaaagcatgtgcaccacagcgcatggatgggtgaccaccatatcttgggccaagaggccaaatccaatttggccaaaatccatttggccattatcggcctcccccgaaaaatttgtttacccgcccacgcgttcattttgactggaaaaggaggaataagaaaatgtaatgaagtgttacataacatatgctgatggatttgcaaaagaaaaatgggtataatccgaaatatgtaaaaaatggctttacaagaaatataaaaaatgaaaaaatgtaatacaaaaaatggcgccaaaatttttctaaaaagaaaattataaatttttaaaaaatggaaatttagtaaagtgccaagacccgaatcttaaaaaaaattaatacttttgccaataaaatttatttttctcattttgtaaattgcagaagtgcgcctccggcagcaaacagaagttgcgcagtcgcagcttcggccggaagaactcaacatgctgttaagctaaggtcgacaaaaaagcaaatttttgataaatttaaaaaattggcaaagtgtttcgctatggtatttccaaagaaatcgttaccctataaaattttgtagtgaatatgaattcataattcaaataaatttaaaattttcattttttggcgtaaaaatttttgcgtccgcttcagtcccacggaaagcgctggtcgctcaaagaattgccgaaagcttgctgttgcgaatggtcaatttattacggtggagaactttactaatgattgtggaagcgatacggtaggggcgaatacggtgtcgccgcgtcgaaaaatttcaatgccacaaacgacgtcctcaatgatgatgatgatgatgggcaccatggcaatg

SEQ ID NO: 29409 - DNA, 1471 bp, Heterodera glycines
  misc_feature (1361)..(1361): n is a, c, g, or t
  misc_feature (1365)..(1365): n is a, c, g, or t
  misc_feature (1419)..(1419): n is a, c, g, or t
gtgccatcgttgtcgtcgtcgtcccggtcagcatgtgccgtccatttgtgcaagagtaacaacaacagacacaacaatttggcgtcgtagccgccgcgatcgccaaatgatgctgatcgcctggactgaccgaaccattaatcggattgatcttttcatgatggccatgatgactgctgctgctgatcgggctatgctgatcactattgatcagattgtgccgacattggtgctgatgggatgccactgaagcggcggaggacagcgcggacggtgacggcgacgaacttttcctttgatgttgttgcgaatgcttggccacgacggtgccatacggaggcggcagcggcggacgctcgtgctgatcacaatgtgtggaaaagaaaaacaccgctgtaaaccataaagaatcagagatgatggcaaagtaagctacagcaatttaacggaagaaagttcggggatttaattgaattggcattatgttatccgatcattggcacacccggtaggaggcaattgcgtctggccaactgcgttctgagacaactttaagaagccattttttttcatttttcgccaaatcaagtaaactagatagatgtcattcgaaagctctgtctatatctttcgaagatatttgtaagcttttgcaaagcgattaaggaacccataaaaaattcatatatttttatttttaactgttttatttcttaacgaataattgtgaatctcagacgtaattggaaaattttgagacccgggtcaaatcaaaaatgtttttttttaatttagcaggctactagagcttgtcaaatgctttcgaaaaatgccattttataacatttggtttagcataaattcatggcgggaactccccggcgccaaaagaggcgatttccacctttgatcagtcaaatgcgtttggcaacttgccggtggcgttggagacgctgtccggctgaatgttttgctgcgaggaggacggcgcgtccacagtgagcgcagcggtggcggccgcagtggtggcgcagccgcgtcccgccaggaacaggcgctggcggttgtcgtgcacctcgcgcaggatgcgcataagcagcgagacgagcagcgtgagcaacaggcacgggaacagcttgaacacggcaccggtgatccaaaatgcaaggcgaaagacgaggcaatcggcctgaacaggatggccattttaaaaaaaattgtatttctattacaaaatgccaaaatattttgaatttctataattttggagaccggaacgggctcggtggtactgagacgggcttttattctctaactcaaaaaattctcaatgaaacaaaaagtcccgctcggctctcagntggncaaagtgggacttttttggcatgctgttgattttatttatcccagcctcgtccnatctccttcgtctaatcatatcaaatcagtctaatcatgcgctcccatcagc

SEQ ID NO: 29410 - DNA, 2011 bp, Heterodera glycines
  misc_feature (1853)..(1853): n is a, c, g, or t
gtagagtcaaaagattggaaacagaagcattatttaaaatcaaaaataattgatattagatatgttacatcttagtggcaaaaaaacaaacaaaaaaaggtttccaatttggaaaaagaaatagggctcaaaaaggggagatggttagaggtcaagagaaatgtttcggaaggtacgcgccccatctgataatgccattattcagttccacaactgaccaaaggagattgtgttcgtagacaattaattgtccaattaagggactaggaccaagcacaataaaatgttgtacaaattttggaactgtgccgcctcacgatgggatgaaaagcatagaaaaaacaaggtcaaaatatcaaagaattaggttgttttaaactttacagtttaattcattagcgtccaaagagtggaggcgggagaccagagaatggtaatggtatcgtatcggatttcggatcacctcccctctcccttttcaccccttcctcaccctcccccccttcactttccctcgctctttcacccgccgaactgatcaagcagttgtacctattcacccttccacagcatttccccatctttttttcccgaagagaatcgatcggaagagggaagggggggggagaggggggaaatcacctgtcagtgtcggaggaggggaagagatgagtgggcgttggtgcagaagaggggagggggaggggggaaagaacttgccgttgctgctgctgccggtggctttgtccatctccgagtgagttggtctgtttgcccctcggaggctgatgattgatgcttgttattgccgtgttgcgggtgtataggggtagggtgttgatgtaatgataaatgaccgcgtaggacgaactgaggggtctgctttgacgttctttctccctactttgctacgaggtatattatcggaatttagcgaattatctgatccgatcttacgattgttaatagtgatgaattcacggcgtgctgttctatacggcttgtatgcgtctctaattataacattcctcgtatgaacacctgtgaactctgctttgacattctttcgtcaaactttgtcagttgcttttaatattaaaaattagcgaattatcttatccaaatttaccactattaatactgaggcatccaccgtgggttgttctatacggcttgtatgcgtctctaattataacattcctcgtatgaacacctgtgaactctgctttgacattctttcgtcaaactttgtcagttgcttttaatattaaaaattagcgaattatcttatccaaatttaccactattaataacgaggcatccaccgtgggtctgctgttctatacggcttgtatgcgtctctaattataacattcctcgtatgaacacctgtgaactctgctttgacattctttcgtcaaactttgtcagttgcttttaatattaaaaattagcgaattatcttatccaaatttaccactattaataccgaggcatccaccgtgggtctgctgttctatacggcttgtatgcgtctctaattataacattcctcgtatgaacacctgtgaactctgctttgacattctttcgtcaaactttgtcagttgcttttaatattaaaaattagcgaattatcttatccaaatttaccactattaatactgaggcatccaccgtgggttgttctatacggcttgtatgcgtctctaattataacattcctcgtatgaacacctgtgaactctgctttgacattctttcgtcaaactttgtcaattgctttaatattaaaaattagcgaattatcttatccaaatttaccactattaataccgaggcatccaccgtgngtctgttctatacggcttgtatgcgtctctaattataacattcctcgtatgaacacctgtgaactctgctttgacattctttcgtcaaactttgtcagttgcttttaatattaaaaattagcgaattatcttatccaaatttacactattaataccga

SEQ ID NO: 29411 - DNA, 1031 bp, Heterodera glycines
  misc_feature (11)..(11): n is a, c, g, or t
  misc_feature (59)..(59): n is a, c, g, or t
  misc_feature (67)..(67): n is a, c, g, or t
  misc_feature (77)..(78): n is a, c, g, or t
  misc_feature (88)..(88): n is a, c, g, or t
  misc_feature (104)..(104): n is a, c, g, or t
aaaaatttgtnaatttaatggcccccggaaaatgcgtcagtgataaaaaaaatatctgnaaaaaatntaattaattnntaagtgattntaattaattaatagtntaattatttactttttaaatcttattttcaaatccttcctctctttttattattattattattattgttaataagaatatttaattccttaatatttaattcctttatttattctttcaatcttcgtaaagttttgtatgttcctcccattcatttccaataaattttttactttataaggttcatttttaaattttcatctattacattaaatcaattttttcttttggataatttacttggttttttaaagtattttttaattaaagtttttattagtttttttgatttattttcaatggattttttttataaatgattgtttccacattgactaataataattttattattttgcctttaggttgcttttagttgtgcaactttaaaaatgcgaattttatttaaaggatttaattattgctgctttataagtctagatgtttctcattggctcactgaataactttttctagtgaattttaattaatttattaattcattgttttaattcttgatgaatcgtctttttttgttgttgaaattttcgtaataaaaatgcatttattaaggacctacatttttttaatacactcttaaaatgattttttcagaaaaaatattcaacattgtccaaaatcagcttttaaaacctcataattactaaagttttttaatgcaactggttacttaataacaaaaaattaattatagagattaaggaaaaatacatcgatttatttctttagtatatttaccgtatttactcgattatacgcccccccccctcgaatggaagccccccccctcgaatataagccccccttggaggggggttgaaaaatagaagcccccttcgaatataagccccctcaaaaaaaatttttttttcaaaacttttgaagtcagaaacgtgcaaaaactatt

SEQ ID NO: 29412 - DNA, 1325 bp, Heterodera glycines
tctttttcgggattttgatgcctttttcttgccttttttcgggattttggtgcctttttcttgctttttttcggtattttcgtgtctttttcgggattttgatgcctttttcttgccttttttcgggattttcatgtctttttcgggattttgatgcctttttcttgccttttttcggtattttcatgtctttttcgggattttgatgcctttttcttgccttttttcgggattttggtgcctttttcttgccttttttcggtattttcacgtctttttcatgattttgatgcctttttcttgccttttttcgggattttggtgcctttttcttgccttttttcgggattttggtgcctttttcttgccttttttcggtattttcatgtctttttcgggattttgatgcctttttcttgccttttttcgggattttgatgcctttttcttgctttttttcggtattttcatgtctttttcttgctttttttcggtattttcgtggtgtctttttcgggattttgatgcctttttcttgccttttttcgggattttggtgcctttttcttgccttttttcgggattttcatgtctttttcgggattttgatgcctttttcttgccttttttcggtattttcatgtctttttcgggattttgatgccgttttctgccttttttcgtattttcatgcctttttcgggattttcgtgcctttttcatgtctttttcccgattttgcttgccttttttccgttctctactgataattgtctgtgaaaagcaacacactttaagatgaccactttccgcagaggaagaaccgactcaaaaaaaggaaaagctacaacaaaaagcagctccaatcaatgctcgaaatgtacttgggtaaaaaattttggatttttattcatttatagtcaaattttgtttgaaattagtttttttgtacatttaaaaattaacaaataaaaagtggtgtattaaggcggtccaatgggtgaaggagttctcactggcccaattgacctggctgaacttataagcgacattgacatggcctacaacatcacatgcctattggtaaaaacataatttgtagccgtgcatttaacaattaaaattgattttgtcataaaaataaaattttgatcactaccaaccgatcggggtccccgacccccaacaattttgctccccgagggggcggggctcaaccctaatttcgtcagttttataaaaaggaaaattttttgaatttattttttgtagcaagggctcaaaaagcatttttgcacttaaattttttcatttgaagtcaatat

SEQ ID NO: 29413 - DNA, 1158 bp, Heterodera glycines
  misc_feature (85)..(85): n is a, c, g, or t
agagtccccaaaaacacgagagttggcgagaggcgagaggacgagaggcgagagtttttcaatttttttctgtagccttattttntaatttaaaaaacttcaaaatcgtatattaaattaggggtacgggcctgggtatttgggcaaataccgggtcagggtattgccgggtacagaaatccgggtcagagtcctagtttttaaaccgagtccaagtcatgaaaaatccaaaaaacttgttttttaaattttttgtttttaagtcgcttttttgtggcgctgttttttcaaaaaaacttttttggaacattgggtgcggggtccggcggtgccgataggcgccgtcggaaaaattctaaaattttgagtgtaatatattaacagaacttgtcaaaaaatgatcaaagttttggttaaatttgcagttttaggctgtttaaaaaaagaaaaaataataatttttaaattgaaatattttttattaattaaaatttcaattgaaaaataatttaaagaaattatttaaaaatattttccgatttttaaagccctgtaacttaactgaatggaaacagtaaaagatagaaactcaacgaagaaaaaatgattatttgcgagaaaaaacttttaaaagttgaggcaaaaagaattcacacgagattaataataattcaatgatcaataaaatttttatatttatacataattaaaaaaacaaattctaacaaatagtaaacgtttttataattcataattattaaaatacaagattttaataattttctattaatttggtaaattactgcatctttggagctcctaacgatcatataagtacaatttagaaaaattaatgttgtttaaaaaagtttcttttatttttgtcaattaattgacaacgccaaacttgatattgcttgtttatttttaattgatatttgcaattaattaactatcttcttatatttttctgaataccttttaataaattattttaaattattttatattttatttttcagcttgacttcttacttctcaaattaatatttgttttttaaatttctaataaaaattaacaatcaattaaattaaagcgtaaattaaattcattttgatctatttcatgtgtgttgctttcgatttcacccccagttt

SEQ ID NO: 29414 - DNA, 1274 bp, Heterodera glycines
gattcaatataatcatgcggcaccaatgttgccatctgatagcttcattgctggcggatacgtcgccatgccccaaaaagagctaaaaaagaaaaagaaacaatcaaaaccgtaaacccaacacaatatattttaaaaatttatttatttttgctatattatttaaaaattaactttttgcgctgatggccttagtatcatcaagttgttatttttaaaattaataaatgccaataaataatcattttcccgaaactttttaagcaaaaatgaaattggaggagaatctgtgagaatgccattggaactcacagtgagttcgtcagtcaaatcgaaaacaggaaaaacttcaacaaagagcggcggggttattaataaaatattttaacaaaaatgcaaaaagaaaaaacaaaaaaaatgtatatattaagaaatgaccaattttaaaaaatagacgcctaaaaaatgaaaaactttctcaaaaatttatcccataacatttatttattttttcttgagatgaatttttgattaaaaattgtccttattcaaaaaaaaaactataaaatatttaataattacattataattgaatagacacaaaattaagttaagttttttatttttggtgttttttgtggtttgataactaaaaatctttattcaaaaattactcctatttaaatacatatttcgcgagtttccttacctaaaaattatattatccggtctcttttttactaaattaataattgataagaaagttttagtaaattttataaaatttaaatcaaactttaaaaacatagttttacaacaaaaatattacaaaaactaactaatatggcggcacatttttattaaaaaaagaaggacgaggaggccaatgctatttaatgttttttttaaataaataaatttaagcggcatcctttggaccttagcagctctcaaagaaaagagtcaatgcggaccagcagcaatgcgtcatcgtcatctgcaagacaaccatacaactttgtgacgccggcattggaatataatgtgtcaaatggttattttagttttcgagttattatcaactattttctggtttttattttagagcctaaaaatattttggcatttttcccgaaaattatttttaaaaaatgcaataaaaaagaaaaacacacccctaaaaatggacccgaaaatttttaaaaacacccctaagaaaagaaaagatttctcaaaaattcatctccaaaatttcttcttatttacgacctgca

SEQ ID NO: 29415 - DNA, 1004 bp, Heterodera glycines
gagagcgtttgttgcatagaaaatttctcaaaaaaagagatagccatttttttggaatatctattaaatataaaaattattagaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagaaatagccatttttctggaatatctattaaatataaaaaatattttgaaaaataaaatggccatgggcgcaccgccccccccccc

SEQ ID NO: 29416 - DNA, 1500 bp, Heterodera glycines
tggaaccgtttggtcaaagcacccctggggccagcccaatcatttgtgccgcaattccaattcgtcccgcgtttagacattcgatcgccattttatatccttaaaagcatcatagaattaaagagggcatatagggcttttagaccacgaacctttgccatattcgccaagaatggcacttttcgggactcggacctcgtcgaaatggacaggacatgtcgaacttgctctaatgccgagtttgtcctcatgttttgcaacagtaactcctgcaatttgttgaaatgtcttcccagcaaatgaacctcgtcgttaacctttcagattccggtcaaccaaaaaacatgtgatgccccggtaccctttcgttggttccgcgttggccatcacataaaaagatggaattgttcaaactaatggaatcgaaaaaaatacgagaaaaaacttggcgaaagaggcattggaaatccacatctttgagcccgaaatcaaaaaatcatcgccgtccggaagagcaacggttttcaatgcgaatgcgtcggatccactcccagcttcagaaaggcaaaaggcaccaatcttttgatagacaaataaaacgaggagggagcaagtcccgtcctacccaatccttcacaattcgtgtcaaatacttgtgtttttgctcttccgttccattttctataatcaatggtgcaactaaagtctaaataaacaatgaataagcaaaattctggctgaataaggaaaggcacacattttgaacatcgaccaaaaccgcaaccgatgggtccacttttgccaattcttctacggttaaagccacattgaagaagctggactcggaaccgccaaacttctctgctatttcgatgcccataagctgaaataaattatcaaaactggtaaattcgtggatccgtaccccatttgcaaatacgccttcgatcactcgcctgtccatctccgatttcacatccatttctttcacaagcggtcgtatgacactctcagaaaactgtttaactataaaagaaccaaaaataaatagattccgcgtatttaacccgaatgcttaagtgcgacttcgtcctcgctaagatatgtaagcggagcaggcggtgcttctgcggcgactcgtggcaatccatttctactggcaacacccaaaaaggcagtcgcttgtcgagaaacaaaggaaatgtgcatttttagtgacagtgtaaattcgttatgctaaagaaaacttggcgaaaacctgaaatttttcaatcggtgccaattctaaacagagttacagacccgagactgaattgtccaaatgtatttaattcgtaattttggaatgatatggcataatgtcattgctttagagaaaatttaaaagtgtgacgcaaaatttaatcgttttttggacaaatacccgctgaccaacgaaatgtccaagccacgaaatgcccaagcccacgaaatgtccaagccacaaaatgcccaagcctc

SEQ ID NO: 29417 - DNA, 1099 bp, Heterodera glycines
atgtttattcaaattcggaaaagagacaatcatcagcgacttgaaatttcagctttaggtaaaagataggcaaagcaacctttattatttccgattactttcaatttttttccacccccccccccctctgttttttttgttgtttaaaatggcacctcccgctgaaaacgctcttcgccacatcgctgtgattgcccatccgccagcagagaagagaaaagcgcaggatcggtctcaatttgcccttctccgtcatgcatttcctccgctccgtcctcctccgcttcattcgcatatccctcataaaaatcctataagcattgctccatccatttattaaattattcatcgcaacattttgaattacctcaaagtgtttatcaaagggacgaaaattcgcaacacttttacgattactggtccgctgcgcctcctccaaatgtttgttgtgtaaagaataattcactgcacttttgcggtcaatgaacggctttttgtgtttgcccttaattaaggaaaagtgcaaatttcacgaagcgattatgcaaaacaaaaataataccattttagcagtgtaatgtcagaaacactgaaaagaaattggaaaattataatagtaagaaaaagtagaataagaatttcaattgggaaaacaaccaaaagcaagtgacaataatatggacaaatatgaacttgaaatttatttgggaaaccaatcaatataaacattaatacatagaatccacatataaaatataacgaagaaaattaaaacgtaattcactgcgctgatcgtgcatacaaagcggtgaaaaattcacgctaattaattttatttttttttgatatttttttaagatgtttcccaccatcccaaaattcacttacggcgaagaaatttcaattgcactttcggacttttttcctaatcagctgattaattggatttttagctaacccatggaatgcaagaacacacagtgattgtctacacaaaagtgatgtgagaagtgatcaaagcaatcagcagaaaatgttataaattatcaataatcaccgaaacaattatttttattattttaaatacattgcttatttt

SEQ ID NO: 29418 - DNA, 1843 bp, Heterodera glycines
  misc_feature (23)..(24): n is a, c, g, or t
  misc_feature (35)..(35): n is a, c, g, or t
cgatagggatgaatagtttgatnntcgtctctttnttcttttgcctattttgccgtgccattcttttttcggctttccttaggcttcgctttcgtcccactgcctttgatgtgctgttgtacgctgttcagcttctgatcggctacattttgatgatcattgtcatgacgttgaacggatggctgattttgtccgtccttttgggccatattttggccaaattgcttttgggtttactcacttcggactcagtgctgaacaattgaaagggcaccgaagcagaagcaattggaaaagccaaagtgatttaaattcatttgaacaaaaaaatggaaaagttttaattatttaataataaaatgcaattgaaaaattattaaattcatttttgagaaaccaaaaaattgacaaattttgcaagagaacaaaatcaaaaaatgagaaggaaaagaaaggtaacaaaaactatcattgataaactaggcaggtgctatgtcattacttaaaaaccatcataatgaaaatttttgcttataactttgctctaaaaagaccaaatttttaatccttgctatcattcgatagatctaaatgttctttatgagcctgtaaaatttcaaaaaattttattaagtttaaaaaaagttatggccaaaaatgttcgaaaatcaaggttttttgagttcctcgagctataacttttttgaaacttaacaaaattttttgaaattttgcagactgatagagaacacttagggctatcaaatgatatcaagaattaaaaatttggttgctttcgagcaaagttataaataatttttcgacaaaaattttcataatgatggttttttaagtaacgcccattatgatggtttttaagtaacgacccagcaccgtttaaacaaggatgatgagcaataacacgtcatatttattgtgggtcaccggcccataaagtatgccgttggtgttctcgcatactcctgatggatagtgacatttaaatcgaaaaatttgaaatgcgttttttgcgctcttttctccaaaacagttgagcaagcaaatagttaaatcacttaaaatagcgactttactaattaaaattgctgaataaatttttattttagtttagaaatagcgaccttactaattaaaagcacgaatggtcggtccttcgtcctttttatttgcttcttctatatcctccccacctctctcaacccctctctctctctctccctctccctctctctctctctctctctctcaacccctctctctctctctcaacccctctctctctctctctccctctctctctctctctctcgctctctccgctctctttttaagaatataaaaaaggacgcggagcgccatcgtccattgagattgtcctaaaactaaaatgagttcttcaccaaataaccattttcattcattcgatatttttggaaaaaccaaaatgcgtagcaaatatataaataaatttttaaaatgtttcaatacaacaaaagagtgaaataggcacaaattgccataaaatttacttagaatcatattttagcaaaattaatttttaaattgcgaaattttggatttttggggggaatttccttaaaaatcatcataatgaaaaaattacaaaagttgtgaaaaaagtaaaatatattcctaaatatgtataaaatccagaatatttaataatcatactcaatgatttaaaaaaaatcattctgtcaaaggcataaaaaaaataaaattattttatttttatataaatatttttattataaaaattaaagattaatcgttacaatttaattataaagaaaattccaaa

SEQ ID NO: 29419 - DNA, 826 bp, Heterodera glycines
tgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactaaaaaaatatgagtgatcaaactttcactaaaaagttaagcctaaactttttcccaaagttaaaaagcaattaaaattttattcacctccattattgatagaaaaagcatcagagtgcctaaactaacatgtaaataaaatttggtgcgtttcagaaccctttctgaaaaaatatttatgaaattaattttgcaaataaataaaaacgaaag

SEQ ID NO: 29420 - DNA, 1022 bp, Heterodera glycines
cccatccggtcccggtctcgcagcctgaagctgtactcggggctgggcgtcggcgcaccctccatacggttgtcgcctggcaatggcgccaaaaagttgctgtgcttaccaatggcatgtgccgaaagggcgagccgtgaggttgacccatcctccgggtccatgatcgagcggtcctcgacggtcagtcggcacgacagccggagttggcaatggaatgtcttcacagggttcagcaccaccggtctctggattgttgtgcactcggcgggtagttcgtcttgttgtctggctccgtgtagtgctttccaccgcaaccgtcagccgattcctatgcaaaaccccatgcaccactgaggaaagttttcaatattcgtggttggcaagaaaactttcatagaaggcaattggaggtcattaatcaagcagatgtaattttctaagatacgaaattcgtgcgagagtttttgtcattaaaagttggtgattttttaaatcccggattttttgggttatctcggcaggcagtcgcttgggtcaatttgtaatccagttgaacaaatgcgagagtaaactatcctctcatagtatgggattcaatgggaataagtagacgtctcagacagtctccgcagattctgattacagatcaaaatatccatgatgctgagatgagcgagagggaattccctccccccgaaataaaaaatcaaaaaattttcaggaaaactgacaattttttaaaaattcaccccccccctggttatgcgcctggtgcaaatccttaaatatcaaatcttcaatgtcgtgatcgtcaaaagattaacatgtcctgatttttaagatgcatctcttgtattaatttgtgtttattataatattgttttgtaaatagaaattggcgcctctaatcttatttattaattaacaattaatttgttggtttacaaatttttttaaatccgacttgggactgtccggcgacaaagtgagtaaataatgtattaattaccctaattagt

SEQ ID NO: 29421 - DNA, 1110 bp, Heterodera glycines
gataagtaatatatttccaaaataattaactataaactgggcgattttggttttagaatacttaaacaaatttgaaaatgcttaaggtccgcttcatctgctacccgcggacttcctccggcgagtgtgaaccgttgcggcccgaaaactttgaaccaggcgccaaatttgaacattgccgagcatttgaatggattcagaggaacaacccaaattggcagcaacagcaaagcatatcgccaaatgacagtgacataatgccaagcaatgccccaaattcaaattttgaacaagcaacgcaacgattgtccaacaaattattctttattagcgggaataccacacgctaattttatttatgcaaattttattttaataaactgtgcattaatttcgcaaaaaatcaacaaattacaaaaactcaatgaaaattaaaaatatttatcatcttgaaaatattatcgaaacataaaaattaaatcaaaataagtaagcctttaatgtattttctaggttcataaaaaattttcatctttcactttttatttaattcacactacaacagtgatttctcggttatgtcagctgacgattccgtcactcacaagcggtggccgcggttcgtcaaatttttcaatttttgattttattaaatttattattttattttgtgccttcagctttttgccgaaaaaacactttgtcatttttcccgtgccgtgccctttttggttgtcattttgctgctgggcaacctgaacagttccatcttcgcctcgtcacggtcaatattttaaaattaccaaaaatgacataaatcgttcgtttttcagttatttgtttgccggtgccaaaaatggcattttgctctccgcgttgagtacggtccatgccaattcgatgagtccgcgggtggacattctttactaagtgcattttcatttgatcatatacaaagtaaatcaaaacaaataataattttaaagtgttcgctttgatcattctgtcattcatctgcgacttggagaatctgatcggatatatgtgagtgagttgagttggattcgcatatgaataggcaaatttaatttttgtatttgttcccatatt

SEQ ID NO: 29422 - DNA, 633 bp, Heterodera glycines
aataatgtgtttttaaatttatttaatctgtttttgaaaacttgaaaaaacatcggtcacttgaaaaaataaattctaaaatttcgtccaggaaaatccagggtttttcctgttttgcctggacctggattttttttcacatttgacctggacctggatttcctggacaaaaatcgaggaaaatccaggtccaggcaaaatccaggttgtcgaaaaatggcctggacctggatccaggaaaaatccaggcctggatccaggtccagaccgatctctaattttgattataaagatacaaaatcgctttggacatttagaatcaatagaaaaaaaaacgaagtgcatttcaacatcatttatgtcaaaaaaaaacgctattaacaagacaaatacatcaatcattgatcagacaaaacgacacattggataataggtaatagtttagatggtacccccccttttttaaaaatttttttcaactttcaaaaaatcataaaaacatgtttctaggggttttcggggtcgctgatcacgaatccgacatccatttcgaccgattccgaacccctgacccggattcgaacaaaattaaaaaattgattttttaacaaaattcacctttattgctaaaaa

SEQ ID NO: 29423 - DNA, 1232 bp, Heterodera glycines
  misc_feature (25)..(25): n is a, c, g, or t
agaggcaacctggactgccactatnctttgagtaaacagcatgaactctaagctaaggctactaccggctaagatagttcggcagatgaaaaaatctgcagctaaaatctgtattaataatactaaggattattattaaattattaatatgttaaattttttgaattttatttagttattaaaaaataaatatacaaaaaaaagtataaacccataaaaaaattggcacagttaaattaattgaacatttttttaaatgataaaaatcttgctctatttaattgtttgtttatgtttttcggtacatctaattcatttttaatatccaaattacaaattaaagggcatttaaactgtcattacaaacgaaatataatttttagcattgtgtctcaaaagcaaatttaatttaatttaattgggaaacaatttaagccaaaacgtgaattctatggcaatttctggatgtgaacaattgaagaaaattaaattccaagtgaatggaaaaagtcaaaaaaaaaagaaattaaattgaaattaaatgtaacactttctttttgaaaagttaatcataaaattttaaaataattaaaacaaattttcaaattaaacattactttttatactttaatgtgtttgttaatattaagttgaaacggaaattgtttcattttttctgtttatttaattcattggaaatttttaaaaattgtattcgctgagaaaactcaaatgaacgaattaaattttcactgaaaaaaatctttttttttaatgataaacgagggcaattaaactttcaattttttttccatgcacatttttgtcagtaaaaataatcaaaaaaatggacacccaaattttgtgccggtttcttttttctaattattaattaattctcaagagattctttaaaccgggtacacatgacaggttcaaattttttgattttgaaaaatcacaaaatcggtggcccagtcggttaaattcgaattcttggaggtccgccggggttcaaatacaacacaaaaatgaataaatttttgtgctcggtcgtttcgtaaaaactgccaaatttacagaatttttgagaaaaatcagtcataacttttcttaaatacaacttaaaacaatagtcttggtatcatacgatagctcttggcttgctctataagcaagaaaaatattcagagaatgtttcattgagttatcagaaagttctgaccaaaaat

SEQ ID NO: 29424 - DNA, 1381 bp, Heterodera glycines
accgctgccgctgccgcagcaacggcactgggcctttcgtcggtgccgacgacgaatgcgatgagcgacgaacaatggcaatgggtgtcgcgaatgcgcgcccatcggctgttccaacatcacccggaccattcgtcggattttgacctgctccgttgggccatggcttacaggtcaatcaatgatagctgacaagcccaagacaataaacgtacacagaacaagccacgttcgtgccgaaacatttgcataatgccaatcccaaggaaatataaaattacccccacaaccccatacatttttcagcgatttttccgccattctcggcaaatgattttggtctgtgtgctgttctcccgctcataccttgattctcaaaaaaaagaaaaatggcacatttagaaaaattaaaggcaaattttggtttatttttgagtgccctaatcattgttatcattgttttgtcctagtttttgctaccttaaaagcagtatttttggatttcgaaagttttaaaattatagaaacttgataaatccaagttgatttatgaatttctaatttttagaggtgacatcgaactcgcaatacgcaaatatcgacggtagcaaatttaattttatactttcatttttaattacaaaattttttattttcaaatatttattattttttatttaaaatatattttgtaagccatttgcgcatccgaaagctgctccgactggacgaaattgagcagcttggcgagcaggacggcattgacgaagatgccgaactgtacgcaccgatggaaattgttggcacggtactgaaaaataagtgcatctcttacgatgcaaaatctatttctaatctaatactttttgaaattgagctatcatttttcttggcttgcaactaattaggctaaattactcccgaaaatcccttttgaagatgagctccacggatggccgcattttgttgttggaacgctcgggacaatttgaattggatgtgatgatgaaaagtaagtttttggaaccaaattgaatgggaaaatcaaatttttttgttaggttgtttttcaaaatatgggacagtgcctgaggcgacgctttgaaaatttttaaaaatttaatctgtttggcaccccgaaaactttaacttaaattttgaaaatttatttcttaattttattaattaatttaaaaattggcattttatcaaagaaattttaaaaaatggtgacaaaagcgcgactggcacaatattcttcctttaagcggaaaaccgctcaaatttcaggcatccgaaccaacgcgttcatgctgaaccgcttccgtctgatggagcgcgtgcttggcgtgtgtgcacgcgtccgaacgcgcgtgcgacg

SEQ ID NO: 29425 - DNA, 1082 bp, Heterodera glycines
ccttctccgtgtgtcctattttaaagcatatttcctgtctttagcatgtccccgacatttgcatcgaatttcttaaggtccattttcgcacataaacgggagtccataaaattcaattttgaagatctcgttgcagaattagaactaaaaattttggctctattactttaggcgtccaaccgacttaggctccaatcttcagtttctttgataatagcttttttcttacccggtcaatccctacaatcttggtatcaaactaaagtttaaagtctatagttttttatagacttaattcttggctaaaagcaacagacaaaaaattattcttgaatacactcgaaaaaagcgcgtttagtattttcttgttgtatttttttcttaatgtatagtacctatttgctcttttcatgtatttatgacttcgcgggactttaagctttcgtttgataccaagaatgtaagcattgaccaagtaagaaaaaattatagcttaaaaaatgaagattagacgcctaaaagtcgatttaaaacgcatttcaattcacaaatattgtttgtattctaaaaggacaaaaaaaacatatcagttggacaatgtgaaaatgtgtatttttctgattccattcgcttttcttccttttcctttatccaattggcttttgtaagccaatttgtatttcattgagcttcttaatagggtgaaaattgcacaatttgattggtcagtggcaaaaaaccacaaacttaccgaagtgccgtccattggtccgacttcgtacagactttcgcccagcgtttcctcgcatttctcgaacacattcaacagggttttccaagcgaccatcacagttcggttgccaaagcaatgggacaacttttatgcgtggattgaacgggggatggactcagttggcctgtgctcacccgtgcgaaattcttaacgccgttcagagtcgtgtggaggaggacagttcggtcggcgaatggctccaacatcgtcgcctgatttggcggcacaattggaagtgtctcattttcaatgccctgctggagaattctgatagcttcttgcagaattg

SEQ ID NO: 29426 - DNA, 1015 bp, Heterodera glycines
ttttccattttttgcattttttttattattccggaatgaactttcaataaaaccatttttatattattttttcaatttattcacattatttatcaatctttgtcattttttattattattattaggtgctctccgagcccgggttgaaagcttcaaaaacaatttttaaatttaaaattttatttgtaattaattatttttacattgccattttttaattattaggtgctctctgagcctgggatggttgaacgatttttcccaaaccctgaagaagcgccattaattaaagccatccgagacacttatgcaaacatttggagaattgaagagaatgagaacaatgagccattttctgagataattgaagtaaaacgaataaataaaaatatattaaaaatgtgtttaaaagtttcatttaattgttttcattttagagagtcaaaaaacagccaaataattttgtaatgaaattaactgaatatgcattatgggacgcatggattaaaaaggatgtggagaaagtatattttggcaaagaaattctcgaagctttggcaaatttcgatgctgacaaacgcttggcatacattttgatggaaaaattacggccgatgtctgtgaaggtaaagtcgggaaaatgcatcaattgtgagcttaattttaaaagtctcagtttcaattttcaaattcttaaaataattttataaattcatttatgcaaattcagaatcacattatttgggcagaggacggagaagaaagcagcggagaagactttttagaagacgtgaccccggaattgggaatttttggcactttgctcggcaacattgtcaacggtgaagtattgtacaatgcgcaatttggccatcagctgaagaccaaattggccagcgagaatgagggtggcatcgcaagtggaaacagtgcttatgattcggcatatttggtggactgatttttgaagagaaagagagagcgagagaaaggatgaacaaatttggataaatat

SEQ ID NO: 29427 - DNA, 1300 bp, Heterodera glycines
tgctttgaagttccgccgtagacatttcgctaattgactttttggatgggacggaggaagtcatttcgaaatttttgaataccaaacataagtattgactccttaaatacacattgggcctttatcatttctactgaccacatcaaatttgtagacggccaatatgactgctggaaatttgactcttgactatgaatatgactcggaaaagagatttgaacatttgcaaggaatggtgatgctgatagttctttactcagttttcttattgtttttatgtttttcatatctacgacactttttgtatgaataatcaccatttattgataaaataaatcacgaaaaaattggactacaatttaaatccaaaatcacgtacagtaaaattttctgatacaattcctttggtcacaacgggacggtatcgcttcaaaatgcttacagattgcactgctccttcacgaatattggggccaagctggtttggatagtcaattattatttcttcaaaagcatcttcttcttcttctgcagtgtcataccgcaaaacggtttgtttgaatgcgctgaagtgtaataagcggcacgcgtcggcgcacaatgtaatttttctaactttcaaaacagtgtcttcttctcccgttcttttgctccgcattctcagcgcgtactgcttacatcctccactcacaaattccaaaagttcatgcccgggatattcgtctgagaggtcgcccaggtgcggcccagttgtcaatggacatccgtcttaataaaaccttataattttattttttattagttttttaccggtctccttatacgccaaaaccacgctgtccgtgtcggtgtagattaataaggaattttgggcacggactacgcgttgcataagactcaggaggtggagacgggcggctgaggtcgtccaaagcgacaaaactataaattcacaaattattttaaaattattaaaataattttaccaatattggagcagccgtgctcctcaatgaactcagtgacagccgagtatgtgataagaacagtttcttcgttcagcaaatccacacttgaaacttcaatttttgggtcgtcgagaagggagcgtagcattgccggggagtccgtaattttcgtctttgacaggccattgcggagggagaagcgtccccatagcgaattgttgcaaagcttggcgattgtcctctttgccttgttgtgttccatctttgcttcgtcaattttgatgccaaaaagttgttcgcactcttcaatgaactgttgtctttctgcgtct

SEQ ID NO: 29428 - DNA, 1086 bp, Heterodera glycines
tttatgaattctgagccgttttgagtagattagactagaaaaaatgaaaaatttgaaatcatgtctcccactcccttctcgcaggggtattattttgtaaagtctttttttccacaataaactttcaaaccccatttttcgcaccgtgaatgttatttttattgaattctgagccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaacaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctccaaggggtattattttgtaaagtctttttttcccccaaataaacttgac

SEQ ID NO: 29429 - DNA, 750 bp, Heterodera glycines
aaaagcaaaaaaaaaattggactaaaaaaaagttgaaaaaaatttcaaaagtttcctctttgcaactagcgcctaatatttctcttctaattgaaaggaaaagctttaagtttgaatcactaattttcaattaatcgtcaaaataacacttccgttgtgtttttctctgcaaatcattcatatgaaaaaaaatatttgaactcatagtttttttgcttataaaatgttaatgaaaattgatgtgacaaatgctttcgcaacaggaaatatttgatattaaacgatagaatcattatttttttttgttttttaaattatttttttattaacaaccgaacagcagctgattagcaacaatttatcactaaagaaaaatcgagtgaaatgaaatgataagcaaaatgaattaactgatcaaattattcggtgtgataaacggctaaatgaatgatgtaaagtgggaaaaaataattatccttagccatttttgccaaattaattcttaacgaatgggcaaaaaatttatgaattttaatgcgaaaaaattattagcatttggttcactttgattttcacaaaagctgagcaaattgtgcgacaaaacattgacaaaaaaaggaagaaaaggcattgtgaaattcagtgaaatttggccaagtttttccaacacttttcaaaaattattcctttaaaaaagttcagacggttttaatttattttttcaatcgataaatactaatttgagaagca

SEQ ID NO: 29430 - DNA, 1022 bp, Heterodera glycines
gatttatagttttttcactatgtttttcctgagatccccgtagccttaaatgcacgaaaaacatgtttttttttcggctgttgttaagctacttttcgagatattagcaactgttttctagttttttatttttagcaactaaaaaactataaaatttttgaaaaaaactattttcaactattttggcgttttgccaattatttgttaacaaaaaggcaataaaaaggaaaaatacacccctaagaatcgacttaaattttttttcaaaaaataaacccctaagaatcgacccaaaaattttgaaaaatgcccccctaagaaatgaaaaatttctcaaaaaatcatctccaaatttaattaatttttattgacgataatttttgattttgaaaatggtgtatctcattaatggtttggcataatatttttacttttttgaataaattttgtcagtaccacgggctcgaattgggtctaaattgtgacgaatttatgatcatgatcatgaaacctatgcattttgaaatttggtcggttttatgctgcacatccaaaggttcaggcaaaacaaattaaggtttaggggtcagactcaattaatttattacaaaaacaaaatcaaatttaaaaaagtgttcatcgaattttatgtcttataaactgcaaaatgtttaattttcataaccacaaaatattaaaagaagaaactaaatatattaaaaaaaattaaaataaaatttaaaaatatatttcaaaagaaacataatgggtggtatttgctaatattgcagaaaaaatccgtatatttttattattggcgtaaagattctgcaccttaatccattcggcataaaagttagcacgcaaattttttcatattttttaataatttagcttatttacatttttgattttaatttttttgcttagattttctattttttcaatactaagattaacaacttggattcgcaaacgagtcaaacctaagttcaatgttttttgaaccgttatatagttct

SEQ ID NO: 29431 - DNA, 688 bp, Heterodera glycines
ataatgtaacagtaagagaaaccaagagaaatctaacatttaaagaaagttataaacaaaaataaacaacaattaattaaattaatcaaatcttttttggtaattgcctgaacgctgcgattttatatattttagcttcgttagaatttgtgctttcgaatgataccaaaaagatagggtttgttcgaatatgaaccaagttattgtacatataaaaacccgggattgtaaattgattggactcataaaggtcgattggactcataaactgcactagagcctggattttttggtttttacctttttttgcagatagtacttgatgagagaagcacgaaaaacacattttctccgaataaaaacgaaaaatacaccctaagaaccattcaaaaaaaaactaaaaaatatacactaaaattgaccaaaattttagaaatattttttctaagaaatgaaaatttttcccaaaaattcgtccctaaaattgacattttggggattttagtgcataaaaacactagatttttccaatttttagcacctatttttcggtaggggacggttcggtgccagcccaatttttggactacaacttttttcattgttgaccaaatctaataatcttggtatcattcgaagctttatatgtttagaagctttttctaacctattgcttagcgattagctt

SEQ ID NO: 29432 - DNA, 844 bp, Heterodera glycines
tcaatgaccatttcctcagtttcttaggcaattgggcctttccatatattcttgttattaatcgacagcttaaagtctccggaattttttgtaaaatgaaattatgggctaataacaatagacaaaaatttattgttaaatatactcgaaaatgctgaaaatctcatgttttctcatagtaacttttttcttaatgtcaacatttgttcttttattgatttataaattcctgagactttaagctttcgtttgataccaagaatgtatgggatttaccaagtaagagcataagaaactggggatagtcagtcgttgattggacacgtaaactgcatacatggagccaaaaaatgtgcccgggaatttttttttttaaagtcgggactggcatcaggccgggataggattagtggattcaaatctttatgtcgccgagattttgccgggaaatgaattccctggtttcatcggtgtcccaatccgagcccttttttcaaataagccgggattagtattgggatcccccgggaaaaatcatcgggattggcaccaggtcgggatagggattagcgggattcaaatccctgtgtcgccgaaattttccgggacataaattccccgaatcccgtccgggctccactgtattcattttctaaaaaaaataacaaaacccaaggagagtttgttggctgatgaatgatgaaggatttttggtcattttgctcttctgcagcaggcgatttttaaagtagcaaaaaaagtgactaattaattaatttcctaattaattaattttccatttaaaattacactaaaaattgccgaaatttaccggggggggggg

SEQ ID NO: 29433 - DNA, 1015 bp, Heterodera glycines
tttgtaatttctttctgatttgttaacagattttcaccaataaatgatcaatttttgcgattttgagacaattggcgaccatttttatattcaaaaagctttttttgtggcattttttcaaaaaactttctttttttaggcgggggagtccgggggtgccggtaggcgccgctgggaaaaattttgtaatttttaatgcgacttgataacagatttttaccaaaaaaggccaatttttgcatagcaaattttaagtcaacttttgaaataaagggggaattttctggccaagtcggcgccgataggcgccgacgagaaaattattttggaatttttcatgaattttgttaagaaaatatattcaaaattcaataatttttcctcttttctcactttgactgcgaaatggtcatccttaacagtgtaaaaatttctcggtttccgagactaaaaacccgagaatgctttttgagcccctttcttcatagcatatgcgcagaaaaaatatgcaaaatcatacaatttatacttattatgattgcaaaaatgttgcatttactttttaaatttctatttctaatattaaatttttattatatccacacgtgcatacatacatatgattacaatgtattgattgatattaattgaaaaaatcaaaaaaaagaaaaaaaaagagaatttttattaatggaggatcaattaaacagatgctaaattcgcgcataaaattttatttttgcaattcattgggcgctagcatttatatgtgtgtaatacttaaaacgttaaatcttttatttattaaaattggcaggtttttctaaaagaatttaatataaaaaaaggctgtaaacatttttaaaattttatcattttaaaggcaacaaatggacacttttgctcaatcacttcttccaagaaaatgtgcaattttgcatcttctaatcattggcatatgtattatgtttgaggaagtaattaaaattttgtacaattttattatgtttaaaag

SEQ ID NO: 29434 - DNA, 961 bp, Heterodera glycines
aaggcgactgtgttcgttgacaattaattgtccaaccttttaaggtactggactttccacagtaaaatgtgtacaaatttgaactgtctcgcctcacggtgggacttaaaaacatagttaaaaacttcagagaattatttgttctaaaaattacagtttaatttcttagagtcaaaagattcgaaacagaagcattatttaaaatcagaaataattttttaaaattttttacattttagtttcaaaaaaacaaacaaaaaaatgttcccaatttttaaaacgaaatagtgcacaaaaaggggggatggttagacgaaaagagaaatttttaggaagggacgcgcaccccatctgatatttccccttttctgctccataagaggccagaggcgactttgttcgttgacaattaattgtccaaataaggtacttggactttccacagtaaaatgtggtacaaattttggaactgtctcgcctcacggtgggacttaaaaacatagttaaaaacttcagagaattatttgttctaaaaattacagtttaatttcttagagtcaaaagattcgaaacagaagcattatttaaaatcagaaataattttttaaaattttttacattttagtttcaaaaaaacaaacaaaaaaatgttcccaatttttaaaacgaaatagtgcacaaaaaggggggatggttagacgaaaagagaaatttttagtaagggacgcgcaccccatctgatatttccccttttctgctccataagaggccagaggcgactttgttcgttgacaattaattgtccaaataaggtacttggactttccacagtaaaatgtggtacaaattttggaactgtcccgcctcaaggtgggcttaaaaacattgaaaagccaagttcaaaacttcagagaattaattgttataaattttacagtttaattccttagagtcaaaagat

SEQ ID NO: 29435 - DNA, 1346 bp, Heterodera glycines
ttccaacctctccctgttttgtcattcctgactatcattcttggaataaaccagaggttgggccaagggcagcaagcttacttgcaaatgtgccgccaaatcgggcttggagagaccggagaacacttctggattcctccgcagttcctcgtaaagagcagggatgagttgatagactttgtctatcccgacttccagaaactccttggaaatgacaaggaactgctaaatcgtctgatcctcgcacctcacattgacacatgcgatgagatcaacgaaatcatgatggcgaatgtgcctggtcaagtgcgcgaatatttgtcctcggacaaaccgcttgacgagcggccactggatattgatgaaatcgagtccgaagtggcagcgttgaatcgacgcacagactctgggatgcctccccaccgtctgcgactcaaggtcggaagcgtcgttgttctccttatcaacaaaagtgataaggaaggactgatcaacggcacgcgcatcgttcttgaagaacttggcgacgatcgtctggtcggtcgcgtcattaacagcaacgctgttggtggccaagttaagttcttcatcgaacgaacacgcaatgtctacgaggacaaaacgcctggcggcataaaatatgagcgtttgcagtttcccatcaaacctgcctttgccatgaccattctcaaaggtcaaggccaaacaatcagcacggtcggaattgacctcgaaagggatgtgttttcccatggtcaattgtacactgccttttcaagggcaacagacgggaacaacgtccgagtgtacgctcccagaagggagaccgatggccaaggtcaaaccaaagtgttgaacattgtggccaaaaacatgctcaaattacaataaagcaaacgagttatagtccagcgtgtgtggcactttactgatgtcgccccgttctcatctgcactttaaacggatacacatacaaaaagtgctgccacctggactaagggagggaggagggatgacgtgcgagttagggcacttccggtttccattgcactgataaatgcaatgtgtcagctcatcacgtgagtgaaaccaagtgcatgtcggctgacgcaaagaccctaacacaaggcctaggtagcgaagctcccaaagcgcgaagcgctttaagcactaaagaaacatgtaagcacacacccgctagtttatatactttagaacaacagtgagtttcattgctaaaactaaaatctcgggaaccgctggcgggaggggctcgcgagtgtggcattgcttaagcaactttttgaggcgcatccaggaaaactataggcattccgttccggagg

SEQ ID NO: 29436 - DNA, 1130 bp, Heterodera glycines
  misc_feature (1126)..(1126): n is a, c, g, or t
tggttcattatgatcaataatttttggtttgaaaattttattattttttcaaatttttttgaagatcaaatgatcggatacaatcacttttaatcgcttatttaaagctatttatgcgatcattgattgaaaaaaacttagttttgaaccagattttggacaaaggcgcaaatgtcgggccgcaaaagtcggggccgcaaatgtcgggacacgaaacagagggggttggaggagggctaagaaccgctagaaatttcaaaataaatttttagaggcttgaaaaggggcaaaaaaatttcaaaattttaacgccttacgaatggccattgcattggcacgggatgcaggaaccgatcagatgcgtgccaaccggggccggcaaccgatggtagccttgtgcgcactcttggcaggacgggccggtgtatggctctgcaaaatatgaacatgaatgattacggtagatttttgacgtgcatactgtagaaagtgaattacagaaactgaggaaaacacattgtaatttaccaggacattcacacagttccacagatgatgcagttggacgaagaaggccagactcatcctgggaaatgattttacaaatttaaaattaattttactggatttttctatctttagatcgaaaagataagaaattataaaataagttaatttaattttaaaaaattgaaaacattcaaaaaatatgttattggacttttttttgtttttttttgcataatgccattatctttgtctccttcttatcatcactttaaaattttgattcggttaatttttgaagagtaatggtggccaaattttgttaaatttactaaaaaaaaacattttaaaaggcagaaaattcaaaataaaaccactttgaatttttctctgttccagactaacttttctttcttaccaaagcattttaaaattaaaaaatccgacacttaactttaaaaaaaatattttttcaaaaaaatttgtttctcatattttaatagacttttattgaattaatgacacatgaccgaccaaatgttccgtaataaatgttctgagccgaataattaaatttaaaaaattaaaaaattcattttttcaaattttaccctcgccnggtg

SEQ ID NO: 29437 - DNA, 916 bp, Heterodera glycines
  misc_feature (871)..(871): n is a, c, g, or t
gtataaaaacccgggattgtcaattgattggactcataaaatatctttggtctcataaaagtcgattggactcatataagtcgaatggactcataaagtgcattagagcccagattcgtactcagtggctcaaattagccttagaaatgtttttccagaatttattttaaaaaatttcgggaccaatgaaccgaaagattgccgttttttctgtccctccacccttttgggtgttcgaaaatgccaaaatcgcatcctcctcccctttttaggtctgattggcaccggccatgcccggaagatggtcggcgtgtccagcgatgagcccattctggccggccctgcgtatgcaattgagcgagctgagcacattttggtggtccatgtgagcgagcgcttgtgccgtcgaacggcaaaaatgccaaaaaaaaatttctaaatttttaggacgtgacaatgcccggcaaattcctgagccatcgtctgctgtacttcctgaaccgatttgcgcacattccctcctctctggtgctgaacaaagtgcggcttttttattggaattccgtggggttaaaaaaaataattttccgaaaattggtaaaaaaaaattcaaaaatatgccaaggcatttccaaatcgacacttttaaaaacttctcaatcaattaaaaagcattttttccaacaaaaatttttgtatggtttttttttgaaatttacttaattggtttcctttaattcgaaaaaccaaaagctcacgcggtttttccaaaaaactttttgtggaacagggggttccggcggtgccgataggttccgcgccggaaaagtttttgcaattttttaacgaattttgtccaaaaaatgacaanattttgcgattttgagccattttaagcagattttcatcaaaaaat

SEQ ID NO: 29438 - DNA, 1269 bp, Heterodera glycines
cgatatgatcttatgacacgtcagttcataattgaaacgtgcatatgatttatgacacgtcatatctgagatatgatcagaattgaaataggccctgggattttgtgaaatgtcgtgccatctcctctgatttttaaaacagcgcttgtcaagtgcctccgacttttgaataatgccaactttactaagggcacgacctttaaaatgagttcaatcacttttttatttaattaatttagttttatgatttaagaaaacaataaaaatcgactcgtccccattgatcccacccattcgccggtgtcggtcatttcctcagaacacatcttagaacaaaaaagtgaaaatgcgatgattaattaccccctccccgatccgctgctgctgggaatcccgttttgttgtcggggatgggcgaatgaatagtctcccggaaccagcggagcatttgaccagcaccagcaggggaggggcagcaacagttacaggcgaaggaatgaacgcgggagggactccaaacggatggggcgggcgggaggaggcgtaaagcattttttgggaaggggcacccaagcttttcgcggacgggagggggcagcttttcctttcatttaggggccgtggtgggtaagctttccgccgatggcttttccctgcccctctccccgagggcatcaaacctttcctcttccctttcctcctcctgcttctacctcctccatcccgtcgcttgacgtcgtcttacgacgcgatgatgatgaccagcgccgatcatcgacaaagtcagccgccacaaccgcaaaaatttctcttcgccaacggcggcggcgcgtttatcctccgttagcagcgctcgacaaaacatttccctttccctcaaaccatcgtcccccccccctcccctaagggtcgtcgttgtgtcatgctttttgatgctttaggcatttctctcatcaacagtttcaatattggtagaggagaaagcataagtgtcgagactgagctcgggttttcagcccaaactcgttggacggctaatatgttgagagaaagaaaaatggaaaaaatagggcactgattcttcttaaatatggaaaatgcctttacaaataggctaaaaaggtcacttttgtctctgtgattggtgccgatttgttcccaaaatgtgctcctcctccactttggtcagtgtcttccgtccgtccgtcttggttttgtcccctccgtcggtgggttgcgcttcatctcctccccccccccatttgcaag

SEQ ID NO: 29439 - DNA, 999 bp, Heterodera glycines
  misc_feature (28)..(28): n is a, c, g, or t
acagcttacaaaagccttgatatttttntggcgctaaaaataagttttctcatcaaatttatgcgtaaagtcctccgttccactcttttgtgtaaagaatgcgaggtgttgcagaacattcgcagctccaattcgggtctaaaaatggtaaaacaataattttatattatctttttatttttgcacctttttgaggggaacactcaagggcaaaggccaaactcttttcattacgttcatcagtgtctgtttgtaccagggatgtgccgagccagacaaaatccgattccgattaaatcgccgattccgattatggccaaaaatccgatactgttggtaccaattttgcggtaaaaaaatgagaaaaaagagatagccattttttggtcaagaattttttttgtttgcgtttcaaatatcgtaagattgtttgatagggccagacaaaagaaggcaactgttggtaccaattttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtacaaattttgcggtaaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaaaagaaggcaactgttggtaccaattttgcggtaaaaaaatgagaa

SEQ ID NO: 29440 - DNA, 1516 bp, Heterodera glycines
  misc_feature (50)..(50): n is a, c, g, or t
tagtggcagccgaaacgacctgtttctcccattcaaattcggcccacatnttccgaaattctgtgtctgtgcaagtgcccggcacaatgtaatcctgaaatgggaaatggtaggaagtgagtggtaagcaaagtactagattggaattatgcatttgctccactcaccattatgtcaatgtgaatgtcctcaaggtacacacaatttcgatccgaggtcgaccctcgcacatcataagcaatggtggagaaaatgactccattttcggtggatgacacttttacggtggccttaattatgtttaaagactgtgtggattatgaaagatggactttgatgttagtgaagtcgttaggtgcaagagtaatcggcgagggtttgtccacccttaaattgtctcaattttagcgaacaagatgatattctgtcacaatttaaggtcgccaacggtcgagagttccaatgacaaattttgcaaggtgtcgctagtctggttgaccacgagtacgtccaatacaatgtcatattggttgacgttgacgtacgcctcggcatagacgggatccgaaaagccggctaactgaatcacttttcccagtttggagctggcaaaggtgtatttggtcgttttgggtgcagtaccaagcgcttgggaaagcgaaagatcaaacaaatttgtgtccgtcacgttttctgacacgcgtgtggacagctgcgtgaacataattgtcttgtcgggctgaatttgtttaaatttgattttatttaatcgttgcctccttccgcttgcctgcacaattttcttcttcggcgcttttgtgtcgcgttcgtgccggtccacgtcccccttggccttgagcatgctttccaacgaagcacggcactctctcaaaaacacatccaccgctttcggccattggtcaacaatcagtcgaacagtggtcgacaaacggtccaagtcgtcctcagtgatcggctgtttgcacaagcccgacttgccaagatgaatgattgaagcgatgagcagcagcgcaccactcgccaatttattaacagttgaggggacacctaaaaattaagtgaatttgactgcgataaaaccgatgccacggggttgtttaagaatgttggaatgcgaatggatttagaaaaaaacaaacaaagcaaacgctactgggaatcgaacccatgccatcggaaatgtagaaagcatcattttaataaattacaaattttaaaacgataaaaatttttaattagtgtgtaaaaaagatggaagcgctcagacaaggaaacaagtcagtcacggacagtcagccccgaaagatggaatatagtaaaaggtcatcattgcgccttacaatgggctttgagagcacaaccactaagccacgcctatacgttcagcaggtaccaaaaacaacatgttaatggaaaaaagaaaacaacaaacccaacccaatccaatagacaaacccttgttgagctcagcgtagcgcaacaccaaatttggcca

SEQ ID NO: 29441 - DNA, 915 bp, Heterodera glycines
  misc_feature (830)..(830): n is a, c, g, or t
ataataactagggttataagttgtatgcactaataatgccaaatatgcggataaaatatgcactaaaaatcccccaaatatgccctaaaaactcgaaaaatgcccaaatatgcactaaaatatgccttaaaaaactgccaaaaatagcttttagccctcaaaaatgccaaaaattatgtataaattaagagttgacttttaaaacacaaaacaagggccaaggagcatttttttagacaattgcaaaaatactgaatttccaaatttataaatttttattatatgcaaaaacaaaattacatttttatatacataaatatttttccaaaagttcttacaaaaatttaaaaaaattttcgtttttaagggtgtattttttaaaaaattccaaaaaacgtcgtcgatccttgggggtgtatttttcgcttttttcgcatttttcttatgaaaatttgccaaaaatgaccgaaatatgcactaaaaacttcaccaaatcaaaaaattttaatgcagaaatgctatttttgagcccctttcttcgtagcatatgcgcagaaaaaatatgcaaaatcatacaaattataaccctagtaataggtggcaggccaggaccaatttggtactatggatgaatatttcgaaattgcagtaaatttatggctgctttttgccaaaaaaaagctcaaataaaatatttatcaaaatatattggtttttaatccattaccgataagcaaatttttttttttgtttttttttgtattaaaaaaataaaatttggtgccaattttctaggccccgtttttacgaggcctcgtccaccatacganataattgttttttttattaatttgatttttcaggtgctccggcgcaaaatggaggcgctgggaactacggccagcagaagtcagg

SEQ ID NO: 29442 - DNA, 864 bp, Heterodera glycines
ttatcgtagccaatacagtcggatttcgcattagcattataggaggaatattgcctaaattcaattattaaaaatttaattattagtttgagtaaattacctaacccaaacattggaatcattaaaatctttgccgccaaacgatactcaatgaaattttgtccagaaaatgttgtatgtataaacaaacaaaaaatggccaaactgatggagcatttcaaaaaaggaacaaagtgccaaaaggtaattaacagtgccacatgacctaattaaggtaattaaggttcacttataactcattaatactgcttattccaagaatttatctacacttattacgcactttgttaaaaaggttacaccaatgacagaagaattgaaaatgatgccaattaccgcaatgattccataaatcagtgcacaaccaattagtgaccagctgggatggacatctttgaagaccaaataaaactgaaatttagttataataaaataatttttaccaattaattaccgtatcattgccttaattttccaaattggccataattaaggatcgaaaacaatcgtttttataaatttttaattcaactttttttagtaccaaaagaatgttatgaaaaaaattgctgaacatggaatttctcatcaaaatttatatttccatgaatttttgtttaaatttatttaattaattttttgagataatacaacgaatgacaaagtgctgaatttggttgaataaaatgaaagctcacctgacaagttatttaattcaatcatgcctaatgaccaatatttgtgattttttcatgtcatttgccaatgaattaatgaaattacgagcattttacatttttccaa

SEQ ID NO: 29443 - DNA, 665 bp, Heterodera glycines
cttcagatttctcccccccccaccccccccccttcccgaaaatgttttctggctacgcgcttgtttcctattgttttagacatttctcggtgcaaccacttctgtcaatttcattgttcattttgaactgctccagccaattgagcaatttgaattggtgaataaacggactcgcgaaaaattgacacttgagaaaggacggaatcttcgtcaatgggtgatgaaacgatgccaaattggacaaatggttcagtgggaggacggaaacatgaacaccgtcagcattgaattgaatgtttccagttgcattgggtgagcaatagtagcaacagtatttgtgtaaaaatggaaagaaatggattatatgaaaatttttgagttttttcatatatgtataaactattgtattttggcaaaaccgggaccatttcgagttgaaaaatcgggaatttttgctggaaaacccagtaaaaaccgggacttaggtactcagttgtcccgttttttcagtatcaggtcccgaccccgctctactctaatataaactgagggggtggtcctccaaggcgcatacgacgtacgctcgagccagggtggtggtcatatgcgattttccttacgacggggtccaaaatttttgacgacctttttttttttgctcatcg

SEQ ID NO: 29444 - DNA, 783 bp, Heterodera glycines
ctgaaaaaacgacgcaaaaaatgacaaataaaaaaaaggaatattagcaaaaataaattataaaaaggaaaaaacgcttttattgtcagaaaaataaaattggccttggcattttatgcaaaatggcgaagggaaggaaaagcaggcaattcggagactaattcccaatgccctcccaattcttccttttttgcatcaattttctcgggccaccgtttaccgaatgtttctttttgggctttgctttgctttaacttttcccctgggcccatcacttcgttccaaaatgaaaaatgccaattccctcttcctttgtcaatgttttttcccgtaaatctggtcaaagtgcataatgatagagaatgaaaatgagtgccaaaaatgtaaataaataattaattaattgttaattgcctgagggacggtgcggcgaagtccaaaagcgttgtccgttgcccaattcgtccgcgattaattttggtcgtttcttttgaagtttgggacgaattgcagcatcattttgggcagttgaagcttttcattcagtggagaagggaatcgatagaaagaagaaaatgaaaatccatctgttggccaaagggggcattcattaaaatggcggacaaagcgaagaaaatgcaataaataaaataaactttattggcaatcacaatgaagagaagtgacaaatcatttgggagcataatttaggagctttgtataattggccgacaaagcattaaaaaccgaaggcatttcccacgcccgggggggggggggggg

SEQ ID NO: 29445 - DNA, 1270 bp, Heterodera glycines
tggaaagatattatgaacttttggttcaatctcagttgtcacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgtaatactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgtaatactgcggtctaaacactttggtagaattgcggatttaaaaatacagtttgcgtcccttaatcttcactctgagccgagttactgcggtctaaacacgtttttggtagaattgcggccagaatttaaaaatacagtttgctatggcttcgcatcacccgcttcaacgg

SEQ ID NO: 29446 - DNA, 755 bp, Heterodera glycines
caaatagacccactttccatatagcgccaatagtttcgcttttggtccattatcgtctccacttggtcctttgtccttgcgaatttcgattgctctccaaattgtcaattcgctttttgcatcgaaatgtttgtccaccaaaacatcgaaacggtcggaaagcaatgccaatttgagtccaagttgaggacggtcaaaagatgggagaatgtccatccacacgtcattgcaaatccaactgaaattcagaacaaatacattcaattgcttaatgtcatgaaaaatgccaaatttggctcacattttcctaaaaaattgttgttgtctttcaccaatagcagaagaaatgaggtgccggtcgacggaagaatattttttctttttttcgacgggctgcgccattaaaaacctggaaattcccggactggccccggtttcgctcaattttgtacctaattaaaaataaacaaataaaaaaataattttatttatttggcgttatgttgatcaaaataaaaaaaatttccaaaaacaaattgtaagttatatgtatgtaagaggcaaacatttcaatgggtgagaaaagttaggagcattaaggtcaattgttttgcgtttttgatcgtttaaactaaaactggcttagagcaactcaattattttcccggtaaccaaccccggtaatagtttagatggttgcccccatttttcggagaattttttttttgttttcaaaagtcatgaaaacatatttc

SEQ ID NO: 29447 - DNA, 851 bp, Heterodera glycines
caaatttgtcatcgaattttttttttggaaaaatttttgaacaatcttagtaattcaccatttttcgtaacgtaaattttttaaaatttcttggagggggatgagttgcttccatcaaacccaccgagtccatttcacgtaattttcgctccagacccatgtttttgtgcaacaatgccttcattattgccaggtgcactgacttgtgcacgtaatcagcgctaaaaatgcaagcaaattttattttttatttttccgctaattgttcattttccatgagtatctggtagcaatccacactcaattttttatttaaaaaaattttttcctggcattttcttacgaaaaaatttcataaacatttttttaaacaaacttctgttgaaaattttttttgggaaaattaaggcaccacccccccccccccctcctgttttccatcccacttttttggaaaaagcgccccgcaaaagcggttttgaaaaaaaaaattttgcctaccgaaccctccctctgcactttcgtaaaagtttctccgactcacccaatgccacgtgcaccaccaactcgttccaactcctccctcatcactcgtcggatattgcccagcatcagtgtgccgtcatcaacttgggagcaaatctgtgcaagaattttttaatttaattttttttttgaaatttaatttcatttcatttaattgcctgtcgaatttgctgcgccctttcttccaccaattgcgaaacatccagagccgtcgtccaactgctgaatacggtgcaataaattttaaaataattaaaattttttaataaaaaataaatacgaaaaatttttgccatgaccatacc

SEQ ID NO: 29448 - DNA, 2235 bp, Heterodera glycines
  misc_feature (2001)..(2001): n is a, c, g, or t
gctgcacggatggctgagcacttttctcccgctgttatatgtcaacaaactgaacagtttgtgtgccaaacagccgcagttggagtcgacgcgtttgctcatggcgatgaaggcacaggacgacgcgaaggacggaaacgacgacggaactgttgctccgcatgagtcgttgtggaccaagaagcgagcgaccgtggaggaagagatgtgcgagttcggcatccggatggggtgtgcacctttgatctatgaaatcatatgatttgttatgctaaaaataggcagtttctttgggtgcaccccaaaatatcgccgacacaaaatatgccgcggaaatttaagatgaaaatttttcacttagaaattttcaagaaaaaaatcttagaaaattttttataaagaattttatgaaaaaaaccattgaaaatttttcgagaaaaacagtaatttatcataaaatttcaaaaagaatcgcttaaaatttttcaattttttattgaacttttcttaaaaaaatttttctaagaatttttttttaaaaatttctgtttgaaaaaaatttttaaaaaatttcggcggcgatattttgtcgcggcgatatttaggcggcgaaattttgtcgcggcggtatttcggcggcgaaattttgtcgcggcggtatttcggcggcgatattttgtcgcagcgatatttcggcggcgatattttgtcgcagcgatatttcggcggcgatattttgtcttggcgatatttcggcggcgatattttgtcgcagcgatatttcggcggcgatattttgtctcggcgatatttcggcggcgaaattttgtcgcggcgatattttgtcccgtttctgttatacatatccttgagtcttcggatacaaagcaaaagttcctaaaaacaaatttttacactaaaaaagattaaaaatgaccctcagccgttgcaacttgacgatcaattgagttaagtgccaattttgatcgagaaaaactctcaattgttgtgtttttccgtctttcttcatccgtttgcttatggactctgttttcagtgtgcgacttgatggctgaaactcccattgattcgacattgaagtccttttgacaaaaggaacaataaaaaaagccattccctttccggcttctttttacaaaattatattgcttttcccaatcgggattgaaagaacatttgcgcttatttgaaaacattctgaaataaaaatgggtatcatgaaagattcctaataccatattaataataataataaataataattctcaactatgagcaaaaaaaattaacataatgccataatttaatatccaaatatgttataaaattaccaaatttcctttgattattttttccacttttccaaattctcattttcaaggacgtccttgcatccaaggacatttttttattttcaagaaagagggcccaatttcaaggatgtccttgccattcaaggacggatcccatccctgttatatagtcttacggaattacttttaccgttataaaaatgtctacgcaattacctaccattttttagcctcgtgctcggcgacatcccttgccatggtgcgacaaagacgttctcggataagcgaccaatgaaaaacgggtgtttgaaagcggagctgaaggacaaatccgatcaaagatctcactgacttcttattgattcctattttgacaaattatgaaattattgggtattttgattaaatacattctctttatttctttctataaatgtcaattaactgagttccgagaacctcaatcattattaaatcttcattttgctgagatgtaatatagtgtcaatgtttaggcagtaaaataattttcaaagaaaacagtcgaaaactttttttaaacctgccaaaaattgagtttttttataaattttgtagcattttttctcctttcattagaaaaaattaactgaacttttcaaaatttatttttatttcaattctcctncaatttttgggtggtcatatatttatgcagtaacatttatcttagaaatttttctttaatttatgggcaaaaaaaaaattctgaatctgctaagtaacttttgatgctgatcaaaaaagtcttttacagcaacttgatcagatcattccttcatagtgatcgggacaccacaaaatacagtgcaaatcggggaaattttcgaaaaaatcccctagggggttgtgaaattttttt

SEQ ID NO: 29449 - DNA, 2133 bp, Heterodera glycines
catttgcaaccaaaattctgccattttcttttattttaaaataatttgttgaatttaattgattccctaaaaataaataactaaactttaatcgttttttttaattacttgagccactcgggaatgcgtatgtggttattatcattgagatttgttcattcaataaatcaatttcgctaaagctttgttgaatgtggtaaaacgattccattaccacatcctcattgttctggaccaaatccctagggggaataattaatgggtcagttaacgcatcacaataaaggtcgtaagaaattttttttatttcccatcccttttcatttttttccagtgcattttttttaatattcgattatctttttgaaattcttttttgagttttttttctgtatttttaaatataaatctcacaatattttcctttattccaaattttctattctcttttatcgtatttgaaatttctgtgtaataacttccgtctggtatattatttgttttcgaaaaataatttttttttttctcaactgtcttttttctttaggtacttttaaaaatcttttttcatccatttttaatctataataaaactaaatttgcaaattaaaattaagaatttaaatatttttggacaatgaaacccttttttaaactatcaaattaaaatgtttatttatacctaaaacaattaaatgcaaaatgaataaattaacatatgaaaaaagaaaaacccaaatctatcgctgaatctgacctgtaaccggggagagaatggaacgaaaattatttttgagaagatttagagaaaaaactaaaatttcttatgatcaaaaacataaattgtgttttctcaaactgaaaaaaaccattttagaaaaaatgtaaaaaaaaggtccattctctccatatttccggttatgggtccagttggtcttttaacatcggcattatgcaccaacactcggtggggtggctcatcatgatggtaatgccatcgtcgtaaatttggcggctccggtggtggtggaagacggacaactaaattataatttatttcaaaaaaatgaattattttttgtaccaaattcttcgggcacaatttccaacagctcacgtcgacgtttttgaccattggggtcacgtaattccacttaaatattattgtttttattatcgttttttgattttttatttatggacatggttcacgccaacgcggctggcggccaatttgttgaagaaaatgacctctttggccaggcttaatttaataatgtaatcgtttataatttaggttcgtaaaaatataaactcaccggagcaaacggcatgttgatcaacggtggcggtctcatttgtggtgcgttgaaagccccatacagcggacgagccggaggaattggaatcggcttaaaaatatttgaaaaaagtattatttgcccaaaaagaaccccatttgtctctaaattgctgaaaaaatttaatatttttatttacaagaaatgcatattccgccccccccagaaaaattcctttttttctgtaattctgaaattttagcattttgcgaatgacttaagtacctgcggaatcggtggtggtgggtacggcattggtagcggcggatttgcgaacagggggacgaacggaaccggcgggggaaatcccattggcggcggcattcccatcggcggcggcattcccatcggcggcaggaacggctgcgcaaacgccattgccatttgttgttgcggttgtggtggcatggcgtcccaattttgcgccacgaacggagccaaagccgccgggccatgttggggtaccaacccattttctgccgcttcatctaaaaatgaagggttttaatgtggcccgaaaagtagtttccctgtggtaaaaagcagaaaaacggtgctcccaaatccttaaaagattttgaaccccgcttatttacctggcagattctcctgctccgggtacccgaactctccctcctcctcctcttccggttcctctttgatcatttgcaggtcgggcacatcgggcacaatcggactcggcacaacattttgggccaaaaattggcgtagccacaagctgaaaagtgaaataagaaattaaaaagtgaaa

SEQ ID NO: 29450 - DNA, 1068 bp, Heterodera glycines
aaataacttttgagataataaggtttatcataaaattcaattaaaaataaaccctcaaatattggtatgaacgatactttccaaacatgcacgcgtttgcgctcgagctatttatcatcgggctgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcgttgctctaattaaccgcgataaaaacattcgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcggtgctctaattaaccgggataaaaacatccgaatcaattaaatagcttctgagataataaggtttatataaaatttcaattaaaaataaaccctcaattattggtatgaacgatactttccaaacatgcacgcgttttgcgctcgagctatttatcatcgggcttgttaatccaaagcgaaacaacaaagatgctgttttgaacgaataaagggcttaggttattttgaagaagtgtcaaagaacatcaaacggtaagcctgcaaaatctaataagtggaaaatacatga

SEQ ID NO: 29451 - DNA, 1829 bp, Heterodera glycines
aatgtttggaatcgatttagggacttttataagcctttcctttggtacagtgatgggattagccgtctttttgtcgactggcactacttctgctgaggaatcggttatttttacgataaagtaagggccgaaatgtgtccatagtaattttttgtgtcgggaattacggtgcattcccggaaaagctaccataaccctttccgatatttcaaatttgtttgccttcactcggggctttgcgtcataccactctttactctttttcctgtattcctccaaattttgtttggctttgtcttgaatatttaagagattttccaagaacaattgaaaataaaattggacccccaaaatggtaaaatggtcatttttggcgaaaaaatcctacaaattccttctttttctccccggcgctgaaaatttggagaaataaatgtcggagaaaaaagattttttggcctgaagaacaaaaaaaaaacgattttcccttctgaaatttcattttttcttgttatggatttttacttcatataattaataaaaaaatttcgaaactttaataatatcgattaaacagccagtgaccatctgatcaccaatcaattcaatgctttggtacaacgatttgcacaagtcgaaacaaaaagcaacccaaacaattgttatcgtagccaaatacagtcggattttggtcttacggtgccttaaaaatggaaattaaaagttttataacaatatttatatctaacttttcatcaaaaatcactccaatcagtcggtcaatgcccgtgaaaagcattgtcggataaatgccacctaaatttcagttttagaaaatttcggataaataaaaatttatattttccgatttcttacaaattccaagcattgaaatcagttcaatctttgttgccaagcgatacggaatgaaattttggccagaaaatgtggtgtacacaaatagaaaatgcccttgttggtgaagcagttcaaaaaaggaacaaagtgccaaaaggtaattaacggtgccacggaattgtctaaaaatttaaattaaaaatttaggaattattcagcttttttttcaaactttgtcctaattgttacaaatataacggaaacattgaaaatgattccaaatgctgcgatgattccaaatataaatgcgcagctgatcagtgcccaacttggcttggcatttttgtatgccaaataaaactgaaaataaattaaaaacaataattattttttcttttggcttactgtgccattgtttaaatctgccattgcttatatttgaattggttgttcaaaatattattagaaattgtgcacttttaacaaccttttttcaaatgccaagaaatgattacattcttttgttgctagggtaaaaaagaatggaagcaactgttaattaaatttaatgccaaatgatggtaagttacaacaattcacctgccaattaattaatgaaattacacgtttttcagcaataattaaatggaaattttaccctttttctcgaataattaaatgtaattttacgctttttcccagtaattaaaggtattttacgaattttttctccgataatgaaatggcaatttttctgtttttgagttgtaatcatatgtacatgaaatgacaaattaactctaaaaataatttatatgactaagcaaccgtggtatcatcaatggcacaaagtttctaagggcatattgaaaagattgcaccaaaatttttcaaaaagccggtatgaaaatgccgaaattgattgtcagttcagagtacaaaaaagtgccatggaaaaacatcattttaat

SEQ ID NO: 29452 - DNA, 1693 bp, Heterodera glycines
ttttttaaattttcgaccaaaaaaaaaatccaggccccctggggggttttttcggttttttaccaaaaaatttttttttcatttgcgccattgaaaaaccccccggcatttttgggttgcactttttcaagagcttttgaaatgatataaaaaaaattttgaaaactcaaaaaaagtttttccctccaaaccgggtgggtccagtggtgtgtgtggggggttctgggggaggggggcccgggttcgaatcccgcggtgtgcggatgatttttatgacgggtaacgatgttccaaggggctggaaatattttctaaaatttttctatatttttttcaattttttaaattttttatttgaccaaatttgggtgtgtttgaatttttcatttttcgcccaggggaaatttggggggattttcaaaaattaataactccatttgaaatgggtcaaatgtgaaaattaaatgatcaaaaaatgcagaaaaatcgggagaattttatggtttttattgtgcatttctacaattaatatgaaaaatgttattcctgaaaaagatgaaaaattcgatttttcacataaaaattcataactcattccaataaaggcagtagggtataaaaaaatattgataaaatccgcaatttttttctctacaagtaggaatttatttcataattttagcacatttttaaaaagagttataaaattaaaactgcttttggagccaaaatccaaagggataccattttggaaatttaatggacacatttttttgctctaaaatttaaaaaaaacatattttcttacgtaatttgggtcgctgatcacgaatatgaactttattttgagttatagacattttggaattttttaaaaatttttgaaattttagaattttttggcccttgaaaatttaagctacattttgaaaattcataactcccatcaaaaaggtccaattcagtccatttaaagtttaaaaaatagagaaaaatagggagaattttatgagatttatttgggatttctatcttgcaaacaataaaacttattcctgaaaaacttgaaaatttcaatttttcacataaaaattcataactcactccaaacaatgtgctaaggtatacaaaaatattgataaaatgcgcaattttttgctctattatataaattttatttagcatttttatcacttttttgaaaaaagttataaaaataaaagtgattttgggattcgggaccaaagggggtggacaggatttttgagtggaaaaattttttcacccaaaatcttcaaaaaatatgtctttaaggccatttaatgacgctgatcacggatacgtgatcagttttcacttttgacatcgttaaggcctcagaatccctgcgtaaactgggattctgaggcattcaggttcgaatccggacggtgtaaatcatttttaaatttattttctgctattttttaatgctaattattaagtcaaaattattttatttattttttaaattcaattttaaaaaaattaaaataatttttctataaaataaaaatgaaaatgtttaattattaatttatttaaatttaaattaaatgaatttttcttgaattaaataataaataaatgtatttatttataagcaaataagattcagaaaatgaacggattaataacagacaaaaaatttaaa

SEQ ID NO: 29453 - DNA, 1126 bp, Heterodera glycines
tctcttattatttcattaaaagtagtatacttttctgtctgcagctgttgactttgatactgcgagtaaaatagaattttttctttcaataatagagggcaattttgccctttcgggttaggtaataatttgaaaaatactcaccaattgaaatttactggcatttttcaaaagaggtattcataattttaaaataagctcatatttatagtgagcctgttttcacctcgcttctattattaaagggttaaaagattgcgcataaaggccttaattaaccacaagaacatattcacatattttgtgtaattctatctcggactccctcttgctcaaaataatgagtttaatgtaaaatagatttgactagcggatactactaagttattttaaaattttcatctcttaattattttcatttaaaagtagttatactttttctgtctgcagctgtttgactttgaatactgcggagtaaaaataggaattttttcttttcactaatagaggacaatttttgtcctttcttgattagctaataattgaaaattactcaccaattaaaatatacttgcatttttcaaaagacgtattcataattttaaaataaacacatatttatagtgagactgttatcaactcgcttctattattaaagggttaaaagatgcgcataaaggccttaattaaacacaagaacatattcatatatattttgtgtaattctatctcggacttcctccggctcaaaataatgagtttaatgtaaaatagatttgactagcggatactacgaagttattttaaaattttcatctcttaaaattattttcatttaaaagtagttatactttttctgtctgcagctgtttgactttgaatactgcggagtaaaaataggaattttttcttttcactaatagaggacaatttttggcctttcttgattagctaataattttgaaaattactcactaattaaaatatacttgcatttttcaaaagaggtattcataattttaaaataagcacatatttatagtgagactgttttcaactcgcttatattattaaagggttaaaagaaaggcttaaaggccttaattaaacacaagaaccatattca

SEQ ID NO: 29454 - DNA, 1170 bp, Heterodera glycines
  misc_feature (1082)..(1082): n is a, c, g, or t
ggcgagctctaaatttccaaccaatgtaacgccccaaaacgaccaaatcctctttacaccatagatttggatgaatatttgcaatttttcagagaaaattatgaaattttggttaaagaggcttcaaaaaacatcgcgaaagcccaatttatccaaaagaaacaatttgactcgaaaccgaacgttcaaccaggaaaatataaattgggagacagagtaatggttttctttcggccgtcggcacaaattaaacactcaaaattatcttggaattattttggtccttacaaaattaaggccttaagtctaaccgcagcatggttgtgcctgtgaataaagaagaaagtgaacaaatcaaagtcccaattgaacacttagtccatacaccaatcgaacttcccaatgaaacttttctcccaaaacaaagacgcggaaaaattttcaaaaatatgccacctccagaaaatggaaaagaaaccagccaaaagaaaattaattctgttttgacaaaatgcatcttttcagaaaatgtcgccccggcgaaattggcactcatcgcacactgctcaggcattgagcaacattcaaattgttcttgcattttgctggaagaagtgtttccgaacttttcggccatggaccctcttcgacgcgtccaattgtcatcacttggagaattaatcccaatttcaatcgccaaacagaaagggattttgctgggccatattcgcagttgggccaattcggatgaagaatcagcttcactccttcgccacattcaaaatttcattcctccaattttaatgtgggtggaccgttgtgccgtcgcatttcaaaccctcaaaaatacgggaatgaaagttgtacagcaagagatttgctcaaaaaatccgctccaccggttcggggagttgatcagcgaagcattcgaagaagtgaaggcaaaaaatataatcggcttttcatcaatggaatccgaaaaattccttttttacggcgactcatcggttcgagagtttgctagtaaattggaaacaaaaaccatcatttttaaaaacacactggaaatggccgaagcattncaaaatacttattttacgactaaagtccaagaaattctgatcctgatccgaaatgacgatttggaccaggccttgggttaaatgatgt

SEQ ID NO: 29455 - DNA, 1043 bp, Heterodera glycines
  misc_feature (61)..(61): n is a, c, g, or t
cgcgcttccggaatgtgccaatatggcgacgcgtgccgtttcgcgcacagcaacgaacacntccgtttcgcggcaggtgggcagagtcaatggcaaatcgaatgccacggaacactttcttcgttcagcttccgcacaattacaagacgaaactttgccgtaacttcgaacaatttggtttttgtatttatggggtaagtcaaaaaaatttccgtccttttaaattttcttgggatggaccgtcggacccggccttctcgaattagcaaaacagtgaaagaatttttggctgtcagtgattatttaattaaactaaaagggctgttttaataatctttgaaattaacatttgtcgtcatttaggccaagtgtttgtacattcatcgtgatgcggttcgttaattctcacaattatggtcaatgtcttcttccgatttcagttccgtgcctttccttctcagcttctgcccaatgctcattgtcagatgccttcgcaattttcgttccctcgcctttcgaattcttcgcccgcgtcggcgcccttttctctgtggaaagaatgaatgaatcgctttttctgttgtttttaacatacattttcaaattcctataaatgtgttttagaaattaatgaaaataagttttaaggggttttcaaggtcgctgatcacgaatatagcacccatttttgccaatttcgaacccctgacccgaactcgaacaaaaataaaattaaaaaatttgtatggatgatatatcctcattggcatcttacccatgagggtaaccttggtataggaagtataaaatttaaagtgtatggatgatatcctcatgggcatcttgccaatgagggtattattggtacaggaagcctatcaattctttgtccatgtacagctcatgtagtgaacggtagcgctgatctgagcggattcatgatcagcgacctcgagaactccttaatacttattttcattaatttttgaaacacatttataggcatctgaaaatgtatgtagaatctgtcctgtaaactagag

SEQ ID NO: 29456 - DNA, 1882 bp, Heterodera glycines
  misc_feature (29)..(29): n is a, c, g, or t
  misc_feature (103)..(103): n is a, c, g, or t
cggacggagtgccccctctttggacatgnccgagcacagtgacgcgagtgtcgtaatggagcctgttcttgacagaattgcatacctaaaaagaaagatggtntaaggagtgcctaaactaatgaaccatttcgctggtgatgactttgccttcctcgtcgatggcaccctccgccacaatgataatattcagtcgctggttgagttcgcgagaattggtcaattttgcacaaagaacctaaaaacgaatgaattgatgggcggatgaatcggtgggccgacctcttcccattttttgggttgtggccattccggaatgaaacaataatcggcctcacaagccaaagcggcaaccaacgccaaataaccgcagtggcgacccatcacttcaatcacaaaggcgcgctggtgactttgcgcggttgaaacgaccgcatcgacggcctgaaaagaaaagggaaggaagaaagagatgtcggagattgcattccatttcaatagtaagcacctcaacaattcgctgcaatgcgctgtccgtgccaattgtcatatcagtgccacaaaaatcgttgtcaattgaaccaacgaggccgacgatctttaattttaaggaggatgttatgaccgaaagcaaacataacctggacataagggcaaagcttggcctgctcctcactgatttggccattcgacaccaattctttaagcagtgctggccattcgtcacgaaaaatggtggcgccggtcaacgacccgtccccgccaatgcataccaaatgagtaatggaatttgcgacgagatttttgcaagccgaaaagcaaccgaataaaaagagcagcgaatgtactcactttgagacggccatcgtgttccctgaactctttgcaacgcgccgaaccaattatggtaccgccgctttggattatgtcggaaactgaattccaatgcgcctccacaatgttttctcctccgtccaccattccctaaacattcggatgttcgccgcccaaaagtcgctcggtccgtctgacctggtaaccctctttgatgaaaaacacgcgacaaccaaagtaaagtccggtacggacaacggaacgcaccgcactgttcattccttaaagagtgccgttcaaaaaaaggcagcgaaggaagcgggactcaccgcacgaatcaccgccacttgtaaaaacagccattgttcgaccagtgaaacatcccggctcaatgagagagccctccatgcgcactggggacggcctcttggcaacgtcagaaattgacatttgacaattttgttgtttaaactattcgactattttttttaagtggagatgcttaacataacacaaggttaaacagttcgtattcatataaaacgaacacatgagaatagtacattaggtaatactgcagaatggcggcccgacagaaaataaattaaaaattttatttttgtctttaccagggtaaaaaatgtgctgattactagagatacgattttaggtttttacctgtttttcctgagctccctatagtctaaaacaaacgaaaagcatgtttttttgtggttgttaagctacttttcaagttattagtagggctgccaaaagtatgcaaatgcatattttttcctggcttctccatgctctaaatagtaggaaaaacactttcttttttgtgtttgcgtataaaaatcgggacttttatttgcatattttgggcttttatgcatattttgggtttttctgaatttttatgcatattttgccattttttggaaaatttgttaacaaaaatgcaatataaacggaaaatacacccctaaaaataggtcctaaaaaatacagaaaaatacacccctaagaatcgaccaaaaatgtt

SEQ ID NO: 29457 - DNA, 1517 bp, Heterodera glycines
ggcatttctctgctctgtccgtctctccccccaattccaggccatttctctgttctgtccgtctctcccccaagtccatggcatttctttgttctgtccgtctctccccccaattccagggcatttctctgctctgtccgtctctcccccaagtccatggcatttctctgctctgtccgtctctcccccaagtccatggcatttctctgctctgtccgtctctcccccaagtccatggcatttctctgctctgtccgtctctcccccaagtccatggcatttctctgctctgtccgtctctcccccaagtccatggcatttctctgctctgtccgtctctccccccaattccatggcatttctctgctctgtccgtctctccccccaattccatggcatttctctgctctgtccgtctctccccccaattccatggcatttctctgctctgtccgtctctcccccaagtccatggcatttctctgctctgtccgtctctcccccaagtccatggcatttctctgctctgtccgtctctccccccaattccatggcatttctctgctctgtccgtctctccccccaattccatggcatttctctgctctgtccgtctctcccccaagtccatggcatttctctgctctgtccgtctctcccccaagtccatggcatttctctgctctgtccgtctctccccccaattccatggcatttctctgctctgtccgtctctccccccaattccatggcatttctctgctctgtccgtctctcccccaagtccatggcatttctctgctctgtccgtctctcccccaagtccatggcatttctctgctctgtccgtctctcccccaagtccatggcatttctctgctctgtccgtctctcccccaagtccatggcatttctctgctctgtccgtctctcccccaagtccatggcatttctctgctctgtccgtctctcccccaattccatgtcatttctatgctctgttagtcactgcccccctcccagtcatataatgctatgaccgctatcacccaaaatccgagaatttctcaacactctccctatcacccacacacctcatggcatatctctgtattgcaccgcacgacctcccatttattggtattaatctactctttgcctacctaccccccctcgcatgtactgtatatgctctcctctactctccacaccatatcatgctataattctctcaactctcatgcataaccaaatataataataatgctcatatgtgctatttttccccgcaacttttatattatttataataaatataacggctaacacgaatgggcctgcactttataccgttccacccccgctagccataatattactgtaatttatattctactttatttaaccccaaaaacaataaaatactatataagattagccagatcctcatggcatcacattaagatcttcatccattatcaccttctgccacaccgtcttgtacattttgtgcttct

SEQ ID NO: 29458 - DNA, 1082 bp, Heterodera glycines
  misc_feature (19)..(19): n is a, c, g, or t
  misc_feature (67)..(67): n is a, c, g, or t
  misc_feature (101)..(101): n is a, c, g, or t
  misc_feature (110)..(110): n is a, c, g, or t
caatcgctttttggaattntaatgagtaatcagggaccgtaaaatgacattctatgcttctcttgtntgatacacggaaagaaataatagttagtcctttngtgaatttntagaaattttatccgtcaaatcgcttttggaattttaatgagtaaatcaggaaccgtaaatgaattctctggttctcttgtggatacacgggaagaaataatagttagtccttttgtgaaattttagaaattctatccgtcaaatcggcttttggaattttaatgagtaaatcagtaaccgtaaatgacattctatgcttctcttgttggatacacgggaagaaataatagttagtccttttgttgaatttttagaaattctatccgtcaaatcgacttttggaattttaatgagtaaatcaggaaccgtaaatgacattctctgcttctcttgtttttttagaaattctatccgtccaatcggcttttggaattttaatgagtaaatcaggaaccgtaaatgacattctatgcttctcttgtttgatacacgggaagaaataatagttagtccttttgttgaatttttagaaattttatccgtcaaatcggcttttggaattttaatgagtaaatcaggaaccgtaaatgacattctatgcttctcttgttggatacacgggaagaaataatagttagtccttttgttgaatttttagaaattttatccgtcaaatcggcttttggaattttaatgagtaaatcaggaaccgtaaatgacattctatgcttctcttgttggatacacgggaagaaataatagttagtccttttgttgaatttttagaaattttatccgtcaaatcggcttttggaattttaatgagtaaatcagtaaccgtaaatgacattctatgcttctcttgttggatacacgggaagaaataatagttagtccttttgttgaatttttagaaattctatccgtccaatcggcttttggaattttaaagagtaaatcaggaaccgtaaatgacattctatgcttctagaagtgatacacgggaagaaataatagttagtccttttgtt

SEQ ID NO: 29459 - DNA, 1114 bp, Heterodera glycines
agagagagaataaatgagagagagggagaggcagacagtggaaaataaaagagtgtgagagggagagaaatggagagtgtgaaagagaggggaagagataagaatagcagacagacagagaaaattgggggagcgaaaatgtcgataagcgaatgaggggggggggggggcggcgtccaccctttgccatagcaaggggaaatgttgcaaataataactaaaaacatttaggtaaaattttggcaacagtttttttgcaactatttgcagtttttagcagctattttgataatttttagcaaatattttggcagtttttagcaactatttaagcacctttttcatgtttttaacaaaaatacatgccctagtaataattcactgtaaaataatttaacgtctcaccattcgggcattctgccaccattctgtttaaagttacctaagactaaaatgatttaaatgattatattaatacatagatttaaaaccaaatttccatatgtttctgttttagaaattatcaattttaaattttcgagtaaatattaaactttttaaatcttttgggcccagtatttttatcaatttgttttggtttgtggtccggtaggaggtttaatacaaagtactatattaaattaaattggttgcggtttcttattggttttttttataatttgatcaatttttggctaaaaactgctatgaattatttagttaataattgcaaagcattaagaagcattccgatttcatataaattgcacatattttatgctattccgaacagcaaaaatttagcaaaaatgcaaaatttaaaatcattcaaaaaatcacaaaaatattaaaatatattcaaaatgacagaaaagcaaaaaaatttaaaaaatgctaatacaatatagaattgaaataaatgcattaaatatttaattaatttaactttttgaaattttaaaaattgttaaattattaattgaaattcttccacagaacaacattgaagaacaaacacacaatagttgactggtacaatttctgtcgtgatgtcaaggaaataatttaacacaaagtatatttttaacaaaacagaaaagaattaacattaatt

SEQ ID NO: 29460 - DNA, 492 bp, Heterodera glycines
attttaaaatttaagctttcacctcatcacatttacttaattttcatgcagcataattcaacacacagaacgagttgcagaatgcagaaattctttacgccgttgaaaaagctttattcagttatattcataaaatgttttctatttttttgaatagtgattccaatgctaaataattttgtgactaattatttatattaaaattatctctcaaaattattagaaataatatagatttttacgtgtttttgtactatttttcgtaggaaattcaataggagtagttactcaccaagattttcggggttgtttttcagtcccgccatttcagtcccagtggaaagggacatttcagtacttaaaataaatataacccaaagccaaatcctattggagaaggggaagggaggcaaagggaagggagtcagctgtcgtgcccttgggggaggagagggacaccaggccatctgagcgctcgcgcgtgccatatga

SEQ ID NO: 29461 - DNA, 1975 bp, Heterodera glycines
  misc_feature (639)..(639): n is a, c, g, or t
  misc_feature (645)..(645): n is a, c, g, or t
  misc_feature (667)..(667): n is a, c, g, or t
  misc_feature (706)..(706): n is a, c, g, or t
  misc_feature (716)..(717): n is a, c, g, or t
  misc_feature (723)..(723): n is a, c, g, or t
  misc_feature (727)..(727): n is a, c, g, or t
  misc_feature (729)..(730): n is a, c, g, or t
  misc_feature (769)..(769): n is a, c, g, or t
  misc_feature (797)..(797): n is a, c, g, or t
  misc_feature (813)..(813): n is a, c, g, or t
  misc_feature (817)..(817): n is a, c, g, or t
  misc_feature (835)..(835): n is a, c, g, or t
  misc_feature (846)..(846): n is a, c, g, or t
  misc_feature (867)..(867): n is a, c, g, or t
  misc_feature (880)..(880): n is a, c, g, or t
  misc_feature (932)..(932): n is a, c, g, or t
  misc_feature (936)..(936): n is a, c, g, or t
  misc_feature (938)..(938): n is a, c, g, or t
  misc_feature (940)..(940): n is a, c, g, or t
  misc_feature (1088)..(1088): n is a, c, g, or t
  misc_feature (1304)..(1304): n is a, c, g, or t
cctgcaccaaaaaagccgaaaatttacaaaagcaaatcgactatgacagattggcaggcttttcctctaaacacaaaatgttttcttccatgtcttctgttttcacactctttccactcttgctttaaaatccatgttttgttgcaaaatcatttaataaattaaagaaaagttccggaatttgccgtgcggcgcctgtcggccgctaaccgaaaattcttcttaattttcaaaaattttttagaaaaaaatggttgtgattagttttttaagcagaatcttttagcaaatttgacaaaaaatttaatgcacaactctttcgcaaatagctagctctgttttccctttatgggctttcttttaatctcgttaatccgttcaataagttttcgcattttcttttcgtaatatttcttttcatatttttttttaaaattcttttttccatttataattttcattcgagatgcaattttctgctcaattcgtatctgaactttttgtggatattttcctcctttttaattgcttctctgattacatcaaatttacgaacaatttcacaattttgctcatttcaattgttttcatttgatcagttacaatgaaatcagctgaatttaaaccatacaatcaatncctatnacttttttattcattaaatttnaatttttaaaaattcaaacaatttaattatcttcaattnataaaaatcnnaatatnaccntnnatttcaataaaaaaatctcattattactctaatatattntaaatctacaaaatttaaatccattctntttaattacccaaccntaanaaatcatacaaaaattcnaaaatttcaanaaaaaatttaaaaatcatttnataactctcactnaaatcaaaatttaacaaaaatttacccatttattttacttttttccattttnatanantnacaattccaattttcaaaaggtcagcaatttctttcacttttagagaccgagttttcctctttaatttatatcaaatgttcatttttttcttcattcgaatacgcatatttaactaaaaatttaaaattaaattttaatttaaaattntaattaattacttttaccaatttcaatgccaaattcctttttccataggaataatgttttttgtctatgcccaattctttggcaaattctttatgttttcctttttaggacatattcttaactcgtcaattcgttcaacaaattctctctttttcttttcataataattcattcggtttttctttcttttcattaaattaaattcttttttccatntaaaatatattggcgatttgttctaattttttcgcaattttttgctcagttttatacgagacttttgccgaatatttatcttttttcttaatttcttctttaattgcgtgaaatttattttcatcactgaattgaccaaatctgagcattgcgaattgaattggctgaatttaattcattttatcacttttacgataatttgcgttttgatcaatttcattttcaaattcaattttttctttatcccatttttggctaaaaatttcagcaaaagttggccaaagttttctattcttttgacataaatttactgataaagcttttttagttgaattattatgaatgagagcacaaaaacaaaaataagaaaaggcatctcttaaaaaataaataatatttatgatttttattattcaatacttttattttggctaaaaatttagaaacaattctaatgacaaaattttatcaatttgtgaaaaaaatagaaaattaatgacaaattttgctcaaatatttggccaaggatgggactttgtaataaaagcaaatttatattatcccatatctaaaaatttaatttatgaaaagtagatttattttttacatttttgtgaatataattattcataatgaattcattaaatcccatttattcaaaataatatttt

SEQ ID NO: 29462 - DNA, 1676 bp, Heterodera glycines
tcctctcctccccttttgttaatgctctcataaatcacagtgatttcttcgctttctttttctctatttttcgttgtgtttcgacgtgtcttttcttctctggctctctcactttcccccgctgtttcgccctcctctctttgctttgtcgcactttcttcagccccttttgctttcttccgacaaatgaaccctttgcgtttgtcaggcgtcgcccatggaatccgtggcgcaacgtgtcgcaacacttttccgtccaccgcagtgccatcctcgaaatgctctttgccgtaatatattcccacccaaaaatcgctcaagtcccagtggaaagtgatgaaggtgaactcgtccacactgtggaaggaagcgaaatttgcctaaaaagcaaaattacacaaattggcattcctgctgctgctttccatccgccatttactttcatttgggcacattcctcaacccccgcgtaaaagtccttctctgtgcggcgtccgtagaagcacaactcattacggtaattgagccaccccttctcgcattttccctcctctttctcctgcttctctccatcttttcccgcctcttctttctccttcctctcccgtaacttccatctttgtccctcaaattgctcttctctctcttcaacgctttcattctgctgctcttcctctgtctcctcaaatgtttcattgtctgatttaattgagtcaaaatgtccgaaaaatgccgtcttatcagtgacagcaatatcctcatactcataatctaattcatcgtcattaccatcatcatcattgtcgtaatcatcttcataacggtcagtgtcattctcttccataaatattgtttcttgaattgactcggaatctaaaaaaatttttaagattgtttaaattttgttgtaatttactttcattttcattcaaaaaagcttcatcttctgcttgaactgcttctttttcttctcccaactcgccgaattcgattggtgaaatttggtgaaaaattaaaataaaaagaaatatagaaaaaacaattttgcacatctgcattttagaacggcaaaaaatgcgtaaaaatttacgtttaattactaatttagtttaatacacaattaggcacttaaaaaagcatgtaaaattatatttttattcattttattttttaaaataaaaaaaaatattaaatttaattgaatgcagctttagagatggaatgatgccatcatccgtcatttgccatcgctcacctccaccccccgcccgccccctccctcctccctcacctctctcaatttgccatttttttgcccaatttgtgcctttctcttcccacccattcattgccttggccacaccaatcactcactaatgccaatgcgtatgacttacaaaagccaatacttctcttcgcatttcatcatttttgcgcttgtcaaataaattacacggccataaaggtaaaagatgggagctgctgtacttcttcaagttgtgaaaattatttgggataatcataatgctggcattactttcccaatgatcaacggttcccatgggccatggtctcctaaactcagagttgccattttgcagttgccactctttgggtcagtcagcagcgccaggaatggccagctttgaaattgccagttttgcttgatttttcaa

SEQ ID NO: 29463 - DNA, 610 bp, Heterodera glycines
ctcattcaaaattcaatcacagcgaatgtctcaaaatccatccaaaatgaaagccatccgccccgggggcggggaaggcacggcacaacaaaagccaaaggcactttaataaatacggcagcccatggcaatgcaaatggaaacagtgaaccatggcaaaatatgcaaattactcttggcaatctgttgattaactcaaaacggaaggtactgtcgcggagagtcataaaataatccgaagagaatatggtgaattctttgccaaaataaccgatggattttgaaagaaaaattttggcgctactgtaaaagttgttggttttgaaaattttttcaaaaggggggacccttttgttttgcaaaattttttttgtgatagtcataaaaatttattctctggggtttttggggtccccgatcacgaatctttcaattattttgatcaattccgatttcctaatctaaatttgaacaaaaaatcataatttgaaacgagttcgggttagggattagaaattagtcaaaatacatgtcagattcgtgattagcgacctttaaaaccccggataaaaaattatcatggttttttatcttaaaaaaattttgcaaa

SEQ ID NO: 29464 - DNA, 1327 bp, Heterodera glycines
  misc_feature (67)..(67): n is a, c, g, or t
  misc_feature (163)..(163): n is a, c, g, or t
cagagcaaaagttcgaatccgcttgcctgcggcttatttattgcgattttccctgggctaccgtacncctcgcagtggtgacgtcatcatctttgcagcatatagtggacaattatctttttctggcaagtgttctcgtggcagagtggtagtgtgttgggtntggtggcagagcaaaatttcgaatccgcttgcctgcgacttatttattgcgattttccctggactaccgtacccctcgcagtggtgacgtcatcatctttgcagcatatagtggacaattatcctttttctggcaactggtctcgtgtcagagtggtagtgtgttgggtttggtggcagagcgaaagttcgaggccactagtctgcggcagaatttttcgaataaaaaaaagtcgcgcacccctgcaataggtttaggcttgcagaaaaaaagtcgcgcacccccctgcaataggtttgggtttgcaaaaaaaagtcgcgcacccccctgcaataggtttgggtttgaaaaaaaagtcgcgcaataggttttggtttcagtactgaaaattttggcgctcagttggcccgcgctcacatggcggcgctcacctggctggcgctcagttggccgtgcacccctcccataggtatgggaggctaccgtacccggcggatttgtgtgccctaactactatagcagtcgatagaattttcgaatcgcttttaaatcacctcttttgcgtcccttaatcttcactctgagccgagttactgcggtctaaacacgtttttggtagaattgcggccagaatttaaaaatacagtttgctatggcttcgcagcacccgcttcaacgggtgctcagtgtaaatatagactggccattcaaattctgcctttccagccttatggaaagatattatggaacttttggttccatctcagttgtcaacaccgcgactgcatcgttattatatcagtcgatagaattttcgaatcgcttttaaatcgtctcttttgcgtcccttaatacactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagcattttcgaatcgcttttaaatcgtctcttttgcgtgccttaatcttcactctgagccgagttactgcgggctaaac

SEQ ID NO: 29465 - DNA, 2193 bp, Heterodera glycines
aaaataaaatttttggtacattgtaggatcgggttttcaaaagaatttactatgatatacctatatgtatgaggctgaattaggtcatttttatcacgaaaaatgttccgattctcgcgaaattccaaattaaaaactgtttttagattaaaatttttgcactaactttttttaactacagtaaaacggtgattttttggaaaattttataaatttattcgaaaatctcccccaaatccttaaaaaaacccacctttcccgggggaggccgacaaatttttgtggtcgtcgatggactggtgggcaaccacggggcggagcaccaccgctgggacgcttttcgttcaaagtccaaaattcggtaggccaaactttgggtgtatcgccgttcctcggcctgaaaaaatgtgaaaaataaataattaaattttaaaacaaaaaaaaataatttttatttataaatgtttttctataaatttaaatccttttcaatatttaaaaatattctttaaaataacaatataaaatttttttttataaaagtgatttttctccaataaaacatatttttatatttttcataaatgaaaaatataaaaaggtttaagaaaaaaagaatttaattgaaaaatatttttctcaatttttatttttatttcaatttacaatatttaaaagattcttcaaataaacaatataaaatttattttatttgtatctaaatgatttattttcttttttattattaaattaatttattttaaaaaattcatattaattgaatcccaatttaaaatcattttttattgaaaattttaataataatttcaatttaattcatttttttattgaaaattaataataattaattaaatttcaatttaaatcattttttaatgattaatttaatttcatttaatttcatttaaatcattttttatttaaaatttaataatttattgaattccaatttgaattcatttttattggtaatttaaataataaattagaatacaatttaaatctttttttaatttaaataataaattagattttaatttaaaatttttttcattttcctcctaaattttgccttcatccgcgtccacaattcgtacgcctcttgcgccacttctttcttccgcttttccgtctcctccttctgctcgtgttccgtctgttccgcgtgctcgtgctccattcgctccctctctctttggcgcacattttgtgagactaaaaatttttaaaaatgcccaaataaagcccaaattaaatatatattaaattaaaaaataaatttcaaaattagagagaaaactagattatttatttaattaaaacatcttgcaattcatcgacgtttcgggaaaagtctcggatttgtttggggtctcgagttttggcaaaattttctgtctcgggtatcacgattatccatttgtatgaatttaaaatatttttttccaaaaaactcgccattccccaaacgcgctgtccgccttcgtccgattcgcctccttccgtcgccgctcgtccgcttcgcgttgctgcaccgcgctttgggcccgctcgcgttgacggcgcacgcgttgtgcctccgtgcgtttccaatgctcaaaagtctgagagaaaattaaaaatcagaataaaaaaaacaaacttttaattgcttttcttgaggatatctcgagattgaggcatatgacactaagtatacccccgaggtaagagttagagaaattttctgggacaagagaatcagtcaaattcaaaacccaaaatcagaatttttatgggggtcaaagctcgggaccaagacagactctcgagagaagcgctattcaaaattgcttccgcgcactttttccgcgtccgctcttttctcctcctttttccgcttttcttgttccgcgagcgtttccgccgcccgcttctccgccgctttccgttgcgccattcgcttgtccaattcgcgcttccaacgctcaaaattcatttcggacatccttaaaaataatttaatttgttaattcattccgctcgcgcactttttcttttccgcctcttcgtccgctttctttttgcgctcctccgcttcgcgctgcctccgtgcccgatcgacttcctgtttttgccgtagccatgccttgggcaataacaataataattagtgatcactgatcagtgatt

SEQ ID NO: 29466 - DNA, 1574 bp, Heterodera glycines
  misc_feature (1557)..(1557): n is a, c, g, or t
cgcagactgaacctgaagagaagcccaaaacatttgcttttggattgcaaactgatcaaaccggtttgatcgattcggagatgcaaacagtttcagaagagaagccgaaaacggtcacttttgcaatgcaaactgatcaaaccgatctggtcaattcggagatgcagacggagacagcagagaagccgaagattaccaacaagttaatcactacagaggcgcagactgaacctgaagagaagcccaaaacatttgcttttggattgcaaactgatcaaaccggtttgatcgattcggagatgcaaacactgtctgaagagaaaccgaagatgaccaacgacgaggttcttgaactcaatgtctcggttagtttattttaaaaatgtttatttggtcttcatatattttcttgttgtcattttattctttgagactaattttatttttcgatgttgcagaaattgcctatggatgctgattcgtcatttctcagtaatcaagggcggagttcccctttgttggacgaatcattgcgccgtaaatacaatgaaaagtgtgaagaaatggcagaattacgttatgtaatttatctttttcttaaaatcttttctaaacattttctacaggcatatgagtttcaacagtcaatcatttctaatcaactggacgaaattgcgcggctaaagcaacaacaacaactacgaaatggcgttcaaaaaaatgggtgagcgaagaaatagattcttacactgacaatgagtacgtttaaaagcgtgttacttttttgaattaaatgatgctttccgattacaatacaagtcattgttcagaagtccgtcctcgactcgtcacccaaccattactgctgcttcgccgtcgtccgttttccctagcggtgctctgcccaccatttcgggtcgaccacgcgctgcaaggcgaacttattgcgaacattgcgaaatgtttgacgcacacgactcgtcagagtgtccaaaagaagaggcaaaaagagcagaacgacgcgaccatgaggcactttcaccgcagaagtgggacgaacgggaacgcaccttctggcattaatattgacgatgcatttagacccaccctttttctctttatttttgtccattcgtttgtatgatcttttgactttaaacccgtgtgcctttttctcttttttttgtctcattgagtttaattattttcatcagctgcctttcatattcttggttcggtttcctctttgacttttctttttacattaaaaatcgtaaaaactaaataaaattcaatcattgcttttttccgcctaaagttcaatcaatggcttttttgtgcccaaattaccgttcgtttatattgacaattggctaccagacaactctgtttgttgtcaatttaaatgtgcattaaaactcatcttagatttcagggtaacgactgaatctcaaaaatgaacggttctctgacaaatggcaacaaagtcgaccgcggcgtcaccattcttttgggcgcgcaatggggcgacgaaggcaaaggcaaagtgttggattntctcatcggacatcaca

SEQ ID NO: 29467 - DNA, 2374 bp, Heterodera glycines
tccatcggaagccaaatgtttctcgtcggattgaccggcggaattgggactggcaaaagcacagtgtcgcggatgttacgcgaacggggctattcggtggtggacgcggacgaaattgcgcggatgggtccgccattttattttccctaattataccatcaaaatgacaattcaattgcaaatttgaatcctaaccgaaccgtcaaaaaactaaattttgttttaaacccaattttatggtcccaaattttttttgccaattttagtaatctccgattttctaaaattttttacaaattcagttgttgagccgggcaaaaaggcatacaatcggctgagggctgagtttggcgacagttttttcgacgatgaaaacggcggagttttgcgacgagacaaattggccgagttggtgttcaccaatgttgaagtatagtttaatgaatttcaccaaagatttttttgaaattaaaggcttacaaactaaaaatttagaaattttgaaaaattcgcaaaattttaacccaaaattagtgccaattttgaaattaaatgtgcaaaaaatgtaatcccagaaaaggaaacggttgaacgcgatcacacacggcgaagtcatcaaagaaatgatcaaacgcattctgtgggaggcggtccatctgcggaaattcatctttttggacattccgttgctttacgagaccaaaatggaccgatttgtgcagaaaacaattgtcgtggcatggtaaacagaattttcacaagcttcagcaactttaagtgccccctttttttcgaaaaaacgattttcaaaatgtaatttttagtaattaaaaatcggaaattttaccacccatttccaatcgttacggcattgtaaaaacaaacagtttttttcccaaatttttgatttttgaaaattacaaaaaatatccaacttctaagatttgatgacccacaaaagatgagacttttctttaaaagatgggataatttcttacggttttcccaaagttttttgggattagagtggacatccgctgaagaaaatttgaatttttttaatcaaattttgttttaaaattggaaatttttcaggaattcctctcatacttttttcaatgcaaattttcacaaaaaatttgatttccaaatttgattttaattttaaaaaaactcggagattttaacattaatttttctcaaattcttgtgttatgacaatttttttccccattcccttcaaaaaaagggattgccaataaaaataaataagccaaaattaagcaatgacgacactcagttgtggcgcgtggcgttgcgcgacgaattggccaccgacgaagcggagaaacggatcagagcacaaatgccaatggaagaaaaggcacggaaagcctcatttgtcattgacaacaatggtaaattttgcggcttttttcttaaatccgatatttatccagatttcttggccacggtcaatagcactcataattttttttatttattttttatttaaaacaacaaattttaaagacgaatttttgctagaaagactttgaaaaatttgttaatttttcatttttttttcgtttaaatttcaaaaaagtgtgtacgaattgccaaataataatgacaccctttggcgccaaaactgtaaaattattgttttacgtaataattgaagcacatttttaaggcagtcttgaggaaacggagcaacaattggatgccgttgtcgaactgcttgagtccagctggttgctcccttttgttgtccgtttcgcctttctttcccccatttttgtattacttttgtacatttttggctaatgtttttttttgatgccttacaattttagttaagcattattattgttgttattatgctgtattaattactctctctctctctgttacataaatttatcaaaattttcgaacaaaaaaaaacaatattataattcattcgttttccttcccttttttggcctatcccaccacttttgttgtctgcgcttccttttgcccttctcctccgtcttggcctttgtttcccgacggatttctcggcccttttggtttgaattgtcctggccttcctctaaaattgtttgtgcatttccaacaaaaaaaaacatgaaaatttctatgacggttctgatttggcttggatgcgctttcaggcccatatgcagaaaaatattcgggaacggcacccaagagctttttttttttgctcttcgggccaaaaaaattttttttttaccaatgttatttttcaaaattttcagcgcaggggcgaaaaagtagcatttttagcggttttgcgccaaaaacgacaagcttttgccgtttaggggcaaattttcaaaaa

SEQ ID NO: 29468 - DNA, 789 bp, Heterodera glycines
tacattataactttattttcaaagcaattacataaaattatcattcagattttttgaaattttataacaaaatttttgaaaaaaaatttatattgcctaacgaaagtgtacaaagatatttatctatcaaaattaatttaacattgttttttgcattttggaaatcgatatggcaaatcagtgattcacagatctagtaataatattagctgaaaaatatcactgtttatttgaataatatttagaatttattttatttttttatttataaatattttattcagagaattgcatttgtgcttattttgaaggaccatacctttaaaatttaaaatgtccttatttctaagtttcactcttcttttggctgcttattttgtgctcatttcttcgattttgtttttcccgtaaaatttataaaattgccttatttggtgcgattttcgagttcacagcagggctggagcgcgcacagaaaaaaaccgcggccgcgcatcgcgcatcgcgcattcaaattgccgcggccgcgaccgcgcatcgcgcaaaaaaaaaaaccgcggccgcgcaccgcgcatcgcgcattcaaattgccgcggccgcggaccgcgcatttaaaaacaaaattttcaaaaatttcaatttaatcaataaaattttcccaagtgaaagtttttttgaaaaaaaatttgaaaatttgactgcactttgttacgaaaattgcctatattaaaatatgtactcattgggggaggcattcgaagaatttttccatatatagaaatttttttt

SEQ ID NO: 29469 - DNA, 287 bp, Heterodera glycines
tgttactagatcggggatcgatccccgggcggccgctcgagcaggacctgcagcagctagcttgatggggatcagattgtcgtttcccgccttcagtttaaactatcaagagagggaggagagggttggagaaggaaaggaaaaaaaatgaaggaggagaaagggtgggtggcggaagaagaaaagggtggggggagtatgagtatgatggtcaatatggagaaaaagaaagagtaattaccaatttttttcaattcaaaaatgtagatgtccgcagcgttattata

SEQ ID NO: 29470 - DNA, 908 bp, Heterodera glycines
ctcaagccgaagcccgtgctgtctggccatcgtgcgcatgttttccagcttggccgactcggtcaacgaaaagggccacggtttgtcgggaaattcggcggacactgacgcagcagccgcaacagccatctgaaaaatggggacccaaattaagcgaagttaaatcattttaaagtcgctgaaattccgtccgatttcactcgccacgacggaatgaatcgccgggcagcaaaatcgattaatttatgtgcatcactcgcctccgtcagtgctctttgctcggccatcattcgcaactgtttgggcggtttatggggcgaggagccgccgccgccctttccgccggacgcacttttgtcgccgctgtgcattttgtggccgttgataattggcaacggcgtcgccttgcgccgtgccaacgggcccaacaagtcgtactcaattttccgtctgaaaataaatggttggtcaaatgcgcaacggcacttttgctggactgtcaaatttgtgccccccaccgattgattgtttcgacgacacccaactttttttttacgtgttatatgtatatgaactgtctaacttctcgctgtctgcactcctacataaatacaacaacaacaacaaaaaagtgttggctttttaccgattgttctgggggtgtgcgttggtttcaactcggtataaatcccgagtttccctctccccccccccatttggctgtgcgcttcactcgcctgcccgagtgatcatgtgtgccgcattcgtacagttcgatgagtccgctgtccgcgtgttggaacgaaaacatttggaagccgcactttgtccgtttccacgtgttgcaccggtagcgcaccttcaccccattcttcagctgctcagtgcgtcgtttggacactttctct

SEQ ID NO: 29471 - DNA, 491 bp, Heterodera glycines
  misc_feature (467)..(468): n is a, c, g, or t
tttttagtgctaaagtcatttataaataaatgttcagagaagtgttttttgttcctctcatataataaaataatgcaaaaatatataaaaattcaaataaattgttcgaatttgaattttagaaattttcttatgaaatttttacttttctttttggacaaagcgaaaggaccgacgaaaatggcactgccgaggccccaccatccccaaatggcactgacgatttttttaatttatttttacattgaaaatccacgcactaccagccaacatttattaacgtgtcactatgtgtaagcataaattgccaataaatataaagccatatttccgtttgtttccctaatatggtattagttgccttaagaaaatattaacaaaatttaatagacaaacggaagcaataaaaattaataattaaattaattaaacgcgtttaaaagcataaattaattttattgccattnntcctttcaagcgaacatttattt

SEQ ID NO: 29472 - DNA, 1249 bp, Heterodera glycines
tataatttcatgaaataagacactaaatgtatagagaatgaattaacgtggtcgattggaataatgaaaaaaaaagcaaagtcaaaacacaaaaccttaaagcactagccgattgaaataaatggaaaaaaaagcaaagtcaaagacaaaaccttaaagcactagccgattgaaataaatggacaaaaaagcaaagtcaaagacaaaaccttaaagcactagccgattgaaataaatggaaaaaaagcaaagtcaaagacaaaaccttaaagcactagccgaagcaaagtcaaagacaaaaccttaaagcactagccgattgaaataaatggaaaaaaaagcaaagtcaaagacaaaaccttaaagcactagccgaagcaaagtcaaagacaaaaccttaaagcactagccgattgaaataaatggaaaaaaaagcaaagtcaaaacacaaaaccttaaagcactagccgattgaaataaatggacaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaataggaactttatacaaatttaaaaaagtaatattttgtatattgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaaacacaaaaccttaaagcactagccgattgaaataaatggaaaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaaacacaaaaccttaaagcactagccgattgaaataaatggaaaaaaaagcaaagtcaaaacacaaaaccctaaagcactagccgattgaaataaatggaaaaaaaagcaaagtcaagaacttattctacctaatttcatggtgactgacgaggcatttgactcccttaagagagcattcccttctcatgtacttgtacctaaaatgttgttggcaca

SEQ ID NO: 29473 - DNA, 1433 bp, Heterodera glycines
tcatctttccaccgggatttttggggtcactgatccgtgataatgacccccccccctccccgaaaaatgtgttacacggtttcaactcagaattctttttcaataactgatttctccacaattaaggcagatactgaacatcccgctgctgctgctgttgtggacaactttgagacgctcactctccgcttcttcgacctgatcaacgatggcaacatccaacaattgcgtgtgctgatcgattcgctggatgccgacgagctgaacattttgctgtggtggacggttgatccagtggagcgcgacaacacccgatcacgatcagctctttggactgccttcttacgccaacacatccaaattgttgatctcttggtagtgaatgaacaattttatccgtcggcactaatttttgtatgtcattttcagttggagaagggcgccgatccggatgagccagtggctgaccaagtgaacaacataaacacgagtgagtgggtgtggtgttgatgatgatgaaatcgtttttacaatgcatctaatttggtccctggatttggctcggaattggtcgaaacggataccggaaaataattatatttttgctttccctgaaaataatggtgtttccccatttgtgcagatatgacgcctcttttccttgctgtccgccatgccaatttgccgctgtgccgtgtgctggtcgcgcgtggtgccaacattgacttgggcacggactttgccacaacgccgctgatgcacgcttgcaaaagatcgcaaacggaaattggtagagagacgaaattttgaaaaaatgcgtaatttttccccgtcttttttccccccacagtcacatttcttgtcgagaatggtgccaacatcaatctgcagaatggtgatggggcaacagcactgatgtacgcgtgttacacgggaaatgtagggaaaaatttccattggtgaaatgttttcctacatttttccatttgaattcaggtggacattgtgcgcttgttgctgacacatggtgcaaatgtcgagcaaatggatttcgaaggtgggggattactgttacagtacccaaaaataccatgccacaaattttgtctctaattttcaggatactttccgcttattgacgcagccgttggcggcagtttggaggtgtgccgtctgctggtggaagagtgggccgcagatgtcaaccaacaaaccatccaagagcgatacactccagtgatttgcgctgccagtaaaggacatttggccatcggtgggagagaattgtggcaaagtgccaaaaatgtaatctccctaattttcagtgaatttcctcgtcgaacatggcgccgaccttcaacatgttgacgtggacggacacaatgctttgatgtaggcagtgaagtttgggaagattgaaatggcgcggcatt

SEQ ID NO: 29474 - DNA, 1952 bp, Heterodera glycines
  misc_feature (11)..(11): n is a, c, g, or t
  misc_feature (135)..(135): n is a, c, g, or t
  misc_feature (163)..(163): n is a, c, g, or t
  misc_feature (182)..(182): n is a, c, g, or t
  misc_feature (1751)..(1751): n is a, c, g, or t
  misc_feature (1861)..(1861): n is a, c, g, or t
  misc_feature (1885)..(1885): n is a, c, g, or t
tgtaaaaaacngataccggtactgtatgcattaaatgtacgattacttatttctcccaaaaatgttaaaaatgatcacggaggcgaaaaatacgaaatttgataatatatttaatgatttaaatgtttacaattnaatgcaattttttaatgcaatgctattntgcaaaatgttctgatttntggccccaaaatctgatattttttttggggctcgatgttctgttttgaaaatttttctaaccgcaccctgcgcgtacccccccccccccctctggtaccatctttggtcaaagctcaaaaatttttgaaattttccaacctatagtataccactcgatagagcttcaatagctctaaaattttgttcagattgatctttcgctttttctgtaataaaatggtttattgcttttttgggtcttcggtttttcgggtttttaaccgaaaccgaccgaccgagaaatttttgagtttttcggtttcggtttttaaccgaaactgaccgaccgaccctcttgtccggtctctaattttcaaatgatgcaaaaccaatggaaaagtatccggacaaatacatcaagtcagagcaggtcgtccccccccgtgtcgtttcctcccagaaaaataaaaatttgaaacctagaaatcttaaaaaaaattcttaggaattttttcataagaaatttcaaaaatttctttttttttgaaaaatattcagcgattttttctaaataataaattttttttacaaatttttcaaaaaaaaaatagctgaaaaatcaaggaaataagcggaagaaagagagctcagctgcaacagtgctgttccgggtcacccgaatcctgacatttttcttttcagaacaatcatgagctgcaattttatcatctttttgctgatttcatggaatcaatgatgcttttttgagatgatggatgatttgctgatttttaagaaaatttgctaattttttgaaaaaatcaacaaaaaatagaaattttttttctaatattttagcattaaaataaaaaagagtatcaaacaagacaaaaaaaaaaattgacggaattttctcttttttactaacaatttaaaaaaaacaaaatgttgctcaatatcgcaaattttttttggacaaaattgacgaactttaaacacccgccccctttttcgggcccgcattttatgttccgggtttcctccattcgtccaatcaaatcacccacacccacccgttcaaattcaaaaagacgtccggtgaaaaaacaataaaaattatttaaatttgtatgtcgtgtcttatcgaaaaaactgaaatcaagaaattctttttaaaatgtagggaaagaaatccagaaatgtgagtgctcaatttcagcacagtcaatgaaaatcaatcagaatccgaattcggattcagaagtttacagttttagagtaacaaaggacaaacagaaaaggtgacaatttttggtttagaaattatagcaaattaataagaagaataataaagtggaatgggcgggccaatttgactccttaaataaggatttttaaatgaaatacctatgcaaatttgtcatgcaatttcaaatttattttggcgttttgttttatagaattgaaaattacgaaaggcggagggttattcttcaatttgatgcttttgcaaaagttttgttagttttccgatttcacataggcatttgtttaactcgttttccttcacaaaaccccttaacttttanaattttacttatctaattttgtccaaataaatgtcataaaatgtgccactttcatatgcctacataattcttttttaaaaatacttgaaaaatttaacttttttcacganaaagtaccgaattttctggtgctntttactcatgtccccatctttttctctttgtaaaatttattttttttatgaatctttgaaggaaaaa

SEQ ID NO: 29475 - DNA, 1009 bp, Heterodera glycines
aaacaaaaaagaaaaaaaaattttttttttttttttttggtgagttcttaaactggaaagccccaaattaaacccaattgttcaaaaagaaagagccaatttgataatggaaatccctttcttttcttcggtatattcgtttgtttttttgttcattttccctttcgattttttccgcttttccctcattttttgccattttctttcgtccgttgtcccaactgatagcccaaagaatggcgccgttttttgctttgcattcgaatggcacaaaaaaggacgagcagaatcaaagccaacagcaaaaggagaaggaaaagcaaccaaaaccaacgaatttcggattggcgtaatgcctaaaagtgccaaagttggaaaatattcgaattccaaaggcacccacttccgggaacaatggccaaaagttggtgtcccaccaaccgccggcttctctttctttgatctgttccactcgaaaggacggggcaccaagtcgtctaccgtactcgtccagcatgtacagtaagcctccggtgtaatcgcttcgagagaaaaattgcgcttctgacaaattaaaagtgcaaaaattttgcaataatttaatcggtgtaattaattagtgttatccatgattttaatttgatttaataagtggaaattgaaattttcttattatgctttacgcgctgtctgcgacacgttcaaaatgaattgggcgtccaatttcgtcgctgcccatccgcccgtactcgtgcgaatcggaaaaaatgacggaaaattacgcaaccgattgaacaattaattcaattggagcaccgtttaccgaactgtcgttgatgggcaacacaatgagcacgtcgtccgcgcattggacccgctggagccgatttcgcaattcgttggccgaaaatggcgggcaaaatgggcgcccgctaatcgaattttttgcaatatttaaatatgggttagacagaggcttcttttaatcccgaatcctatgacacctatt

SEQ ID NO: 29476 - DNA, 1365 bp, Heterodera glycines
  misc_feature (13)..(13): n is a, c, g, or t
  misc_feature (24)..(24): n is a, c, g, or t
ctgcatgcctatncggcaccaccngggcccacatatatcatatttttaaaaaaattttaaccaaaaatggcaattatttgtcattttggcgcaaaaccactacaaattctggttgttttgctcctgcgctgaaatttttgaaaaataaactggtgaaaaatttatgacccgaagagtgaaaaaaagtcttctggttcccccaccccgctccgaaattttttttctgcctacgggcctgcaaatatgtgataaaaatccgaaaagtgcgaaattctggaaactgacgacaaatgcaaaaaaagtcaaaaacaggtcatttttaaaaatgcttaaattgatattaaaaatcttttttgttaatcagggacagataatcttttgcttaaatttaagctttgatcttaattgatgaaattttggattgttactattttggatgggtaggacttagtatttgataaaagaaagattacagtcatagctagggatgccaattttatgtacatatatattttttcctggcttctccatgctctaaatagtaggaaaaacactttcttttttgtgtttgcgaacaaaaattgggacttttatttacatatttttacatatttcgagattttatacatatttggtacatattttggactttttcggactttttcatacattttttttacatattttaaggattttttacagaaattttcggaaattctcaaaaacaaaaaaatccaaaatttcggcaaatttttcgtacatattttcataattttattacatattttgagaatttttgaaaatttataaaatttctagtgaaaaataaaaattaaccaaactaatttttaaaatactaaaatgtgattctaggcctatttaggtcatttttatggcatttagggattttttttacatatttatctacatattttgaccactttttgtacatattgtatttttgacatccctagtcatagctggctggcattacggtgtttttcctttgactttttttttcaaatttttaaggcccgttggcattgtgtcagtcttctcaatgtgcttctttttgttcgcgttcagcgccatggagcttaatgagcatttgtcatttgaacggtacgcgctcaaccagctgttgttcacctacggcaaaacgttgggcttttgcaatgtgtgttcaaaaaaacaacagaaacaaattaaaaataagaagaccaatataacaatttaaatgtattggaagtgccatatttatatacattttcaattatagccaattttggatcttttcataataattatttaaaattgttgtatgaaaaagtttaaaaaattgaatttataaattagttttcgtga

SEQ ID NO: 29477 - DNA, 949 bp, Heterodera glycines
  misc_feature (780)..(780): n is a, c, g, or t
aaaaggccatggggacgcatttaagttctttgggacgcataaaaaaaaggccatgggacgcataaaagttctttgggacgcataaaaaaaaggccatgggacgcataaaaggccatgggacgcataaaagttctttgggacgcataaaaaaaaggccatgggacgcataaaagttctttgggacgcataaaaaaaaggccatgggacgcataaaagttctttgggacgcataaaaaaaaggccatgggacgcataaaagttctttgggacgcataaaaaaaaggccatgggacgcataaaaggccatgggacgcataaaagttctttgggacgcataaaaaaaaggccatgggacgcataaaagttctttgggacgcataaaaaaaaggccatgggacgcataaaagttctttgggacgcataaaaggccatgggacgcataaaagttctttgggacgcataaaaaaaaggccatgggacgcataaaagttctttgggacgcataaaaaaaaggccatgggacgcataaaagttctttgggacgcataaaaaaaaggccatgggacgcataaaagttctttgggacgcataaaaaaaaggccatgggacgcataaaaggccatgggacgcataaaagttctttgggacgcataaaaaaaaggccatgggacgcataaaagttctttgggacgcataaaaaaaaggccatgggacgcataaaaggccatgggacgcataaaagttctttgggacgcataaaaaaaaggccatgggacgcantaaaggccatgggacgcataaaaagtctttgggacgcataaaaaaaaggccatgggacgcataaaaggccatggggacgcataaaagttctttgggacgcataaaaaaaaggcatgggacgcataaaagtcctttgcgacgcataaaaaaaagccatgggacgcataaa

SEQ ID NO: 29478 - DNA, 925 bp, Heterodera glycines
agtgagtggggattggcataggacaaatggacaatgaaatgagtaagtggattggcaagggacaaatggacaaagacagtgagtaagtgggattggcataggacaaatggacaagaaaagtgagtaagtgggattggcaagggccaaatggacaaagacagtgagtaagtgggattgggcaagggacaaatggcaaaagacagtgagtgagtgggattggcaagggacaaatggcataggacaaatggacaaagacagtgagtgggtgggattggcaagggacaaatggcataggacaaatggacaaagacagtgagtgagtgggattggcaagggacaaatggacaaagacagtgagtgagtgggattggcaagggacaaatggcataggacaaatggacaaagacagtgagtgagtgggattggcaagggacaaatggacaaagacagtgaatgagtgggattggcaagggacaaatggcataggacaaatggacaaagacagtgagtgattgggattggcaagggacaaatggacaaagacagtgagtgaatgggattggcaagggacaaatggacaatgaaagtgagtaagtgggattggcaagggacaaatggacaaagacagtgagtgagtgggattggcaagggacaaatggacaaagacagtgagtgagtgggattggcaagggacaaatggacagagacagtgagtgagtgggattggaaagggacaaatggacaaagacagtgagtgagtgggattggaaagggacaaatggacaaagacagtgaagtgagtgggattggcaagggacaaatggacaaagacagtgagtgagtgagattggctaaggacaaatggacaaagacagtgagtgagtgggattggaaaagggacaaatgtacaaagacagtgagtgag

SEQ ID NO: 29479 - DNA, 1081 bp, Heterodera glycines
  misc_feature (1024)..(1024): n is a, c, g, or t
acatacgatgtcctgtaagagccgttgtcaccaatgtgaaaaagttactaatttaatccaacaaattaatttgatatttcctacagttggaccgcaatatccttgcataagagtgcaaggtgtctgtctacactgtcaacaatgcaaacgatttttcttctctcaagctgctttgatggtcatcgtccgcagatgtgcaacttgattaaacgttgcgatgaatgtaacagaacttttcaagtggatagaaaaaatccccacaaatgttacagcaactattgtgcgcgatgcaaggtattttttctctatttatttattaataactcctccaaaaaacacaggtataccatgagaaggaaggcgcgtgcttcatcaaacccattgtggtgcctgacgaaaagccaaaataccgtatggtctgctgggacacagagacccgattggagcaactgcaacaggcgggacaacagcgacacaaggtcaactacctgtcagcacgaattacctgtacggagtgctgtgattctgaaaatggtatgcgactcaattgtaaaatttgtttgacaacctacggagcgatggaacgaacaaaggattggagcgaatcggaaggacatgagccaatttcggcatttgtcgagtggattttgaaggcttgggacaacaaataccaaacatttatttgggtgagtttgtgatcgtttttaacatctttgttatgcaaaaataattataggcacacaatgcctcgaggtttgatggccattttgtgctaaaatacctcggcgagacaaagcgacgacctgaggtcatcatgaatggcctcaaaatttttgagtttcgtcttcaacattctcggcgccactcaaaactcacatggcgagactcgtgcctactgatgccaattcgtctggaagaaatgccgaaaacattcaatctcaactgtgccgataaaccattcttcccctacgctttcaaccgaaggttagtatgcccaaatgagggtaaatttaattattatatnttctagagaaaattacacgtgcatcttcacatttgcgggacaaggaggattactgcc

SEQ ID NO: 29480 - DNA, 1803 bp, Heterodera glycines
aaaaaaatagtttcattactcattttttacgaaaccaattttgtatttgatctttctttatacttgaaaaactttctattgaaatataacatttataaatcacgggggattagcaggacaaaacatcgtcgaccgaaacgtagtcgaatgaatttttggaccatttcttttttctttctcaaccaaattaaacattcttgctgttattcgaaagaatttgaaaaacgctattaaattgcaaattttcaaaaattttattcatacgggtaaaatttgattgacaatgaacaaagtattggttcaataagtctgcaccgttcacggggtggggggtgagaccaaaaatcctgtcctgcccacgttcccctggacgggggcggggagatttcgaaccctagttctaacaactgcgaaattattgacaattttcaagaaagaatttattgaacgaaaattattatgcttccgtgaaagatgatgctgaggctatttaatatctgagtgtaatctgtttttatcaattattttatttattgcttttgtttgatattttttatgttttaagcttctcattactcaaaaccaaaacacttgcgaaatcaaatgatttcttttgtattcgtatttagttttctttattggagctccagttaactgtttcggtcctccggtttaaatttgtttataagtttaataattaaaaataaatgtttttatatgtataatatagaattatttttaataatttttctgccatcattcatttatttaaattaacttattttcatgtgcggattaaagcattgccaattccgataaattaattacatagtgattaatttagaagccattattattttagggatttttttcagaaaaagtgttttcttttaaatatcatattcattaaacaatgaattaagttaagatttatatttatatcaatttgtcttataattacttttaagcatttattttttcttgtcaatttcatttcattagttgttttgttctaattttcgattttaccatttaataaattttgaatattttaaaacactattttatttttacaatttttatattataaattttatatgcctttttgaattctttataaacatctttttaatttcagtatcgtgaggatggaaattagtttcaatcaaaaaatcacacgtgtatttagtcacaaaacacataattcgcattgagttctattataatttctcgaacctcttgcctctcacctattagtactcatcaagtgattttctgtataagtcatcgagagtacgcattcataaaattgtggaggactttcatccgctttgcggcctcaggacggacgcctagcccccgttttcaaactttgtagggaaattaggacgcttcgcggcctcaggacgggcgcttcgcgcccgttttttaatttttttgggggatattcggccgcttcgcggcctcaggacgggcgcttcccgttttttaattttgtggggaacattcggccgcttcgcggccttaggacgtgcgcttcgcgcccgtttttaaattttttaagggacattcgaccgcttcgcggcctcaggacgggcgcttcgcgcccgttttcaaactttgtagggaaattaggacgcttcgcggcatcaggacgtgcgcttcgcgcccgttttttaattttttaagggacattcgaccgcttcgctgcctcaggacgggcgcttcgcgcccatttttagactttgtggggccaaacgggcgcttcgcgcccgttttgtaatttttttggggacattcggc

SEQ ID NO: 29481 - DNA, 1045 bp, Heterodera glycines
aaaaaatcgatttatttttgttttcggggcagtcacgccgaaccgatgcgcccagatttatggggagaccgaatccttcgggaatagcttccctatagcctgtactttaattctgcgttggatttttgctccccataattgtttgagtaccccaaacgggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattctagcactctgatgctttagtatcaaaaaggaagatggagaaaaaaattttaaaaaatttttccttatattttggttatatcgttttgcttttggtggggtgcttggaacagtggaatcatgcgcacccgtccgatctggc

SEQ ID NO: 29482 - DNA, 1032 bp, Heterodera glycines
  misc_feature (937)..(937): n is a, c, g, or t
  misc_feature (942)..(942): n is a, c, g, or t
  misc_feature (960)..(960): n is a, c, g, or t
  misc_feature (973)..(973): n is a, c, g, or t
  misc_feature (1018)..(1018): n is a, c, g, or t
aaacttaggagatttatggggtagagaaacctacgtgacatgaactaatattattaaaattggttatgggaaaaattattgttagatagtttcttaattttaccactatggacgttaaattaaaaatctaaactaaatgtctcacgtataaaaataattttgttttagccctttccccaaatggccggcctattcattcattgtttgctttgcttttctgtggctatttcaatgggttggacggacggacatgtgtaagctttatattgacctcgtgttaagaatgaataatgctgacgggggaacaaaaaaaagccgaaaagatacgacaaaatattttatttgccccgcggggagggcggcacatttttcgcgggcggcggaaaagcgttggcaattcaattggtaattttgtcgcccgaggggttttaagctgcttcctgttgttgatgtatacacacacatataaatgtacattcagcagaaagagaaatgtaattcaaaagttccatcccatccgcggtttgttgaaagcgaaatttgacacattgaacagcgaacatcacaagtcgcgttaatgtgtggggatgtccggaaaatggatcagcggataatccgtcaataaaattctttttttattattaaaaatgcgagatattgcaaggaagaagctgactgagtggttaaaaagcggaaagcggtgggttgataagatcccaaagaaaaagccggaagtgcatcattagctcaatggtagagttacgcaaggatttggtggaggagtgggttcaattcccacccgaggctttacattatatccatttcttagtatattatgaagagaaggactatacttaatagcaggctgtgttaaaaattcttggacactttcagaaaacaaaaaggcaatggcgttgtatgtatagaaaaacgccanatgtnggattaagcgtggactanaaaaaggaataanataaaaaatacaaaataacccatattaacccaaaatatattttanaaaacatattttaa

SEQ ID NO: 29483 - DNA, 1565 bp, Heterodera glycines
aggccgcgaagcggccgagtgagtaccttcggtgcaggaaaattattaaattttaaaaattttttagttgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcaggaatactgaaaggaagagaaataacctattttaaatattatctagtcagttcatttaaataatttttatccaaaaaatttttttttgggttttcggggcagtccccctgaaccgatgcgcccagatttatggggaggccgaatcaagacggaaaaggttccctatagcctgtactgaaattctgcgttggatttttggtcaccataaatgttagagtaccccaaagcaggcacaaagaaaaaatcgattggtttgattcataaatattttgtcagaaagtgctctaaagcactccaactcatacttgccgcttcaacctcagcctttcccttcttcctccccctttcccttcttcctccccctttcccttcttcctccccctttcccttcttcctccccctttcccttcttcctccccctttcccttcttcctccccctttccctcattacccctctctttactcccctttcgcccttttatgtccctattctcccccccccccttcctcctcctttccgccttatttttcccctttcccccgttgcccctctctttctcctcttttcccttcccccccccgttttccctctttttcctttatttttcttttattcttgtgatggcggtcctttgatcaaaatctaacaaataagcgatcggacggtggacttttattggatttgttcgttgatgcgcgaattggcgagagacaacagcaaaagtcgggagggggggggagacagtgattgggccaacagatcgacgaacggctgattggttctgctgatgcgtttatttctcttaaattaattgcccctttttctgtccatttaaaataatgtcaaagcgcaaaaacactttttaatgtcccattaatggtggactattttaatggttttcacttttacttatttatttgttcatgccgttttattttttcttttgaattattttcggatgccatcgatggaacgaaataaaaatggtagcgatttattggcggaaagtggcggaaaaacgagacggaagactaggtcgttgctgggccgttttgtggccaacaaagagcagtcgaatt

SEQ ID NO: 29484 - DNA, 1891 bp, Heterodera glycines
aagatattcaattttttacaaatatttgatttttcatgccatcggtttttttaaatattgcttcgctataaattattctccggatcagaatattattataaagaattcaaatttatcttcatgtttttaattttgataaagaattttcttcatttttttatctgatagatttatttcgctgccggtagcaatttaaaatgtttgttttaatattaaaacatttaattattattataaaattgatgtgcaattaaaaatatatttacatatgattgttttattatttttattttaagcaatttgataaattgtgtttttttatttataattttctatttaattatggttagcatctaattaaagttttctatttaataaatttttttatataagtaattttttgaaagcttaagataaaaaatctttttttaattgaaattatttctaattttcattatttattttatatttccactttttttcctcttttttttaaatcaataaattaatctttatttttttaagcttgttgtttctcaaaatattatttaaatctgatcggctttaaatagtttattattgaaatctttttttttcaattagattatcattaattatatttaaagctttaatcgtagaaaattggatattttttctgatttaaactgtcaagatccaagaaattgtttttgtagctaaaggagcagaaaattttgatataaaaattgttgagaagatttaaaagaaattaaatataaaatgaatttatatgcaatttataaatagaatttaaataactattcttcataggtatctatattttctataggaaattataatttaaaatatcttctttataaatattttattcaaatttaaattattttcttacttttgccataattttacatgtagaaatattaaaagttaattaataaaattatgatcttttctctcactgaaaatgcctagagtttaatttatgagattccatattattgtatttctaaattattctaaaattacattcattgatgattaaatatttttaataccaatattttattatattttataaaaaaaatttcaaaaaattatatttctttataattaatattatttgtttttcttaaaatttttactgaatatttggctattttgtctattggattttttgcatatttttagtattaaattaatttattcattacattttttgttacaaattgtttatcatttaaaaatattatcgctttgttttattaaatattttcgatgatatgacattactcaaaaaaccatcttggaactgtcctaattttgacctcacactattgcagaatttgttttcaaaatattttgacaacaacagggcagttaagttggttttgattaatttatgatgcaacgtttaataaagagttatcatataaaacacttatttgttaaagaaaagtaaagtttagataaatttactgaaaatcaaatgtttataataagaataaataatagttggaaaaagaataagtaaacagaaatggtaaagcagattttcttacataaaaattaataagtaataactggaaattaaatttattaggaggccaaataaagccgaaataatttgcatataaataaatacagattaacttagtaatactcctacgaaacagataaatggtttataattcaccaaattaataagctttttcataaaaaattttgcattaataattaatttattgaatgaaagcaactaaattaaaataattataaatttttcgttaaaatataattttattattcatgcgtaaccataattaaaagctaataaaaaacgcatatgctccatggcaaaattttaaggtttaaatttattttcccggtttaa

SEQ ID NO: 29485 - DNA, 982 bp, Heterodera glycines
  misc_feature (786)..(786): n is a, c, g, or t
  misc_feature (928)..(931): n is a, c, g, or t
gcctcccctctcataactctctctgacctttacacttatataaaataaaaatttcaaaaaactcacaattttcagacacccaatggcattggcagtttcttggcattttgccaagtccttttgttcgtggtgttgccgcgcaagccggaccaacgggcgcccatcctgcgactgatcagttttgtgcgcaactcgtgctgcagttgctgcgccgacaacacgttggacctggagtccgctgcaggtgcaagccttaaaaatttatccttgtattttcaatttcaaggacgtccttaaaaaactcaaaatattaacagcatttttgcgatctaaacgggtttgatttctccttgaaaaaggaagcataaaacctattaaatttagaattaaaaattcgtccttgaatattgaataatggaatttaatttttttcccaaaataatgccaaaaaacaacaaatttttcagtggtgacagcggacaagaagtgcagtgccattgacaccattggcattcatcggatgtccagcagaatgagcaacaaacaccgttggtccagccgcatgatcaccaatgttgtgggcgagatggaaaatgtcatccaaaaagtgcacggagaccagtatggaaataaataattttcaaatttgaattaatttaattaaaatttatttatgccaactgtcctgggtttaattaaacttattaaaattatctaaccttcaaaattcaaaaaaaaaaaaaaagaaaattcaggactcttaaaaatattggttaatttcattgngttcagcgtttaaattcaaatgctaaatttttacggcaacataaaatcctcattttgccacagtttcaataaaaaataaaatattttaaattaaaaaaaaataaaaataaattcatccattcctttatccgctcattttaannnnccatgctaggaagttatctcatttctagactctcgaaaattagttgaattt

SEQ ID NO: 29486 - DNA, 1012 bp, Heterodera glycines
aatacgaaccaatcatcaggcataagaaaacgctcacacaaacaataggcatgacaagatataaacaactactagtttaggtccagcagaagagtgattgagaggaaaggggcactctccaaaaggaaggaacagcgagtaaaagggggttaagggaaatcggaaagggttgcgaggaagtgtcaaaaaatgaagtcctccttcgccatgtcgagagcccagcggaatttgtcgcgttgcgttttgctgaatattttctcaacgggcacgtcattctttttgcaccatgcaaccgaaatcctgaaattttttttggacatagtaaattggaatattcgatagaaccaacctcggatccaagtagttcagttttgaggttcccagtgcaatttgtttgttttcatcctgaaatcaaaaatgaccaatctttgctgttcccgattcgttgatttgaagggtgacttatttccccgaaaaatcaaattccaaatttgttcggaatttttgccaacccttccttccccctgccttgtccgtgcgctgtgtgttcagtttggcgatctgttccttcaatctttcgtatttttttgccattttctcgtccaccgatttgctcttcttcagctgatccttcaactccttgtactcctgcttcttctcttttatctgaattttgcttaggatttgcgtttccgtttcatgtcatattcactttattctccaaattttccatcgacttttcgtgcgtttttggcactgccctttgatggttacaaaggatggccacctgacgatttgcacctgaatttaggcaatataagtgaaatgcctctgaaccagtggctttacgattgtaggaaagcattttctcgtggacggaatcggaagctgaaatttcggaattaatttggcaattaaaaatgagttggatacgatttgtcagtttgtccagctgttcttggagagtgatcgacgcgttatacgtacgaaacactttcgcggtcagtccgtc

SEQ ID NO: 29487 - DNA, 591 bp, Heterodera glycines
tagtatgggctcaaaattctgcgcctcctcgcggtgagtccggaaacagagttaatttttaaaatattaattaattttttttgcaatggaattaactctggctaaagcagacgtaattttgtttaattttgtggcttagaattaaattttataatttttttttgttttattgaaatccccaaatgtcgggtccctaaatgtcgggttgccaaatgtccgtggttttcttaagtgtcttttgctcaaatgtcgttcggtccccaaatgtcgggtccccaaatgtcgggtccccaagttgcaaatcccaaaaagtcgggtagcctatataaccactgtgaaataacattctggcttatggtgctgacagtcagtcttctgtctatgggcggcctttggcctctgaccgcctcattcaatgggatatcaagaaaagcaaaaaggaagcgattccttttttgcctgaaggaaagaaatgaagaaaatcgaatgcgaagaaaaagaaaatcaaataacatttgcatacacagagaaagaatgtgcaaacgggtagagcccaacccaacagccctttctttcgctcacttcccctgg

SEQ ID NO: 29488 - DNA, 954 bp, Heterodera glycines
cgtcctgaggccgcgaagcggccgaatgttgccttcaaaattaataaacgtacgcaaagcgcccgtctgaggccgcgaagcggccaaatgagtccacaatatttagaagcgcaaagcgcccgtctgaggccgcgaagcggccaaatgagtccacaatatttagaagcgcaaagtgcccgtctgaggccgcgaagcggccaaatgagtccaaaatatttagaagcgcaaagcgcccgtctgaggccgcgaagcggcaaaatgagtccacaatatttagaagcgcaaagcgcccgtctgagtccgcgaagcggccaaattaaaccttaaatataaaaagggtgcggagcgccctttgaggccgcgaagcggccgaaagtcctccacaaaattatgaatgcgtcctcgcgatacctatataccaaaatcccttatcacatccataaattcatttcaaaaccgcgcatgcactagcaacgaagtcctttgcgcgaagcgctcatgtcagcgcccgtccatacatataaaaagcatactgcctacacaccgagcaatcactgtgcaaagcatactgtctacaccgagcaattactgcgccacccgctagtccggtggccaactgagtaccagggaccgatttctcacttttgcttgcgtttgaaggcccataactttttttctaaaactctgatcaaaaaatgcccgctgcgagggcaccccgccaaagggtcctctacatgctggtattttttattttattaatagagccaccccctggcctgcagaaaatggcaactgaagcgtgctcaaaaagtacacttcagtaccaggctaataccgcgtcggcgtttgatctgagagaaaagtgcccagcagacttattgtagagttttggaagctcgattttctgaaatttaaaaatttcgaaaattttcaaaatttttcgaagctaggcct

SEQ ID NO: 29489 - DNA, 862 bp, Heterodera glycines
ctaagttcgaataagtgcgttaaaacgcaaaattttcgaacaaaaaatatgtttttcgtgcatttctcgtcgagttaaagccgcagaaaaaataagcaaaaacttaaaaatcctcaccctattgattggatgcgtaaaaaccgattgaacgcgtaaattgcagtataggtagccgaattgttttttcctttatcgatatgcatagtgcaattgtatactcagaaaaaaaatatatttatgatcaaatatattcggttttccctattagcagcagatataaattaattagtacgccaaaatgagggtgtttttctctatttatttgttcgtttttcggatggtgtgtcatgaaaagaaatgcattttattattaaataaatttcataaactgcttctcctctctctctgtctccttcattttgtgctcccatttcgtcattctccgcatggaccgcgggaaggggtggaaggtacaaagtccatcgtcgatgagacgaagtggcgaaggaaatgtgaggggggggggggaagaggaaaaggatgcgcgacgaaaggagaggtcgttaaagtgagaaagaattggcgatattgttgacaaatgtgaagaaaatgctgggaatggatggggatattaaggagccctgcgaaagtgtctgttgccaatacgcattgatctttgctctgcgcatgatcattgatcacttatcagtagggtgtggatttttaggggcgaaaaattccaatttagggacctaaataggggcaaaaaattcgcgaaataggggcgaaggtcgcttcttaagggtgtattttttcttttttattgcattcttgttaataaaattccgaaaaaatcgcgaaa

SEQ ID NO: 29490 - DNA, 1291 bp, Heterodera glycines
tcactaaaagtcgcgaccctattaatcaccgattccaaagattgcaaattgggccaaaactttgaggatcattttgtgtgtggaagatgacagcaatcttctgatcattttagcaaaaaatgaaccaatgattaataagaatcttaaattaatattaaaaatatatgtttttgttttcaagggtttttcaaataaatgacaattttaatggttttctcattaattggttctaattattttgtagtttatgcacttatgagaattaattaaataaattttatccgttaaatcatttaaacgaaaagaacaaaatttaattgagctaatcgttcatcatttaagcggtttgtcgatcataaatgattgtatatcgatcacagtttgtcagtcgattaagccgaatgctttataataaatatggattgattggtgaggaatgctaataacaaaaacgactaatgactaataaatgagtcaacttttacatcgattaaggataaataatgagcttttttataaaaggcattaaacgacggacattttgtggacgagtgaaaagggaacgaaatgatttaatttgttgactataaaaaatgtgtggcggcgatggaatggggcggtgcgattgaactacgcgatgaaattggtgaaatttggatggaaaagaaaataaaattgtcaaagcgtaccaaccccaaaaaatcaaaaattattttatgggggcggccgaaatgcgcgagaagacgaagaaaaaaagaaataaataacctgttgatgggggaagggtgttcattggtgcccgaacatacccatcactcgagaatctcgccgagcacgtaaaatgatttcgccaaaggttttatcacatcagaaaatgcgcaaactcgcgcgtcatttcaaatttcaaggtccaaattgaaaggaaaatagcactgataatgatcaattaagtagttaatcacctaattaactgaacggtggggccatcaaatgaaacgaatgcgtgtattaatgcctttttatgcgaacttttttgtcgaaaacaaattaatttaatttagttgatttaagttattcaatcagtctttataatttaatttctaattgaaattatcaaattaaagtttttatttaaattaaagaaaaatattcggcggaagttcattccactatggcgcacaaaatcagataaagcttacaaaaatatcaactaattttatacattttgaaaaaaaaaatttaaatgcaaaaaataacctaaaacatttaatgaagaatcattaacgatact

SEQ ID NO: 29491 - DNA, 1167 bp, Heterodera glycines
  misc_feature (116)..(116): n is a, c, g, or t
gctttggctgaccataactcgccagagagtggagatagacccttagttgatacatttgaaaatgtagagctcggctagcgcattcgaataacacaaaatttgttttcatttgcccncaaacaatccgcttatgacgcgccgaaagaaaattcacaaaaatttggcaccggaaaaactccatttttttatgggccagcatagtaaagtaaacccaaaatgtaagggaatttaaattggtgatgagagatgtttagttttttatttgccccatcctttttctgggaaaaaaaagctgaaaaattttccaattgcatcagatgcagactcaaattcttcaacaacataatgtaaaaaatattacgcaagaaattatttttacatcctttttagaaatgctgcataaatttttattgtaaatagtcacaaacaaactttttttcactcccaatatctaccatttatcattacaaaaggcaatggttaagcactgagatataaaaaaatcgtctagaataattatctcaacaatttgtcgggaaagatgaataaatttcagttgcaataggcatattggctcaatacataaatgtagagcaggctcaaaatagaggaaataccaagattaaaaaattcgtgtgtatcccccactctgctttggctgaccataactcgccagagagtggagatagaccctttgttgatacatttgaaaatgtagagctcggctagcgcattcgaataacacaaaatttgttttcatttgcccccaaacaatccgcttatgacgcgccgaaagaaaattcacaaaaatttggcaccggaaaaactccatttttttatgggccagcatagtaaagtaaacccaaaatgtaagggaatttaaattggtgatgagagatgtttagttttttatttgccccatcctttttctgggaaaaaaaagctgaaaaattttccaattgcatcagatgcagactcaaattcttcaacaacataatgtaaaaaatattacgcaagaaattatttttacatcctttttagaaatgctgcataaatttttattgtaaatagtcacaaacaaactttttttcactcccaatatctaccatttatcattacaaaaggcaatggttaagcactgagatataaaaaatcgtctagaataat

SEQ ID NO: 29492 - DNA, 915 bp, Heterodera glycines
acagaggaggacgagcagtacgagaagaacctggagaagaacaaagtgcgttgggagggataaaaggaaatttccgcccactaaatgtccctttttcgcattaattggcacctgaagcacgcgcacttcctgctcaattgtgccgatgagttgcaccattgtggcgcggacttgtcgtggaacagtccgttgatggccaacgcgcacaaaatggtggccatgcaaagggccatcgccaggcccaagcgacgctccaaccgcgagaatagtcgctgcagcgccttcggcggggaacagatatattgtggcacgtgttgcgtccaatggcactgaactgaccgactgttcgcgcactgcgcgaactccaccgccacgcaatttgccattgccggaatgaaccgaaagtttgggcaacggaggggcggcggcggaggcaccgctgggacttggcatttcctttggctgcttttgttgttgttccatttgttgtggtcactttttgtggcgatcgtttgcttattattaaaaattggagacaaaaaataagaaaataatgagagaaagggagggagagaaagagagagaatgtgtgaagaagagagaaatggggggagggaatggcgacaaaaacggggaatgaatgctttgcggaaaggcttcgattcgatttcacgcatatcaatgtggcgaaatgctatgatcgcggtgatcggaagcaattgatcagagtgagtgatcagagattaggggagggggagaagcgatggttgggaccgttgccagaaaacaaaaagcggtttatacagatggtctgctgctggctaatggaattgacttccagttttattgcgcattgcatttttgttttaccatttctatacggtagcgaactgactgttacggtaaaagggacaa

SEQ ID NO: 29493 - DNA, 1036 bp, Heterodera glycines
cctccactagttttcgatttccttgatgaaaaaatatagttgtaattctcttttacccaagggcaaaaattgatttcttccccgtctttggtccaagtctcggtaattaaaagaatgtctattttttcggtttctaaaataagtgctatttcatcgattttattcattagtgacctaatgtttattaggcagcatttaacattccctttattttttattaaaaagtttggatgggtaattttttggtataaattttttaccgaccggaaaaatttttgtacttttgtataataattatgggtaatttgtagtgatttggttggataatttaaaaattttttcgaatatggtcaatgtcctgcttcagcacaacctgattggcataaatcacccaatcaccgctgtccgtctgccttttcttcgcacaatcctcaatcaattttcgccactccgacaattgttccttggtcatgctctcgcggacgcggacattatggagaccattcaatgcctgcacctttccgcgcatgcggatgacgtgtcacgctgcgtgtttggtcgggaattccattttgagcgggcgcggtcgtccatccattcgtttgccgacgcggaagacaattggtgcttggtcgacgtccgtggcattcaaaatttcgtccacaacggcacggtcctcccgggctctctccgccgctttgtccgatttgctttcgggcatatttgtcacaacgacagttctcagtcgtcgttcctcctcgaccgcgtcgacagccgcagcctgtgaatgaattaggacggaggcggtgcttaaaagggaatgaagctgcttaataagcaacttggcgtagtcgggaatggagttgtctgagtcgatttctttggggatttgtagttggtcaaggtcggacagaaatttttttggggcagtgttgtcagaaggaggagaaaaattcgccattctgtttgccatcgattaggagaggagatgacaattttgaaggaatgacaattttgaaggaatgacaattttgaa

SEQ ID NO: 29494 - DNA, 1177 bp, Heterodera glycines
ttctcactagagttgagcgggaccgggaattttgacaaaaactgggaccgggacttaccgggaccagaaaagtcgggaccgggaccaagtttttcgaccgggaccacgagaaaagccgggagcgggaccaaccgggacttttcccaagtgaaaatttttttgaaaaaaattgaaaatttaagtgcactttgttacgaaaattgcctatattaaaaaatgtgcccataaaattttctaattttcatttggggggaggaattcgaaaaatttttccattattcgctggaaaatttttaaaaattttcatttcgggggggggggatcttggaattttcggagtcccaaaattctggattttaaattttttaaatacctctttttgtggcactgttttttcaaaagattttggctacattgtgggcgagggtccggcggtgccgataggcgccggaaaattttcgaaatttgagtgaaatatgttaacagaatttgccaaaaaatgaccgatattttggtaaatttgcggttttaggctgtttaagaaagacaaaataataatttttaagttgaaatattttttattaattaaatttaaataaagtaaaaaaaatataaaaaatgttctatcacggtggggaattgaacccaagagacaagtaatgaaggacagaaggtatagccactacaccacataatgatatacgctgctttatccctctttttcgctgctttgtccctctttttcgctgctttatccctctttttcgctgctttgtccctctttttcgctgctttgtccctctttttcgctgctttgtccctctttttcgttgctttgtccctctttttcgctgctttgtccctctttttcgctgctttgtccctctttttcgctgctttgtccctcttttcgctgctttgtaccgctttttcgctgctttgtccctctttttcgctgctttgtccctctttttcgctgctttgtccctctttttcgctgctttgtccctctttttcgctgctttgtccctctttttcgctgctttgtccctctttttcgctgctttgtccctctttttcgctgctttgtccctctttttcgctgctttgtcactctttttcgctgctttgtcccgcttcttcttttaccggtggagacaatggcctaaattaagcg

SEQ ID NO: 29495 - DNA, 778 bp, Heterodera glycines
attattttttgaagtgagtcaacaccctattagtgctttgctgtgccgagaaccggcaggcaatggatagctttcaatctgcaagaaattagattggcaataagtggttgtaaaaaacttttgggtatggaattattttttgaagtgagtcaaacaccctattagtgctttgctgtgccgagaaccggcaggcaatggatagctttaaatctgcaagaaattatattggcaataagtggttgtaaaaaacttttgggtaatgaattattttttgaagtgagtcaaacaccgtattagtgctttgctgtgccgagaaccggcaggcaatggatggctttaatctgcaagaaattagattggcaataagtggttgtaaaaaacttttgggtaaggaattattttttgaagtgagtcaaacaccctattagtgctttgctgtgccgagaaccggcaggcaatggatggctttcaatctgcaagaaattagattggcaatatattgttgtaaaaaacttttgggtatggaattattttttgaagtgagtcaaacaccctattagtgctttgctgtgccgagaaccggcaggcaatggatggctttaaatctgcaagaaattagattggcaataagtggttgtaaaaaacttttgtgtaaggaattattttttgaagtgagtcaaacaccctattagtgctttgctgtgccgagaaccggcaggtaatggatggcttcaatctgcaagaaattagattggcaataaattgttgtaaaaacctt

SEQ ID NO: 29496 - DNA, 1404 bp, Heterodera glycines
  misc_feature (42)..(42): n is a, c, g, or t
gtaaaaatcgtaattacgctcaaaaagcttctcaaacaattntagcgcttccaattccttctacaatcgcctttatacatcccattatgaacgctaaaattatcagagtgccgaaaatcgcgtgtgatctacgcctagaaaaaaatggtgtaagtaaaaatcgtaactacgctcaaaaagcttctcaaccaattttagcgcatccaattccttctacaatcgcctttatacatcccattatgaacgctaaaattatcagagtgccgaaaatcgcatttgatctaagcctagaaaaaatggtctaagtaaaaatcgtaattacgctcaaaaagcttctcaatcaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagaaaaaaatggtcaagtaaaaatatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttagcgcatccaattcattctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaaaaaatggtgtaagtaaaaatcgtaactacgctcaaaaagcttctcaaccaattttagcgcatccaattccttctacaatagcctttatacatcccattatgagcgctaaaattatcaga

SEQ ID NO: 29497 - DNA, 1955 bp, Heterodera glycines
  misc_feature (17)..(17): n is a, c, g, or t
aataaaggtttgtaaanttctttaaaatacaatgggaacttaaaaatggggatttttgagtttttaagaccaggcaaccaaataaagtaggagctagcaaatcctggtaaattctttgaacaagtctaataataaaaaataggtaatttactaattagaattttaaattccaaccataggagaatttgtcaatggaaaccagagaaaatacattaggtaattaaattttaaaaatcgacacccggtagatgactcactcagctgcaatttttgctcataagtcaaatcgccagccggcaagttgggatttgtgtaatctctgctcttgtcattgttccatctgttaaggatgaaaaatggctttttaagaaaaaatgggcataattaatgggttacttacttgacattcaaagtgttcagctttgaatattcaatgtgcaactaaaaattttgtaataaaaatgataaatatttttaaaataaaaaagagagtttaatttattataattatttgattccttccgagtcaaaaaataattaaataatttatttgctttcaatatatatgttaataaaaatttcagtttaatcgggattataaatttaatttattttaataaaaatataacaattatttattttcacgaaaaaatcatttatgtaagaaaaattgaaataattagaaataatgcttaccgtacaacacccgttgtatatattgagaccgtccaatgagtttcctgattttatggaaaacaattagtatattttttagattaaaaattaagcaacgcacttgcattctgtgctgagcttgcttcactgagctgaattaatgcttggaataaatctaaaaagaatagataatttaaaataatttatataaaaataaaaatttattttattttttactgtttttattgaatgtgataatgcgtagaacttttccgtagcgagaaaaaattaggaacaaagcatccaatgtgacacttaaaatgaagaaattttaaaaaattaaaataattttaataaaaaaataaaaatttacgggtaaagcatgtaatcgatgattatgcgctgaaatgggaacaaaatggcgtaatatgaatattatttaaaaggaccaaaattgagttgggctgtgcctgaacacccgccgacaaatcttgataactttgggagaggcttgacccatcgaaacattgcaatgccacggcaccattagagtcgaactaaaaataaagtcatttattttaatttaatatgtaaaaagatgtagctataagtttcaatgatattttttgagcccgcttcatacaataaaattggcacattacatttttgggggattgttcactgtgtttatgaggcccgccgtttaatagaaatgtataaaacgaaattatttaaatatttaattccgaaattcaacaaaaaaaaatcattgcccctgagcagtcccatattaactttgagctgaaacgttaaacacctgctgctgctgttgatgatgaagatgaggttcagcaaatctgagaaaatcagtgccgcacaattcttttggggccaaagcagtggtgccattgccgttgctgctgccatggccaacaccatttgtacttggcgtggtagtgccgttggtgctcagcagctcagttgccgttggggtcacctccaatgcggttgtgacatggttttgctgtgctgcacataacggcgcggacaatgccatttgctggtgaagcttttgcgtgcctgagttgttgcagttggtttcaggcgttgcagcagttgcagcggcaacgagtgcagcagcggaagaaggtgcgtaattgagctgaatttttctttaattaattaaatttcttgtaaaaaaaattattaaaattgtaccgatgtgttcaccgggatgagggtgggtgccagagcggaaaaagacgggcaaagcgtatcct

SEQ ID NO: 29498 - DNA, 1486 bp, Heterodera glycines
ttgattggctcttataggcaggtcttggttgaaatttgggcgttgctgtccttggtgaaactcaaatccttcgtcctggtaactgttgtgtctctgtgcataggcatgtggcggaggaatccgccaacgtgtggttgttggccttcaacaaccggttgctgtgtgagccttatctgctgttctctctgccgctcaaaattaaccggtgcgttttcgtacaattggccattgggtcgaggacaagcaattggattgaccgcttgtggatgatttaatgcagggaaattttgcccgacttgattcggcatttgattttgcatgaaattcataaccctaatttggttttcgatgacgctcaaattttccgggagttgcattcttaggtctcgctgcagggcgcttaggttttgttcgttaagcggtgttgaaaaggctcgcaatccatgcgcgtccaatgcatcgtttccaaaactccctctatccccagcttcaactccattttccaaattttgttggaccataccgttgacattttgttcgtcgccgttttccatttcgtcgtactccaattgttcctcaggtgcgctttgttccattcctccgtaaagcaggcgacgacgaatatcagtctctgctaaaacattttcatgattgtcgtccagtcgctgattttcgttgttcgctaagggcgagatcggcctgccccccgaaactccaaaattttcagccctaaatgcgtttccatcgcggtcaacaatgattccctggttgagtgccctcgtccgggttagtggtggcgttcggagaacaggcattttgtttgagctaccgcagaggtactactcaacaaaacaaaaacaaagttaaacggcgatcctcgaaaaacggcccgatttgtcggtgatttgtcgatgtccacacttatcgcaacaatgcgttatttgtgggacacaaattcaactcgaagaaaaagcgcaacaatgcgttatttattcagaatcgcagctatgcgtttttctgaaatgtcccttgctcctcgtcctcactttgttgctttattgcccctggcagacaggcaagcaataaacggcgagataacgaaccccggcaaacgggctattcgctttgatgaacaactaagtaaagctccgacagacggactacttcacttttgttgaattcccgtgaaccacaaatttctcccttccaattttgttcccgagcttgccctttttcgaaaaaccaaaaattcccggcaccgcttactcagttgaccaggagcgccacgtgcaaaatctggagtccaattggtcagaggggctcgtctcttttgctttgcttcgttcggcttttcctcttctcgggccaaataattaattagcacagaaaggacaaacggggccaatgcttattaattaaggacggcgaaatagtccggggacagttcaatttattttatttaaattcatggcgagacgacgaaaat

SEQ ID NO: 29499 - DNA, 985 bp, Heterodera glycines
agagaggcgaggaaaaataaaggttgcatccaaatgtaatttttttttacattgaagcatttggatggcttgctgtttacagttggctaagtcttctttgcaagaagcagcacaacttttgtttgggccaacgaccccaaaccattcgaatagcaatcgattgggctgactagactccatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtccccgaatctgcgaggaactacttttttgagaatttctatagattattattttgcatgaatccttcgcttaaattcccatttatcttataaagtcagattaaattaattaccccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggcttagtcttctttgcaagaagcagcacaacttttgtttgggccaacgaccccaaaccattcgaatagcaatcgattgggctgactagactccatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagttttatagaaacggtccccgaatctgcgaggaactacttttttgagaatttctatagattattattttgcatgaatccttcgcttaaattcccatttatcttataaagtcagattaaattaa

SEQ ID NO: 29500 - DNA, 1248 bp, Heterodera glycines
aaaatcccttaatgcaggctgtcattcgtccttttcacgttcgtttaggagttttttgttcacttgtcgtttaaccgaaacgaaggcgaaaaccgacgatccgaaatgtttacttttcgaaaattattttttgtaggaaaatatcaaaataaatttcttttgctattgatgagacttgtcgtgtggtgcagtgattagtgtttctcttttatcttttcaaaaagagctcaattttaattctaattttaaaagttattttatttatttttaaaaaaataatccgttaaagaaatttagtaaaattcaaaatttatgaaaattcgggacagaaaccccctaaaaatcagcattaaattgcttaataatagtgaaaaatttttaaatttgtgcttttttcttaagaaaatgtgcaaaaagtgtaagatttaaactgttgcaattgttaattaaatacattcggtaaatattgatcatatggccaagagccgaaaatggccaaaatatatacaaatcgttagctcaacggtctgtaatagaagaatttaaaagactttttttgtagcaaccaatccccgaagagttacagaccagggatgttgcaaaaatgaaaataaaatacgagacaccagatacgagaaaaaacgagacaaaaataaaatacgagacgagcccccccccccccctaaaaaacacgagaatatgagacacgagatgagacgagattttttttacaaaaaattaaccgaaaattttgattgtaattttacggaaatggtcgggccgaaatttttatttcaaatggccggcacaaaacggggattttttccaaaagaaataaaaaattatgattttttcaagtgaaaaattatagtaaaataaaagtgtttttctttaattttagaaaaccaaaaactaaaactaaatccaccttaaaatttaaccaatcaacaattaattaacacaccgtttcaaaaaacgagacatgaaccaataaatagagagtgcagagaaaaaaacatctctcattttggcatactatttttttatctctgttaatagagaaaaactgaattcacttcatcctgtttaactttttttctgcttgttaaatccacttcaaattttgcatattgaaagaaaaaaattttctgcacctgtcaatagtgaattcattattgtctataggctaatacaaaaattataagaaaatccaaatttccaacgctcatatcttttttctaaatcatc

SEQ ID NO: 29501 - DNA, 1153 bp, Heterodera glycines
acgaggaaaggatgtcgaacgctgaaaaattggaaacttttgacgaaatttattagggaaatagtcaattttcaagtccccacttttgcgttcgacaaatcgccctgagttagtcgaacgcaatgcgcgaccctttccttgaacttgccgctcccttttctcgttttttcccctttccttttctctctcttttttctttcccttttttctcgacccccccgcctcgtgcgttcgacacactccgaccccttgcgttcggcgtcatgaccccccccccctgcccccccttgcacagctatgcataagactttgcataacgatgttttgtcctatcaggaagttggatggaatgtcattgaaaaacaaaccgactcggtttgccatgacaaattaccgttaaaatatttaaagtggggaagtcaggcttaaatcaggaaaaaagtcgaaggatctgaaacaatgaaggccgacagcgagtgataatgagagaccgtgttaaccgaacgaagaggacaaattgagtaaaattcacttggtgaggagagaatgagaatagacgaaaagagtgaaaatacaaatgccaataaattggaaaatggatttacgcctcttttcaaaaagtttgtgatttagttttgaggcggaaaatcacttaaaacctccaatcccttgccttccgttgatctcaaaattcgaggaatttttattgagcaatttgatggaaatgcgaagagcaataaaaatgttttttaaagcattttaaattgtgtttgtcgaagtgaaacgatggatgggaaaaaatgaatggcttaaatatggaggatgagaccgccgtcaatttgcgagagatatgtgtcggagataacaagagagaaaatgaaaaatagaatttaacaatttaaatgattgaaaaagcatttaaaattaaagcataattaataataaaaataaatgagaatttgggcagaaagaattgaatgaccctgaacatcaaattgagtgatcgaaattttgtaagatttgccaggcctctccattcggaaattcctcctcatgccttcctccctttttttccctccactttcgacattcttccttcggtctcgtttgtacggctcaactcgccaaaccatgtcggcctcgttgacggcct

SEQ ID NO: 29502 - DNA, 2198 bp, Heterodera glycines
tatttgtatgaggtggtttatacacgaactttctatgacctgtcctgcgtttatcacccccagtctcggccgtccttcctcttttatccacccgcacattctttttgccgctgtcgtcgagcgcccaactcggcggggctcagttaggggcgaatgttcagcaggaatatccatttgtctagtgctgtttcaataatccccgcattttgtttccttctaccagtgcttgtcactggaatttgcccgatcgaaagatgattttaatcagacgcgtgcgcatgacctgaccgacctcgcttggtgggggaaccccattcgatcattcgtaatagggcgctcgatgccaaagctcatcgatcccatttattttttaaacttaaccaaatgggcatattttttgcatttttgttaagccactaaatggggattattttcgtcgtatcaaaggaattttgttaaacagtcatttagaagaatattaatttttttttaataaaaattataaattaatttaatagtgaattttagtttaaattggcccatttgtcacagaattattgccattgcgcaaaaaacgaaaaatggcatggccaaaattggcacaatcgtttcgaattcgtttgttcagcagcaagtacaccacgggaggacaaccttaaaagcatattttttaaacatataaaccatttgtaaaaaactaactaaattttttattaggtttgccatataaaaattattttattttaatttaatttaatttaaaaaagtatgcaaaccattcgtaaaaagccatgcataagtgccaacgatgatgtaaatttcaccgattctgacatattgcattaaggcgtaaattacggcggtaattgaatgtatcaaacttatgataatcacttggagaaacgtctgaatatttattttaaaaatatttggaattactcaaaattaatgttatttttctaaaaagggggcaagggtttttactgattaaaaatggagaattaataaagtatttataactaaattatttgtttttgttgccatttttttcgtcccttataataatcacctggagaaacgtctgaatattaattaaaaactgcttaaaattatttcaaattattgttttatattctaaaatagtgttgtggttttaatgatgaaaaatggagaaaataaaacaaagtattttttattaatagtttttttttgctattttttgtgtccacgatggttgaaacgtttgctgattttctgtcattttgtacattttccaacttagaaatgcagaaaacaacaaataaactgtggataggccaaaaatgacgatgcaattattcacattatccatggtgttgtaatactataattttaaaaattaactaaaattaattaaaatttgcacaatttgtccaaaatcgtccgtatagccaacgtatgggttgaaaaaccacgacaaataaacaccactgaacagaattggcttagtgaacatggcaactgcaaagccataacaacttttaaaaaattatacaataaaatatattgcatacctcctccgaaaattccgcttgaataaatcagcaatggatagtcacaataaacggcaatgttctggattttagggaatttatccctgaggaattggtcccacaaaaactttcggctggtcttcatcgttgtggcatattattattattattcctgttgacattgttcacggcataatttggtgccgtccatgccatggcaattggcccatttgacaccgaattgttgttgcaattgcgcaaaaaacggaaaatggcacggccaaagttggcacaatcgttccgaattcgtttgttcagcagcaaatacaccacgggaggacaaccttttgaaaaattatttttgtattttttaaatatagagaatataccatttaataaatatgaaattcattatttaattaatttacgcattttcaagcaccaaaaaattactaaagattcctcaaattttttcaattccaaacataacccacatattagaaattaaaataatttgatatctttgtttatacagtatgaaactaatgatttaatttaaagatagcaaaatttcaattaaaaatcctacaaaatttatttacaaagttgtcaaattcatggcttaaatgtttgacttaccatgcgaaaaaagccatgcataagtgc

SEQ ID NO: 29503 - DNA, 2219 bp, Heterodera glycines
atgtatgggcgaaacagcgtgtcgtcgctttgctcgtactccaacacgcggaacaccttcgtgactcgatagccctcgtccagtgccgcattcagctcaattgatgtgcaagtgctgacccatccgcgttgctggtcggaatgttcacagcggtagtcggaatccacccctccactcgggtattctttggcacaagtgatgcacagcggaaagcacagtcggtcgtccactctcaccggcagcactgcgacatcgatttggcggggcggcactacccaaactttgagtagtgccaatgggaaagggttgtcagccgcgcttgtccaccgcacttgttgatttaatacgtgcactttgggagtgccaatagggtaacgggtagtgaagcttaaagtttttaatttatttggcaatataaagaaaaacaacaaactttatgtatgggtagagcgacgtaaagtcatagtaggagatcctctcccccggccccgccttgcgcagaagtttcatcggtccggtccgtcctcccataaacgcgtcgcggattaccaggggtccgtcgtccacgtaatttgcaaagcacttcctcatggctttgctcctctccagcattgacgtaattttgcactccctatatacgtccacacgattcactcgggcccgaaggtattccatccgcttggctcgcgctcccgtacttgtcccgctgtctttccgttaggcagcaacatgttgtcattcggatagcacttcttacaaccatgccaagtgcaaccttaaaattatcgatttttatcggaaggagaaatataatcaataccgttaacttcaattgcgcgtccttcggcctcaatccacccgtccagggaataaggaccgatccgcttctctcctccagccgaatgggcattctgtacttccaccccatgctcctccgaataccagtggaagaatcgaagtgccaataggctttggttctgcgcgttgtcatagccgcgctcagggacgatggccagatgttcagagggcagatgattagttcgaaaatgccgcatacaagctcctgcgatggtcatgcactcgcgcaacacgtcgatgccgtcatggttttccttgttgtcgattccatcgatgtactcctgtcgtcgcgaaatctcgaagaattcacggcggaatgcgacaagagctgccatcagtatttcaacatcgtttgtgcaataactgaaaaatcaataataaaagaaattacctggcaagcgcctcatcgagcctaaaaggctcatgacggtgctcggcgtaccactcgtcgaattggcgcctcttcccgggcatcattccattagccaaatattcatcaggtgtcgggtggatttctatgccgtagttctccggtctattggcgagatgagggaagaacggcttgtcctccacatcaagtccataggaagggaccaatgctgccagcgaacatggcatcaggttgaaagaatcacggaagatgacgttggggttccgctttttctgcttccgcactttcatctcgtacattttattaccctaaattttatattagcctaattttttaaatatcattgtacccgtctcagcatctcagggttaaaaccaatccggaacagctcgcggaagacgagcaccatgtcgaagcggccaccaaagtgagaatatgcgtaagtgtcgtacttcttgggcagttggtaaacgagccaatccacaaatgcctccagagggttgtcagacaccacttgcttgtccacctgagtgtccataaaacggcgctgacaaaaagcgacggttcgatgtagtccgcatatttggcagcctgctgttgccctcttccatttgccgttgtcaatgcagtcagggcacgcaactctcgcagcgataaagttgggctgatgttccttcttctcaggctcacgaggattgactggttggtgctgcatcgtctccaagtcaaaggccacaatgcggtaggggtcatgttccttcggttcaattggctggatgaagcaaccccgctctggattgtggtacgtgttgcacaattgacaatacgtttcgtgacatttgtgaccctgaagccaacgaatggcatttttaaatttatttacgcttcttacttttcgttcatttcgatgatgcactcgtgtgtcccaaataaccccgcactctttacactgttttgactgggcgcaaaa

SEQ ID NO: 29504 - DNA, 1451 bp, Heterodera glycines
  misc_feature (1236)..(1236): n is a, c, g, or t
  misc_feature (1265)..(1265): n is a, c, g, or t
ataacagtgttcagcaacctcgaaaacccctaagaatgtgttttcctttaatttatgaatttcaaatttttgttcgaattgggttcaggatttgtatttgcaaaataaaggtcatattcgtgatcagcgccacaaattacaccatgaaaaattatttcaaatgtcttttgagtgctttttatagtgcggtcacttaagtcccagctgaatttggcactccaattccggcactttttcaacctgaaaaagggcaagcgcacctttaattctatttttcctaccctttctagcctttttacatcgattctgaccgttttaagcatttttgagtttggggactcatgagaatcccatattcctcacccttatttactagaaatgttccaaagattctaataaattttaatggaagcaataaatttaaattattaagacgaattattttacgtattgagccattttatttacaatatttataaaatattacttgttaaattttaaacggtacgcaaatgtctggtagccataaattgtttctatgtttttaaaatctgatgaagaataagcgattccataaatttagaaaaataatcaaaacataaataaattttaggatgtgacaattaaaaaaaggccgaaggtaaaatatttgtttttatgctggtgttatttttttttgtctaagttggttgtcgatctagcaagttcatcgtcatgtaaagagcatcacaaaaaaatgtacttcttcgaaaatgcagactattatgaaaacaggcgtttgtcttgcgtttggtcagaaggatgggaagcgaatgagtgctgcgggaaaaattaccaacttgtgatcatggacaaaaaatacgtaaaaaatgtaaagattttgaaagttagaattaattaattttatttttattaaaattcatggcataattatacttaaatattaataaaaagttttatataatatttttaggatcttcggaacataaagccagaagtaagtaaacaataatgctttttgagcatataaataaaaaagtaacgaaatttgaaataatttttatttaaatggaatttccttgaaaaaacaaatttaacattaataaaaatttgatataaaatttttttaggagtcttggataccacattcagtaagtaaacaataatgcattttgttttaagaataaaaaaaataatgattctgaaatttggtttaatttattttatttttactanattcattagatttaaaagaataactttanacattaatgaatattttttatataatattttaggttcttcggacaccatattcagtaagataacataaatgctttttgttttaagcaaaatttactagattataaaaacttacaatttagtgaaggtaaatattttataattggatttaattggcttattatatatattttaaaaataagcttttg

SEQ ID NO: 29505 - DNA, 1653 bp, Heterodera glycines
  misc_feature (936)..(936): n is a, c, g, or t
  misc_feature (955)..(955): n is a, c, g, or t
  misc_feature (1001)..(1001): n is a, c, g, or t
  misc_feature (1014)..(1014): n is a, c, g, or t
tatttattcagaaaaataccacgttttacacgtattacatattatttaaataataaaattcagagaaaaaaatattgaaatttctcactctctctaactctttcactctactctataaaaataaataaaaattatagaaattgtaaacctactgaattaggtaaggcttggcatttttatcatgatgtcatccccacttcaatttctttttttgatttaaaaatttttcaattttattcaaaaaggaaaatcgaaaaaatctaatatgaaattattaaattttatttattactttattaataatgaatgcttgatttaaataatatcactatattctttttgaaaaagttgtattattaatagggctgggatttttaggcaatacctaaaatttatgcgcatttcataagtgtagctaagcgggaaaaaatcatttttatgagtttagagcttccgggccccgttttataatacctattcttacctatttgggagtttttggcactatatggaaagtgacagtttttgaaaattttttcaaaagggggggacccttttgttttgcaaaattttttttgtgatagtcaaaaaaatttattctctggggtttttggggtccccgatcacgaatccttcaattattttgatcaattccgatttcctaatctaaatttgaacaaaaaatcataattttaaaaattcaaaatttcgatttttattcgagttcgggttagggattagaaattagtcaaaatacatgtcagattcgtgattagcgtgatttatttgaattaataggaagcgagtttagcatagatcaagaaagaaatttcaagatgcataagtgtttaaattgtgaaattgccaatttggcattaaagaaaattaaattcgcagaaaatatgaaaaatgtttaaatgtaaattaaataaatcntaataatcaattgtaacanatattttatcttttaatattacaatgtttcttttattcagtctttntaaatctaaattngttatagaagaaaatatcattaaaaaaatcatttttcttggttttttttgttaaatttttgtatcaaaattcggtttttgtgggtcatttaattcacgtacttccgcaaatcgtttttaagttctggatttatttgaaaaaatcaaattctagtatccccaaaaataaaaactaaaatcctaaaacgagtcattaactctcttaataatattcaaaatatcattaaaatttattaaaccttaaatgcaataaagaatttatttatttgcaattttttagtttttaataatccaattcattcatttgatataaggaataaaatttatttcgttttattttattgaatgattatcgaaaattttgttacttttcaacatgctattataagttcgtcagtagacaatttttttaattaatattgagaaacttggacaaatgcattaacgaaaaaattgaagttgcatgcattttcaaagtgggaaaataggcgaataaattgttaacagatttttaccaaaaaagctaatttttacgctttgagctcattattttaaagaaaaatattagttttttgcagtccggcggtggataggcgccaccggtggaaaaattgcaaattttaagcttttttaaacagat

SEQ ID NO: 29506 - DNA, 1011 bp, Heterodera glycines
agtcggtcacttgcgcgacgggtatttgtcgaaattgggggaacgcgtttaggaaatgcgctttttccaaggagattttcatcggtggaacggacgcgcgttttctgagagaggcaattaactaattggaattaattgcaattgcaacttttcccttttcagaagggcatcccggcaattggcttctcaccgatgaataacacgcccattctgttgcacgaccacaacgaatttctcaacgaaggcgtttttctgcgcggagtgaaaatttacaccaaaatgatcccacggctcgccaatttgccgtcattttgagcgaagtgccggcagaacaaagaaaagaaggaatcaaaatgatttctcctctaggccaataaattaattatatttattttaattcacttaaggaattcctttgccaattttattgcctttgttttttaatttatttcattttgaccaaatttatattcaaattgaaaccgaatttatgatttttcgagccaaataaaggggcaaattttgcgaaatgctgcaaaatgacacctcaaaagccttcgactaaaaacgattcgtttaatgattgttcttttcgaattcgtccgccgttttcgacttccccccccccctcttttccttcattcattgtacttcctccacttctgtcatgagcttcggtggtgcgggtgaccaaacttcccgcgtcgacgtgtacattttaggcgtatggtcttcataatcgaagattgaagtcagtgtctccgtgccgtactgattgatcagctccctcgggttcgtgatgaattctttggtccatccttcgcgtggcactccgcccgggccttcgctaagcccttaaaaatcccaaatgtttatcttaccatctccccccccccgtcgtttccccccgccccgtcgtttgctccccgaaaaatttttcttgaaatttttctactaagatttcctaagagttttttaatgaaaaatttctaggtttgaaaattttttttt

SEQ ID NO: 29507 - DNA, 1844 bp, Heterodera glycines
cggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccaaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttattctgcgttggatttttgctccccataatttgttgagtaccccaaacggacacctgaaaaaatcgattttttttgttttcggggcagtccccccgaacgatgcgcccagattaatggggagaccgatccttcgggagtagcttccctatagcctgtacttaattctgcgttggattttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatgaataaaatttttaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtattcctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttatcttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcggagggggggcgaaggcccaccacgaggccgcgaag

SEQ ID NO: 29508 - DNA, 1408 bp, Heterodera glycines
  misc_feature (1307)..(1307): n is a, c, g, or t
  misc_feature (1381)..(1381): n is a, c, g, or t
atcatcagcaaaattgatcaatcatcacatcaaagcattttttaattcaccgcaaaggaataataaaaattaatcagcttttaagacaaaaaaaaaagcgaaaaaaagaaattagcagaaagacagaaaaagagaaattgtaaagattttgaaactttttaaagatacttaactaattggcattatgtcctgatgattctttttttcttttgcttttgcattttttcagatcagaatttgtttttcctcctccttattttaatttgttttaagaatcaaacatttgctacaaatgacatcatcgagcagcagaaatggcatcaaaaaaattgcaattcgtaaatttcaacgtaatttttgcattctttttttatttctttcataatatttcaaccgttttcaggtcgcaatgatccgtctgtatctaattttgacacaaattggtcagttttggaggactccgttaagaaaattcaggagagagaaagtgttacggttacttgcgtcgaattgtacaatgtaagtgttgttaaattcaaatatttattatcataaattaaagaaaaattgcatatttcgggatttactaattgtttgtcataatagttagctccaaccccatttaaaatttaattttcactttacatgttgctatttggtttatattttagaatctttgtgcatttaatccaagccctatattaagtacccttaattttattagttttgtttttgccaattgctgatatttaactctttcattttcaaatttcgcagatggtcgagcatttgtgccaaatgaattatgccggtgagatttacgcccgacttcaattgctcattggaaaatttgccgaggctgagtcggctagccttttggacaacagtctgaatgtttccaacgaagccttcttggccgcactcaatcgcctttgggaggccttctgccagcagttggtccgtttttggacggagaaacttctgattgtattattttacccttctcagactctcaccagaagtgtgtttctgtatttggaccggacttatagggtccaatccacttcatccgtttcaatttggttggtttccgcttttgccaactttttacatccaaaaggttcagggatgcaggattggatgcatttcggaggcatattttggagaggtgtggcatttgttccaggacagtgagtggcattttgcaactcatcgagcaggacagacgcggaattcaagtcgagtttaaaaaaaaataaaattggttatttatttcactgttttcagacaaataaccaattgcttanatctctgattcggatgttcatgaacctgcagatgtacgaccgggcatttgaacgcgaatttctgaagaccactngaacattttatcgaaaatgaagcgaac

SEQ ID NO: 29509 - DNA, 814 bp, Heterodera glycines
acggtcagtggctattttccttttcttccacaatttccccttccgcttcattcttccatattttactcttccgccttatcccccgattccttcggcttttaacaccctgccccttccccgccccgcttctcctccgctttcctcgccccttttcttccccatcccccgtttcagttccgctttcccccgctatgctcgactgtttcgctcgttctgtgggtcgtgccctgtccaatgcttcttcctccaacgaattcttcaacgtttcgcccgatgattgcctgcgcttctgctctacggagcgggcctgcaacaccgttgtctaccacaagcacttctccacctgccaattgtattcgggcgcggaggagggcgacacggcacgcgaagtgagcgccaaagggcacgatttgtacgtgaagaaggaatgtgaggagaaccgccgggagcaggagagagatgaagcggagaatacggcaccgaagggcggcaaactgtgagcagaagccaagaaggaaggcacagcaccattcaaaaagccaatggcacaaatggcgattttggcactttttcaactattgataataatatattttatggaacatttgtttcttcttttcaccaataaatttcatttgcattttcatttggtgtgaatgttagaagacagagaaattagcgataaaaaaaaaactaaagaaaaaaggggggatgagatgagaacaaatcgccaggagatcagcagcaatttgttgacccagaaaacccactgacgcgaccaccgccactttcggggaaaagccaacggcactcc

SEQ ID NO: 29510 - DNA, 1624 bp, Heterodera glycines
  misc_feature (1575)..(1575): n is a, c, g, or t
cgaagaaactcttttcatagagctcctggtggaaaacagcaattttgctggaccacacacgcatccacatgtcgaaacggtcagtgaacatttgaccatttttgtaaatgttctccttgaactctggccactcacggttattcgtgaatgtgataaagagccgcgccttttttgcgtcatggcaacgcgcaaaaatggtgttgcagtcttcatacatttttttccaatactgaagagaatttacatttctctcagaaaggcgaacaacgctgccaatgtcatcaacactcttttgttgtgcattggggttttgccgagcttgctgcctgttgtattggttcaccaagtactgcagcaaattttttggtgtacttacgcgcaggtccatgtctggacggcgcaaaaaagtggcaatttgccagtcaattttggacgcttggtctaagacccagcgctgtccaagaccaccgccacatgaaagaatgtgatggtattgccactccaaattttcatcccttattgcgagatgatatttgcaataatcgcgcagggagacaaatctttttgatttgtcatagcgactggtcactgactgcgtcgatgtttcagatccggtatctgacaatgcaattgacttggtctcgcacatgtcatcatcggacattgcttctgtgtcaaacatatcatcagaattatcgcttttccgcttcctttgtgcgggtttagcatatggaattccaattttatatccatcgtcgcccttaggcttaattaatggataggtcaagctatcagtccatggactgaacggggcaatttcgttcaactgcccttgcttgttttcaacccatattccttttggtgccggggcaccagtgggatccgcatgaatcgcgaacatcccttcacccgttgagggggtgattatctggtggggatgcaactttgggtctttcataccacccggagcagagcgctcatccagcaaagtcattctgaagaatcggagttcttcagtcctttgttgttttaacaactcttggagctgttcacgagcctgcttgtaagcagacgcagctgggtgattttcttggataacttgttccaaaatttcaagggtcgcctcattaagctgatgaccctgcacaaactcttcatcgtttgtgattttttcaccagtaaaggtgggatttttccgtcgctgctccatggcttcgactggatccagaatgtacaactgaccaaagccaggaatctgggttgttcctgcttgcatgctgctaatgcggcgatgaaattctccattgagaattactgccattggtccaccagcagggcatggcttatttcctgccgaaacactcgcaaattggagcaaattattgtaccgcgacatatgccgcacaaattctttcccttcacgggattgtttgtcgcacgtgatgagctcttcaagctcttttgggtgcgggttaagcttcggcaacacaactcttccctgtcgacagcaaaggctgctgtcctcatgcgggaagagtagtgccccacaatgagagcacttcttttcaccaagcnttacagaatctgagtattcgggataatgtttagccgctgctgcagcaca

SEQ ID NO: 29511 - DNA, 1194 bp, Heterodera glycines
  misc_feature (69)..(69): n is a, c, g, or t
tttttgataaattttatacacatacaaatgctctcgagcatgataggagggcggtgcgcaatcgacctnttatttttgagggaatttttaaatgtatactctatcccagaaaaatggctatctctttttttgataaatgttatacacatacaaatgctctcgataataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaacatttggaaaattggctatctcattttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgcttctcggcgcgtttgtttgggaaaaatttggaaaattggctatctctttttctgctcaacagtaataggaattccaaccgcattctcagaataattacgccgttctggaatgtgtttctcggcgcgtttgtttgggaaaaatttggaaaattggctatctctttttctgctcaacagtaataggaattccaaccgcattcttcagaataattacgccg

SEQ ID NO: 29512 - DNA, 1758 bp, Heterodera glycines
  misc_feature (13)..(13): n is a, c, g, or t
  misc_feature (31)..(31): n is a, c, g, or t
agaaggagtcaangcagcggaacaacaagcnggacagtgaaataggagggcagtgagttttgtcccggccaaaaattcgttggacaggacacatatattttctttggcgttttgtttgttgtttgttcaaaaaagacatggcaattaattgtatttcgggcattgaattgaatattattaaaaccaaccaaatcatatattattgtgtattacctattcccattcgttttgttcgccgcgtcctttcacaattcattcattcatcgtttttttttgttgccatttctcgccgttttttgttatttatttctcttttggtctttcgttcgtttgctcttttgtcgtctgtctgtctgtctgtcattcattcaattcatttattgattcaaccattgcatctcagttttgtttgtttgtgtgttcagttctgtttcacactgcgcctctccttgcaataaaaagtgcacttttatgaaaccaaacttaatcaaatttgtccaaaagtctcccattattttctgtatggtccattttctcctcaatgtatgtaccaaatcaacaaatccaatgcgcttttcatacccattttttgccattttgcattcgtttttttccaccgggggcatttccaatcggatttaaatttgcatttgtttttcattcatttttgatcaggtcagtgcgtgtcttacacttacttttttaagaagaaagttattgctaaaattttgcacatgaattttgagaatttccaaaagtactaagaaatttaaaattaaaaaagtaatatgcttctttcattcataatcctgcttttcctgccaaatgcttttccactgattgtgtgtgactgtatcatttgtcgtccgcaattccttttgatggatcgaccgctttcagttgacccaaaccgatcaatttgaatttaattttcaaatttactttcatttgctttattttttgtaataaaattggccatcattataacaaatctattaccataattaaaggtaatgcataattaacctgaacatttttgttgcattgtttctcccatttgcttgtttataatcacataatttctttccaaaaccaattttagcaagacaaaaaatcagaagcgaaaatggtcaacccgaagggataccgtcgcggcactcgttacatgttcgcccgcccgttccgcaagcacggcgttgagccgctttcaacattctaccgcgtgtacaagcggggcgacattgtcaccgtcaagggcaacggcgccttccagaagggcatgccgttcaaggcgtaccacggcaagaccgggcgcgtgttcaatgtgaccaaacatgcgctgggcgtcgtcgtcaacaagcgtgttcggttagtatttttggatatgttggtcggtgttcaattcggaattgtttaatgagttgtaatggatctgtctggccgacatttagccatgtttttcgggatgagagaccatcaccattcatagaaatcaagataagaatttttgagggaaaatgttggttccagttcagtttccatgtctctcaatcattgagttcttgtccaatttgtggaattaaaatgggtttggggtcgtaactgaagtcacgacaaatgaaagagatggcgagggattcggaaaaagtgccgattttccctcggttttacagatttacacaaaatttctcttaaaaacaaccgggttcggagattttttggggcgagggaaccgtctcttccccccccccccccccc

SEQ ID NO: 29513 - DNA, 1305 bp, Heterodera glycines
tgtccgtctccaaattggcgactttcgcgcggtcgatcggccaaatttgtctttaaaattataaaggcgcattttttcataattttttgactaattttgatcattgattaatttattgagtgcctaattgccttagttaatagatcattattactttaattgcctgattaatgagtcattgaattaattgcctgattggcctactttttaattataaagtgatttagtctttgttgattgagtgccttgcctaatcgctttgattaattgctcattgatatatgtattgcctaattagttgttaattggttcattaattaattgattgcctgcagtgcgttcatttgtttgagcgtcgctttcagtcgcacattcgcttcgtccctttgctcttccaatgccatcattttggcctcctgttctgccaattttggcgtcagttcgtccagtcgtcgctgcaattccgcgttttccaccaaaagtgcgcgtttttctccatgcgctctttcttacaaattagcaattaaaaaaggaaaatgaatcggaaatgtctctgagtttttcggggtttcggtctcgaccttaggggtaatttgtcggtctctttctcgactctttgggtttgaattttaatttaaatttaaatttccattccctcccctatgtcccgctttattaccttccatgtcacgcaattgctgctccgtctcgtccgcccgcaactgttccatcctcagctgttgttccgctgcgtgccgtcggcggcgttcgtcctccaatgccgcgggcgaaatgccggcgccgccctttgtctgcccggccattgtgccatcgtcgtaataattgtctctgctgtccaactaattaatattttgatttgcgattaattggttttaatgccttttcccattgccgtcgtgtgccattttgttgtgtgccgttgtcgtccgtttcgaagtgctgctgttcatcgacggacaccgcctcttcggcggacgacgacgactcggcgccacggcgacggccccggcggaggggcgacgacggacgacggtctgtgacaaaagcaacgcggcgctttggcattgtgttgggctgaaaattctcgagtaaattataattaggagaatcgtgccgaggaaaggaccgggcattactctcttttcccctcttcccttacacctttcctccattactctcttttccccacttcccttactcctttcctcttcttccttactcttttcccctcttccgctttttcctcctcatccctctcctcttcctccttctctcctccccttc

SEQ ID NO: 29514 - DNA, 1306 bp, Heterodera glycines
tttttaagtgttttcctttttttcctgagctccgcgtggcctgaaacgcacgaaaaacatgttttttttgggctgttgttaagctacttttcaagttactagtgcctattttctaggcttttatttttagcgcctaaaatcctaaaaaattttgaaaaagcctatttttgcctattttggcgttttgccaaaatttgttaacaaaaatgcaataaaaacgaaaaatacacccttaagaatcgacctaaaatttttatcaaaaaatacacccctaataaatgaaaaaattttcaaaaattcatctccaaaatttatttatttttttcttgacaagaatttgtgattttgaaaattatgtatcgcattaacgatttggcagaatatttttacttttttgaatacattttgtcattttacacccctaaaaatgagggtttttagtgcctattttccatttttagagcctatttttggggtttttagagcctaaaaattggagccctattcataattatgtgtgcattcaaatttttaacaaatcgataatttccgttgatatcgatcgcttaatttgggggaacacaaaacggtagcgcactgcgctgtggacgaggattttagcattcaaagtagtgaccgggggtccctttacaatttaatcacttatctctgttttctcgcgcatatttttttactctttttctctaattctctccactctcctatagtgaatgcgcatctctctgcccagggggggccagatttttatcccaatactactgggggggggggggataatttttaagcaaatttattgagttgaaaatcaaaaatgtaatcgcgtcaataaaatcaaattttgaaaattcgcaatcatctaaatccttgagtatttttgccttgacgagtttgtatgcttccgggagaactcttttcctaaaaaattattttttaattgctttgacttttaccgataatcgctttcatccttcagctcatatttacactgagctttaaaagtcgggtcagatagcaaaccaaatgacagattgttacaggttatcatgctgctaattcgtttgtcagccacagacaaaatgcctaaaaaaccaaaatctggaaaatttaccaacacaaaactaccgctgctggtcaaattcgtgcctattaaattttcgatcgtcggctggttctcaactttttctttggatttttttttcgccttctccagttcttcaaaattcttgacatattccgaattagcatgaattgttgaaaaagatggtttttggacgatttggtgctg

SEQ ID NO: 29515 - DNA, 1511 bp, Heterodera glycines
  misc_feature (1487)..(1487): n is a, c, g, or t
acgactgttccgctggtcagcagcattttaggccacccttctccgagcactgaaaccgtggactatacagtacgtacctgcacagtacccaaaaaatttatccactatccatgtcaacaattgtaagaaatgatgggcacatacttaggtgcccaattgtagcaaaaatagtccacgagagtggtgccgatgaattgtccgtccaacccgtaacatggcaccgcgttcagaatgcccatggccaacgacagagtgagcaaatagcgcgcgaacagttcgaccactcgcggcacccaccagggggcaatgcctgaacaacaggacgaacatgacggaaacaaacagcagttcaaagtttaaacggaccaaatcggggcgtcagctcagacacttcgaccatttggaggggctaaaaaggggcaaaaaatggaaaagcgacaacaaaaagtgaattgatacttcgttcagagagccaatgaacagaacgggccgagtctgaccagccacttggaaacggagcagtgccgtgtcgttgaacagtgcgggcaccacgcaaacgtagcccgggggaagggtctgaaaatgggccgatgaacatagtcgggacgataatcatgcaattatacagtaccgccgccaaaaaggcgtccaaagtgccgaaagaggaagaagttggcgagtcgcaaagggcatgttcagtgactgaaaaggagggaaaaagctgacgcataggaaggaagacgaaatgtgccccacaatggagaatcgaaaattaaaattgagaaagccgtgccaactttgcattgctggcagacacgcgtgtgcgtatttgagtggcggcttcaccagcgccgacattttgatgcccgaggcaaacggagcggtggcaccggcggagcgccgactgtcactgtcgcccaaagttggcacttttgtttgcgggaagaaatgctcaaaaataaggtaatgaaatggatggcttcttcttctgctgatattactataccatcttcaggttggcccgttttcttctcaaatggtgtactgcttgaagttgttgctgctgcgcgctttctgagtcctgccggatgccaaactccgcgtcaaagtcgggaaatttagggaatatgggcttcgccgttgccattggccgatggttttctgccccgctgggccgacggagttgatcctgtactaaaaattggtatttaaaggtgaaattcggaatttcgagctgtttccgcttgcctccttgggccaattgcggtggggccaaatagcggaagcaaatgtgcgtgctgttgctgacgttgaactcgttgcagcactgcacttcgccatcggaaggagcctgccaaaaaatgtgcatcgaattactcaattcgctcgcaaatggcaccaaagattggcacacgaaacgccttttgattctaatgaatgcatttcatcatccccaaaaaaattctacaaatagaaattactcccanaaaaattcgaaaaattattcgaaa

SEQ ID NO: 29516 - DNA, 1818 bp, Heterodera glycines
tctgaatttgcgcccaacttttcggcactaaaatactgtaggtatggatgacggcttaattttgaaattggctttttgaattttcaacatttcccctgcagcggttggaattgccaatcggtggtgacgacgaccacaacaattcacgtgcaaatccgtcatttgcagctgcgcatggcgcgaatggcatgcgattgattggagccagcagaggtggcggaacggcagcggcgcatgacgacggatgtccaaggggaggaggaggaacaaaaagtggagtggcaaaatgccagaaacaaatgaatttttaaacaacctaaagagcagccaaaaacgatagcactttcccaacaaaaaaaaaattatgtaaaaatggggcacaatgccacaattagtctcaccagtacactgacaaatatctgacctattggcaaatcgccgaataccttaacctactatagtaagcgaataaatgacacgtacatcaaatgtccgtgccatcctatacaatttttcaaaagtttatgacgaattacaatttataaaaattttcaaaaaaacactgaaaattttttcttaaaatttgctaattttttgaaaactttcaaagtttgaaatttaaaaaaattcggggtgggaaatgaagtcgtcaaagcgttggctcttaattgataaaaaccatctcatccccattttgatccattaatcactgggttatcactcaatgattaatttaagaaatgtttcgtccaaatggcttcaacaatggcaattctccgccccatcgacaactgttcaaccattcgcctcctcagcagcaggcaaacagcaacagaaggtggccaaatgtccccacgggttgataaataaaaattttggattaatgacccctctccagtcattgatgaaccacagccctttaactcgggattaggttcatactgaaatagtagggggggggggggtcgacccgacttcatacgaacgaagtccagggggggggggggggtcggagatgaaaatttacgaagtcctaagtcatgtaaatcaacaaaatttttgcttttcaaaaccttttttttgcggcgcgctttttccaaaaaacatttggagaaccgggggggggggggggaatgtgtggggaaaaaaaggtgctgaatgagagaagcaaaggcttaaatagtgccacaaattgggaggggcgaacagaaggatattacatagcaaattgtgagtgacatgtgagtgaaggcaatccaagagagattggggaaatgtcataaaaataggtaattggaaaaggaaggaaattttggatgaataggatgatggacggccagaaggcctgggatgggacaaaaaggcgaaaaacaaaaatggtttaaaattacgaatggcagattccacagtatccgatcatttgatcatgaattaatgttcctaataaactagaaggtaatgtgttttaaatttaatgctatttcggctatcagggcttgaaaaaattttacctccgaatccgattttggacataggtgcaaatgtcggggccgcaaatgtcgaggctccgtaaggtggcattctcactgagtctcggaatgggataatctcaaaagaggtgtagccaatccgggccctataaatcaaatgcttttttaaccaataatcgatcataaacaggttaattttgccgttcccggatggagtcaaaatgaaatatcgggcgctttgtcccgatttggactttgtctctcccgaactggctgaaggccttcgctgtgaccctttcgtcgatattttttcccctggagttttgtc

SEQ ID NO: 29517 - DNA, 1064 bp, Heterodera glycines
  misc_feature (8)..(9): n is a, c, g, or t
  misc_feature (27)..(27): n is a, c, g, or t
  misc_feature (34)..(34): n is a, c, g, or t
  misc_feature (43)..(43): n is a, c, g, or t
tgcaggtnnctttttattttttaatantttaaantgaaaatantttttgactttacgcaatttacttatattgaattctatgaataatataaaaaacaaaaaattaatttatttgtgtttttaattagagttgagtacatacactgaaagattggccatcagttaatttccgtcaccccgagaattcatgtgacaaaaaattgccctgtctgtcggactaaaaatattcgaaaaatctttgtttaaaataatttgagcttctaaattttcatgatacttctgtcaaaaaagaaaatcttttatatatacaggcaaaaatcttatttttcagttctgaaaattttcttaaatttgtttactgaagaataattctttaatttgttaaatttggtcttcattaagagaatcgcaaaatggcatttaattaccaccatagtgacaccacgctaatgagccttcctgcctatattagtgggcaagacaaggctagtcggtcggtcctatgaccaatgtgatatgggaaatacaaattgtatacatgctttcaccattcacgccacaggcacgggtgccatttaactttaactttcatattcatgccacaggcacgagtgccacttaaacttttttttgcacacctccgcaaaatgccaacaattatatgtgaaaaacgacatgacatttttgtccgctgatcaaccgcctctgatggtgtgtgtatgtgtgtgtgtgtgtgtcaaaggctcgcctattagcggtgccacctgctactgctggacagccgaccgtctatgcgtgccagacatatgacatctctgtcctccgtcttttggttgcttagcgacacaaagttttatttttggggggaatgagccacccgggcataagccgaaaaagtgatttagtattaataggtgcgcgaaacgaagggtggcacggcaccacttcattaacagccagcagctgttggacagcaaaatttggaaagcttttttaatgaaatttagagaagggggaaaaggggcacaaagtcaaattgtcattttgtgcccatttaatatgga

SEQ ID NO: 29518 - DNA, 1071 bp, Heterodera glycines
ttccaattgactaacgaaattcttacaattagtaattccgtcgattttttgcttttcactttgtaaattatgggcaccggtttcaaaatgccattcattcgtccgtccgtccctttgtcagaccaaccgccgctcatcgccgccctttcggccccttccgttttggctccgttccccgccccactcctccatcattttccttctccgaaacattcgtcccatccaattgcgccacttctatgcaatggaaataggcatcaaattagcacaaatggcagcgctgaaataacagtgccaatgaatgggacaggaggaggggtggaaaatgttcagccaccgcggccggcacggagtgcgagtgtcagcggaatggtaagcgaaggacgcccccacccctccccaccgccttccaaaagtggcacttttctcgctatgttcggcatcaaacacattttgcacttctagcatgactctttcataattagccgatttttactacagcaacagaaggcaacgaccagcaccagtcgagcaactttgctgttgcaacaacttcgtgaacgtaaggacgaagttggagttgagacattgtgcgcaaacggaggggacacagcgcggatgggtttgtcgggaatttgttggcacttttgtcgggactgaatgtcctttttattagcccttttcttctgtctgatcatacgcatttcccttcatttaaggaagtgccaaccacgtgttcctcgaattacaaggcgaaaccaaacggtcggcgctgccgacgaatgtccgatcggttgaacagatcaaaagtctattcttgcgcagctttccttcgcttagtccggctcagctccgatcgcccggggtcaaagtgtacattcaaaatgcccattcaccccaccggttgttctacgaattggaggacattcggtccgtttaactgttatgtttttgtgtctattttttgggtaaatttcagcgaagttggcaatcattcggtgctgaagctgttcgagcagtctttggcctcctcctcttcgccacatgcttccaccgccgtcctcccaacac

SEQ ID NO: 29519 - DNA, 1096 bp, Heterodera glycines
agattgccaaaaaaagagatagccattttttttggaccgtccatcccttcacatatctcaaacggcccgaaaatcatttttagagcataacaactgatgacagccactgtcatgtttccaaagagatttctataccagatgccaaaaaaagagatagccatttttttggaccgtccataccttcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccttccatacctcacatatactcaaacggcccgaaaatcatttttagagcataacaactgataacggccactgtcattgtttccaaagagatttctattacca

SEQ ID NO: 29520 - DNA, 1000 bp, Heterodera glycines
cattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaacactgattcagtttatatttaagggataaggagtgaaatggtggaattccaaaaggtgaccaagaaaaatgtatc

SEQ ID NO: 29521 - DNA, 983 bp, Heterodera glycines
cggctttctctccgatttgtccagtaaataattcttcaaccacgaattttgcttcctcttctatccctttttcttccgctttcttctcatccggtggcttctcttccccagggcgctcccgaaaatcctgtcccgtaattgccgctttctgctgacccggcaacggtgcctggccctgatcagccaatgactgatcacttttctgatcactgatcatttcttggccgttttccgttattctccggccctgtttctgatcagcaatcttttcggctgatcgctttcttctccgtcttcgttccgtcccataatttgccaccgcctctttggcaattcgcaaatttttcagcaattggagaatccgttgcgaaagttcgctgtttcccgcttttgtcctcatgtcagatgtccgctgttgtccccccgggccgtccttcttctgtccgtccgatttcttttgctcatccgtcggcaattgtttggatgaagatggccgatcacccgacaaatttctgagtgatcgcccatccgttgtcggcagaatgttttccttatcagcagaatttgggagagatttgttgcgtgcggaagtctgaactggtagaattttggtccaaaggattcgtccgttcggcatttttttgccgcttgatgcttcttcgttccgattgcttctcgtccaatcgcttatccgatcgctcggctgctttatcgcccccattttcttatcagcgatcacttccctttcattattttgatcattcgattgctttttctccccttttgctttttctttcagtgtgcttttcctcaataatgaagtatcaccttcaattctgttgttagtctgtccttttgcagcggtgaattgtccgacatgaagctgttcactgttgatcctttggtccgttgtttttgtgctaacttcgaccatcatgctgtcgatctgtctctcattttctcgtaattctttgggtgtctat

SEQ ID NO: 29522 - DNA, 1130 bp, Heterodera glycines
ggtataagcgtttagaaattgcgggagaaaaaagcttcgatattgagaaaccaagtcaagtccagaaaagaatatcttaaaacgaattcgttttggtttggcattatgataccgaataacattcggaaattatggaaacaaaattggagaaattcgaataattttttgacttcaaatttttttcccagttttgattgggttttaaaatagtagtttggttcagaatttttccctctacaaaaaaaaatttataatagaattttttattattaattcgaaatctttaatttattggacaaatccaagacttaaaattgggagaagcatggggctgtagctgaggacccaaaatggggccccattggggaattaaacatgatttctgaaaagtccctgaaatgtcgattttttctttctatagcttcttgtagagctcgagctgctctttccaatggtcttatcccggtctcgatccgtgcagaactcaaaaagttatgaagtgaaatgtgaaatattgttttcgccacaattgggagaagcatggggctgtagctgaggacccaaaatggggccccattggggaattaaacatgatttctgaaaagtccctgaaatgtcgattttttctttccatagcttcttgtagagctcgagctgctctttccaatggtcttatcccggtctcgatccgtgcagaactcaaaaagttatgaagtgaaatgtgaaatatgtttgcaccacaagggattttttctgaaacccatcggaaccaaaaatctagggtttggtataagcgttttagaaattgcggagaaaaaagcttcgatattgagaaaccaagtcaagtccagaaaagaatatcttaaaacgaattcgttttggtttggcattatgataccgaataacattcggaaattatggaaacaaaattggagaattcgaataattttttgacttcaaatttttcccaggtttgattgggctttcaaataatagtttgggtcaaaattttctcctctaccaaaaaaatttatattataatattttataatataatctaaatctctaatttatatgacacatccaagactcttaattgtgagaaacatgagactgtggctgaggaccca

SEQ ID NO: 29523 - DNA, 1752 bp, Heterodera glycines
atttctttaattcatttttggcttgcttttgttattaattaaatattaaatttaatttagttactaaaaaaatttgcggtttttgaaaaataaaattctgagtgttttttttttgcagatttgccagccctcatttggaagcgtcgtccccaagttccattgtcccatcaatgtccttctccacaattggatcatccacttcatcagcagcaattgcgccaatgattgatgaaaagggtgaactgttgaatcgccatgaagtgcaactgatctccaaaacgttgaattggtcggtggaaaatgatcagaaatttgaatttaatctgctcatcaaaattggattaagtagataatctaataaatttaaaatttttacaatggcatcattttctttttttctaaaatagtccagatattaataaaaattattattattattgccaaactcacaaaacaattcaaccaaatttattatgaatgcctttttattttaatagccgaaaaggtcacgaattttagcctgcctaatttattacagcgctttgaaagagcttgactttggcaacgaaattgttgttcggcttcttaatgacaagaggtaatggtaattaataattaatttcttttcttaattcaattttatttgtgtccattttatttttagatcgctgtttaaaagccttttggcacgatgtgccaaacaagctcatgacattgaggtctgttgaacaattacatttattttaaaaatttgaatctttttgttactaataatattgaattaagctagttttttttttaattttaaaattttatattatttatttatttttaaaatgaatgaaaaaaaattgatttttgatcagcaaccaaaaatagtttatagaagaaaaccaaaaataaatggattatcttttcacttcttaggccatattttatttgggtgaagtgaaatttaaattttccgatattataaattgaaaatcagataaaactctcgagagtcttgacgacaatttactcatgctcctaagatttaggtgtttgacccgaaaagtttggcacgtttttgtccaagagcagtgcgagttggtgacggcgtgacaagattttttgaaaatgtgagtaatgtcaccctaaaattatttacattattttttgccaatcccagttggccattgagctcgagaagggtcacgccattgctgatctcgagcagaaagtggctgaactgtgccgtgccaatggccaactccattaccgtatgaaagtgtggttccaagccgagaattggctgtgcgtcaaacgatcggtagtcgacacggtaattgttgcacacaccaaacagttcgacacattttgcggcggaggtgatctttacaatgaaaattctcattattttattattatgatgtacataaaaatggcaaaatcaaatgtgtcggaatgccaaaaagtggtggtgatcaattccaacacaaattgtccaccgaccagtcaaaatcattcactgattattcccattttttcctttacaataacagaaatgcaaataaataattggcaacttctgtgggaattgaacccaatcgaccacacaatccgtgggaagctctaccattaagctaccgagcatgctgggcgtaactggattttcaattacggaaacccgtaattacggcgattttcttaattacggattccataatcagtcatgacggggtcaaaaaacgccgtatttcccgtaatcag

SEQ ID NO: 29524 - DNA, 687 bp, Heterodera glycines
ctgttgtacctcttctatttactgttgtacatcttttaatcactgttgtacctcttctaatcactcttctaatcgctgtttgtacctcttctaagcactgtcaaaaattatgtatttaaggcttggttgtaaattatttaaattaatttttttttaattaaaaattttcattatgtattttttgaatttgcaaaaaaaataatttcatttcaaattaataaatattcaattattaattttcaacattgtttttaattaataaaacgagtattttattataaaaaaaattttaaattaaaatgcattcgatttttaagcgcgaagcgcccgtcctgaggccgcgaagcggccgaatatccaccacaaaatttaaaaacgggcgcgaagcgcccgtcctgaggccgcgaggcggccgaatatccaccacaaaatttaaaaacgggcgcgaagcgcccgtcctgaggccgcgaagcggccgaatgattactacaaaattaaaaaacgggcgcgaagcgcccgtttgaccccaacaaaatttaaatcgggtgcgaagcgcccgtccaagcccaacaaaattaagaaacgggcgcgaagcgcccgtctggccccacaaagtctaaaaacgggcgcgaaacgccccgttctgaggccgcgaacctgaagaatgttccccacaaaattaaaaaa

SEQ ID NO: 29525 - DNA, 1141 bp, Heterodera glycines
  misc_feature (978)..(978): n is a, c, g, or t
  misc_feature (980)..(980): n is a, c, g, or t
tcttttttctcattttttaccgcaaaattaggtaccaacatcccgccttctcttgtctggccctatcaaacaatcttacgatattgaaacgcaaacaaaaaaaattcttgaccaaaaaatggctatctcttttttctcatttttttaccgcaaaattggtaccaactgttgccttctcttgtctggccctatcaaacaatcttacgatatttgaaacgcaaacaaaaaaaattcttgaccaaaaaatggttatctcttttttctcatttttttaccgcaaacttggtaccaacagttgccttctcttgtctggccctatcaaacaatcttacgatattgaaacgcaaacaaaaaaaattcttgaccaaaaatggttatctcttttttctcatttttttaccgcaaaattggtaccaacagttgccttctcttgtctggccctatcaaacaatcttacgatatttgaaacgcaaacaaaaaaaattcttgaccaaaaaatggctatctcttttttctcatttttttaccgcaaaattggtaccaacagttgccttctcttgtctggccctatcaaacaatcttacgatatttgaaacgcaaacaaaaaaaattcttgaccaaaaatggttatctcttttttctcatttttttaccgcaaacttggtaccaacagttgccttctcttgtctcctatcaaacaatcttacgatatttgaaacgcaaacaaaaaaaaaattcttgaccaaaaaatggctatctcttttttctcatttttttaccgcaaaattggtaccaactgttgccttctcttgtctggccctatcaaacaatcttacgatatttgaaacgcaaacaaaaaaaattcttgaccaaaaatggttatctcttttttctcattttttaccgcagaattggtaccaacagttgcctttctcttgtctgggcctatcaaacaatcttacgatattgaaacgcaancnaaaaaaattcttgaccaaaaatggctatctcttttttctcattttttaacgcaaaaatgggaccaattgttggcttctctttgcctggccctacaaaaaaattacgaaaattgaaaaacaaaaaaaaaaattctggacaaaaaagggtttttttttttttt

SEQ ID NO: 29526 - DNA, 1096 bp, Heterodera glycines
  misc_feature (67)..(67): n is a, c, g, or t
  misc_feature (99)..(99): n is a, c, g, or t
  misc_feature (1075)..(1075): n is a, c, g, or t
tttattaagtaattattgcatctgattaaatataaataatattcatataattccgggctctcttatntactcaatctataattgaactaaatattttgngcatacagcaaatattcgttaaacaattttaaataagaaaatattcaattaatgaaaattggttcaaatgtcgaaaaaattaaaaatatataattattttattagagaatatgttttatcaataagtatgccatttttactgttgattgattaaaaataaaatgacaaaaaataaagtacaaaaaactaaaaaataatgacgaatgcacaatgataaataatttgttcctgaccatatataatatttatatgcatacacattcaatataattaatttaaatgaaaaacaaatactgactcataaataaaaaaaataatttatttaaattaaattagttcattaataaaaataataattgtttaaaaattttaattaataatcgtaaaaaacttacgaaaactgccaatgaaatcatagtaaaaattttaaaacatataattttcacatgaaaatcaaaaaaaattttcctttcccctttttggccgtgagattaaaaagcaaaaagagataattaatattcaataaactaattttacaattaattaaataaaagaaataattaaattttttgaaaaaaattctgatcggaattatattttttataaatttattattcaattatggattaaaaaagcaattaaatagttaactttttgaaaaattttccaattattatggatttttgaaataaatcttttttaataggcgaaatttttttttatatttatggttgatattaaggaaatcccacattaaaaggtattttcgcatttatcgacgaaacaagttgcaggaataattttaaaaatatataaatcttataactatacttaattttttatttaataaaaataattctttaagcagaactattattcagtctaaataaataaaatttaattcgttaaattacctaaaaaatcccacgtaattggtacttgcatctaaatatgtaatcacatttattaatcaatnaacttagatttctgaatttat

SEQ ID NO: 29527 - DNA, 1534 bp, Heterodera glycines
  misc_feature (1464)..(1464): n is a, c, g, or t
aatacatcgttggccatactggctgactgaccttgactgttctgcagttttttgtaaccatcacgacccgaccaaatgtaaatgcgcttgttgatcaccgccgaacaatgcccagcacgggcagttggccagaagtctaaaattaaaattttgaaaaaaaggtaaaacaaatgctaacacgtttgtccacacatgccaaatcaatttggacttccaattatttgcacgaaaacttttttggaaacttttttgctaaaaacttataattaattattctcaccataaaattttgaaaaaccactaatcaagcgattatttttaaattttatttatttttaatttttttctaaaaaatcgccaaaaaatttctctcattttttcatgaacttattaaaaaaaaaatttcgtgtggggctgatattggggaagaatgatggcggcagggaaaccacctgctgctccgaaccgagataagcaacttaccagtggaatatgttgttgctgtcacgggcgttggagggccgagggaatgttcccaacggagtgtgctcaaattcaacaccgccaatgtgttggtgcatttccaccccttatttggacgctccgagttgtcgtcagaatcatttggtacccaaccgccaaaaatgaacatgctgaaaatttgtaaaaaaaaataagtctgtttcccacataagaaaactttggaaaatcccaaaaaaggggaaatgaagagacccgtaaaaaagcaacaaaaaataaaaacaaaattctaatttattaataaacgcgtccaaacgcaccgattttcaatcaaatttgcggtgtgcagtgaacgcggcaatggtccaaagccttgcggtagcggatttgaccaattcatcgattccaaatccaaaatccacacatcaccaagtcgttggccattcatcccaccgtagatgatcaactgctggttgcccgtgtttgttgtgaaataaacggcagtgtgcgattcacgcgttggtggcgattgacaatttgtctgtttttagtggtcaagttttaattgctttaagtgtttttttggtattttttagtcgcatagaaatgtaaatttcatttcgtacaatttcaaaccccccgacgagcctctgaattcgaacaaaaacagaaaatccaaaattttcgagttttctcatttttggccaggaaaacaatttaaacattcaaaaaatagtcaaaatggattagtatagaattaactctcttttctttgcaatttaaaacaaattaatttggttatcctttttgttcgaattaaggttcgggttggggtattgtccatatttgaacaaatgaccccaaaacatgtactggactaacttttgtgacctatcggtactgttacacaataatgtacaaaaaaaagtagcaaaaaaaatgccttgggacaatgccaggaaagaccgcttggagcagtgctcnaatcgatggcataaaagtcgttcagatattctggcacattctctctgcgatccgcgctggcattagctag

SEQ ID NO: 29528 - DNA, 1190 bp, Heterodera glycines
  misc_feature (88)..(88): n is a, c, g, or t
gattagcatcgggttacgagatagaatatgtcctaaaaagagatagccattttctgagaatatttcacaatttccgcagctctgcggntaatggaaaaaatttgaagaggctctgcggaacagattagcatcggggttacgagatagaatattgtcctaaaacgagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttacggtaatggaaaaaattttgaagaggctctccggaacagattagcatcggggttacgagatagaaaattgtcctaaaagagagagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttagggtaatggaaaaaattttgaagaggctctgcggaacggattagcatcggggttacgagatagaaaattgtcctaaaaagagagccatttttctgagaattaattcacaatttccgcagctcttacggtaatggaaaaattttgaagaggctctccggacggattagcatcggggtacgagatagaaaaatgtcctaaaagagtagccatttttctga

SEQ ID NO: 29529 - DNA, 936 bp, Heterodera glycines
cgacattttcggtgtggtactccctttctgggaaacggacgaccgaagcaagtgatcaaggtttgcttgttttgcgtatttacttccctgacagtgaatgatgagttgatcatagtttttcagtgccatttgacatgcttttatgattaagcaaaaaaaaaaaaaaaacggttaccaaatttcgagtcgaaatgtaaaaaaattaattcaacaataaaagtattgatgttcaactttttaggggtgcctgtccctcctgacattcttattcctattttgattgcttctcataatttctgcccattttcggtggccttggtttgttcatacaaggacacggccgattggacggccaaagcgaccggcacagtgaccatgaaaaaatggcaggacaaattgccaaagtgcagcggcagccagcaacatttggacgagctcaaagaggtattctttacggcgtacttttctatcaaccttatagagaacctgtacatacgaaatattttcacaaattggatcacaaaatcttgttaattgatacgaaaatgattataattgttcaattttcattgtttcaacgcctcccttaaatttagcacttctcgcgcaaattcaccaactcccagccgaaaatgattatcactaaagacttcccgttgccccctctcctggatggcggcagtgcgcgtgttcttcccccctccactggggcggcggcggacgcgcaggcgtacgtcagcacgaagagcaagcgggtcaagttccggctggagttcatcctgcacaacgtgcgcaagaggttggtttgttttgcagtccatgcattttgaaaaaggggtcattcaaaattgtcagtattttttaatatattgctcaaaaacgactgaatttcgtgtatttgagtcgtcaattaaaaatttaagaagaattggtggg

SEQ ID NO: 29530 - DNA, 982 bp, Heterodera glycines
  misc_feature (938)..(938): n is a, c, g, or t
  misc_feature (944)..(944): n is a, c, g, or t
  misc_feature (959)..(959): n is a, c, g, or t
  misc_feature (964)..(964): n is a, c, g, or t
tttcattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgaaaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaatatacccctgggagaagggagtgngaaacnatgattcaaattttncattntttctagtctatctactc

SEQ ID NO: 29531 - DNA, 1317 bp, Heterodera glycines
  misc_feature (1288)..(1288): n is a, c, g, or t
aaaaacttagtagttcatcataaaatttcgaaaaaatcgctgaaaatttttcttgaaatttttatactaagaattttcatacgagtttttttatgaaaaatttctaggtttgaaaatttttttaaaaaaattttcggggggaaacgacgtgggggggggaaatgaagtgcacccagggaaacaattggcttaaacgaaggcggggcaaaagcatgtcaatttgaattaaatttgaacttggcattactttagctttgctcctttttagtatcgaaaagatgagcatggaactgaacaatctttcggcactttactcggccaaatgtcttgaaaattccaaattggacgaagaaatgcagaaaatgctcagagagcgtgagcagaaaagtaccaatacaaagtgggctttttatttattttttaatattttattttgaattttgctttcagcaatttggatgccatcaacaaacgccttcagagggaattgcgtcagaaggagcaaagcatcgatgacctcagacagcaaattgcatggcttgaaaagaagctgaaaatgagcggaattgaagtctcggagcagggtaagccgcacaacaaaagcacttcgccacaatttatttaccaatatttttaaattcaaatggtgacgggctgtccgcggtcaccagccatttttattatataatttatttgtgcacgctgagcaattttgtttccgcttttcacttcattcccttttctattcgatttcagagctatgcgacttcttcaaacggttagtggcgataacacattacaactcgtcaaacactttccatgcttttgcttttattattatttaattagtaaaaaggtttctgttcactcgtcaaagcattgcgcggcatttctcatgccaaacttttttaagccaaaaatgccgttactggctaaatctgttgaggagcatttgtacataaatgagaaatgtgacgcgcatgttgatgaatttaatttgaattgtgaagtgcaaattctcccccatacagtccaccgaggagcggacgctcgcgaagccgagcagcggggatcaggaatttgctcgcaacaaccgcagcagcaaaagcaatcgcaaaggttgatgacaacaacaaatgcgaagggtttgacgaaggcggcgatggtggacgacgagcagtgcaaaacgccaacaacagcggcagaagcaacgacaaagaaacagcagagaaacagtccgttgcaggagacgacgcccgtgaaagtcagacagtcgcccgcaagcatncaacaccagcagcaacagcggaaagactg

SEQ ID NO: 29532 - DNA, 1252 bp, Heterodera glycines
aaaaaagaaacaaaacaaattcatccatttgttagctcccgttggcaaaccgaagggtacatggggcaatgggatgttggcttcccgtatcagttattaaaatttttgtttttaaaaaggatactaaaactgggataatcccattcagagacaagtcaaaaaaaataataataggcttggactactatactaattagaaattttagaatgtgtctgttaaatgcaaaactgttgtgaaaaattgttataactcctttcagagaagagatagaaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttggcaaaccgaagggtacattggggcaatggatgttgggctaccgtatcagttattaaaatttttgtttttcaaaaaggatactaaaactgggataaccccattcagagacaagtcaaaaaaaataataataggcttggactactatactaattagaaattttagaatgtgtctgttaaatgcaaaactgttgtgaaaaattgttataactcctttcagagaagagatagaaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagacaagtcaaaaaaaataataatagtcttggactactatactaattaggaattttagaatgtgtctgttaaatgcaaaactgttgtgaaaaattgttatatctcctttcagagaagagatagaaaaaaaataaaaatagggttagagagcccgcgaccacctgcatcggatgcaagtgccgccgttgctgtccgcctaacacattggtgagcaatgccggagaattttttaacacccccgccccccccccccccccgcccccgtccctcgcccttttttttcattggcacagcaatcggcataagcccaagcattagcatcatccagcagggcggcacagtgaagcg

SEQ ID NO: 29533 - DNA, 999 bp, Heterodera glycines
gcttttggaattttaatgagtaaatcagtaaccgtaaatgacattctatgcttctcttgttggatacaccgggaagaaataatagttagtccttttgttgaatttttagaaattctatccgtccaatcggcttttggaattttaatgagtaaatcaggaaccgtaaatgaaattctctgcttctcttgttggatacacgggaagaaataattgttagtccttttgttgaatttttagaaattctatccgtcatatcggcttttggaattttaatgagtaaatcaggaaccgtaaatgaaattctctgcttctcttgttggatacacgggaagaaataattgttagtccttttgttgaatttttagaaattctatccgtcatatcggcttttggaattttaatgagtaaatcagtaaccgtaaatgacattctatgcttctcttgttggatacacgggaagaaataatagttagtccttttgttgaatttttagaaattctatccgtcaaatcggcttttggaattttaatgagtaaatcagtaaccgtaaatgacattctatgcttctcttgttggatacacgggaagaaataatagttagtccttttgttgaatttttagaaattctatccgtcatatcggcttttggaattttaatgagtaaatcagtaaccgtaaatgaaattctctgcttctcttgttggatacacgggaagaaataatagttagtccttttgttgaatttttagaaattctatccgtcatatcggcttttggaattttaatgagtaaatcagtaaccgtaaatgacattctatgcttctcttgttggatacacgggaagaaataatagttagtccttttgttgaatttttagaaattctatccgtcaaatcggcttttggaatttaatgagtaatcagtaaccgtaatgacattctatgcttctctttgtggatacacgggaagaaataatagttagtccttttgttgaatttt

SEQ ID NO: 29534 - DNA, 1293 bp, Heterodera glycines
  misc_feature (1212)..(1212): n is a, c, g, or t
  misc_feature (1236)..(1236): n is a, c, g, or t
  misc_feature (1285)..(1285): n is a, c, g, or t
gcggcggtcctcgggatggacaccccgaagggaaaatggcggcggaagggaatggaacaaaagattgcctgccctttgccattgccggcaaacaccagcagaacatcacccacttgctcctcatacctcctttccttctcacggcacttttctcgcaaggaacagaaaaaagggcaaagcgaaggggagcggggagagaacgcaggggaaaacaaaacaaacaaacataaccaatttaaaataatttaataagaccaaaataggcttgttgtcctctcattatgtcatttgacccctgcttctagccctctccgggggcaggtaaattggacaccagaaaattggacaccaagcggaaaactggacaccgtcggaattttggacaccaaaggaaaattggacactggaaaactggacaccaaattcctcttttaaaaaataaacacaggaattagcttgaaaaataattggtgtggataaatggattaaggcatttagagtcgatcaaacattaaataggcacgattattgatcaaatgtggcaaaaagtgtacgaaattaggcgatgattggttatgccaaaaaatgtagaaaattggcgatggttgttcaatgtgccaaaaatacgcaaaaatgggaacccgatcaaaatgaaaacttttttcgttatgaatgtatgatggcgttctgctgctgatattcagatgggcctaacgttaggcaaggggtaatataaagggtatattcgtattcagcgaccccgaaaaccctaaaaacctaaattagactcattttgtttttataaattttgaaaaattttggacatttcgtgggtttttactcttttggacatttcgtggcttggacactttgtgggggtgccctaattttccattggtgtccaattttcggtgtccaatttaccgggagcccttctctcctgctgcgctcgcctctctttctctatcgctctccctcttccctccgctactcgttcccctctttctctcctcctttcccacctcatccctctcccttctctttccccttccttacgctctttctgctttcttttccctcactattctttacctctgaccaaagcggaagacacccatttgaatcagttaaatggacgtgggagaaaagcaatggaaatgcgggaaaaggacgacacgaaatcttgacacgaaatcttattatatctcctcncagagaccaaaattaagaaattgngaaaaggcaaaggcaaagaatatgcatgttggcatttgtttcggctggngaaagggc

SEQ ID NO: 29535 - DNA, 1188 bp, Heterodera glycines
  misc_feature (16)..(16): n is a, c, g, or t
aaattcatcattatanttggtgattttttaaattgtttcttttatcgactaattttgcaattttccttttaattcaccattgtgtattcattaattgccgcgttctaaaaagtatttccttcccactaattatgctttttcccacccaaaacgacatcttcttatcaattataatgctttatcagaaataaaattgttacaaagtgtgaccaaaattcaaaagtttgaagtttggaccaacaattcccttgcccataaatggtcgataacacttttgcataggcatagagacaacccgaccgccctccctgatgttcggtcgtaaaaaattaggataggtgacgatgatcggttcataatctcctctcttcgcatagttgatcacttcctatttgaaccgttcatagcacagtccctggttattgatcacgtcatagttgaacgtcatcccacggactttaagcacgtactccggttcaacatcgggtcccgctccctttcgccgcagacacaggccatagttaatccatttgttataacaatttttttaaaatgctcaaatttacctgttttgatcctccactacagtactccacgatgtcatggtcggggtattcatccgtaaactgacccaagtgtggaccagttttgagtgggcaacgctcttccggatgcacaaggatgagactgtcggtgtcttaaatttaagaaattatcttacattttttttgttcaagtacctgtgtacagtagctcacatcggtcagtcctgaccaccttttgcattgccttaagcaggacaagccgcgcagctgaagttgtccacaaagaaattactgtaatttattaactgaaaaaattttgaagagaatttgtcaccaatgtttgagcacgcgtgctcatgcacccagtccttcttatgcaggtatgtgatgagaatgtgcttctcatccagctgatcaatcgatgaaacttcaaattaaaaacttaattaaaacaaagtgtttacataaattatttaagcacagttttgcagaatatattttaataagaaataactaaatgatcatagaagcaaaagttaaatgataaaatgagaagcaaagaattataaatatatgaaagaaagcgataataaaaattaaagtcaagtaactgatgtgatgaaaataaaagaaataattaatt

SEQ ID NO: 29536 - DNA, 1253 bp, Heterodera glycines
  misc_feature (1209)..(1209): n is a, c, g, or t
agagaaaagaccgaaggtggaagagagagaaggtggagggaagagagagagagagaagagagagagatggaggagagagagaggagagagatagagagagatggagaggagagagagaggaagtgagtagagtggaacgagaggagagataaaggagagagagggagagagcgagaaagagaaaccgcgatttttcttgagaaacttcactctcgaataaaaaccatgcctaattaagcagtttctgcctgccgtttcggccgccggcttattccaaacccaaacggctggcggcaacgctttgttcaatgcgggcgcaaccgcgatgccaagcgtggcggcaaattctcttcaaatgttgcagcaacaggccgctgccgcgcaacaatattccgccgccaccggcacgccctcattcattagcagtgtcagcggtggcaaatgcggcgccgaataccagacggtttccgtttccgcgtccggtacgcagccgcaagcgagcggcaacaatgcgtccggagacccggcaaccgctagtggagccggctatccgtcgggcgcgtcggttggcattgttggcggcagtggcgccaacggcaccagcggcgttacgccgtacgcgcagttgctggccatgggtggtggcggtactggtgccatggttgacccggctacggctgcaaccgctacgcttatggcacaacagcaggcggccgctgccgcggcaattatggcacaacagcaacaacaccagcaacaacaacagaaccagcagatcaactgtatgttgttggatttgtgctggaattttgggctagaaagttttgttcggttctgatcgggcctctgtgagatggtgccaccaatcaatccttgatcgaatcagaccttttgaagatatttcatgctctgatcaattttttagcaatcattgttctgatcgggaactttaagcaattccatgatttgctcgggctttttcagaacttgatctgatcagtcctgttttaagcatttccataatttgatcacctttcccagaaatcattgatctgattatatttttgagcaatctttgatctgagcaggccgaatcgttttttattccggcatgatttgatcaagatttagctttttgctcttcgatcacaactttctgtcattctacactcgctcaaaatctatcgtatatatatatatatgtaattnttttttcttactgtagcggccgccatgtacagttatgccctgca

SEQ ID NO: 29537 - DNA, 2232 bp, Heterodera glycines
  misc_feature (12)..(12): n is a, c, g, or t
  misc_feature (37)..(37): n is a, c, g, or t
tgcaggtcaaanttgaaaaaatttcaaaatactacgncttttaaactaccttcaaaaattctcaagtttggcttttgaaaaagctgttttgtcattttaacttctaacctatcatatacaaaatggcacaaaatatttggctaactttcaaaagtgccgagaaaaaactttttgaaatggtttgagttcgaagtataattcttccgcctcgccccttccttacttgaaatcccttttgatatcatccaaattagcgtatccattgaagcgcgatgccaaggtgaacagcaactcctcctggatggtcttcagcctttggcacttctcctccttgctcattgtcatttgttgtgctcctccgctcattccgtcggacggtgccatttcaaatgccataggttcggctcgccccgtcggttggcttctcagttcctgctccatctcttcccaaaaagtgccgcttgtgctgttacttgccgtgtcattggccacgggcagcccattctcatcgatcaatggagtgctcacccaattcgaagaagcctcacccatcattaatgggcctcttcctccgtttgctttagcgaagttatcgaaaatacttggcattttcttaaaaacaaaataggtatacctaaccatccgattatgggtccacacatgtttaaatggtgggtcaactccgtgtccatgttttaaacaaaacaatcataacaccaaacctggccatatttgtgcaaaattcaaaatgcattgatcaatgccctttttaagatgttatttcgataggctatagctcgcttcagctttagctctaattaaactgaacaattttagtatcgaaagagatttctaagaaaaagcagaagatttattcgtaaaaaaaaagttaagatatttttttcgaattccgggtttataaatttttagtttgcagtcaaaattcagatgaagaagaaagtatcaaactatgaaaataatcccataaaacaaagaacaaaaaaaagcattttaaactcgagcaaagccaagacttaaaaagaagcataatgatatgaaaaaagcgaattatgaacttttaaaaaatgactaaagaggggaattcggcaatttggaatgttaattaattaggtaattaattattcataacaatctctgagtgttttattgccattgtccaaattgcctaaacatgccaagggcgaggaaggagcacaaagggagggaaagaggtgaaattggcgcgattcattgccatcccatcgcatcgtaagtcatttgtgcctgatttcgcctgccattctctttgtcggtttaatatttgttcccattgcgcgcgcatcgcttctcccaacgcattttccgtcatcggtcgaaatcgaacgatttctttttggtcttccgccattttcgtggccttccgaactttgccttctattacgggtcgtcctcaacggaagttccatctgatgggattccctcgcccatttctcaccctttgaagacatttgagcggagggcacttttggaaatgatttttggattaatgaacaaagacggaaagtcagcggagggacattgccgcagtgcaatttggggttgggatttgcggagtgccggtttctgaagggaaagggggcgagggaatggagggattgtggcacaagcggaccgactcctcctggatgagaacatcatctgacatccctccacggtgcatctgaaccgaacagtcggtggcactgggacagattcgcgcacccccttcccaaccccgttttaattgatcctctccctccttaattgccccttaattatcaaattaccccccccccccgcccacttgtgcatctctcgcaaatgcaccgcactgttgtgtatcttcagtgcgcccttgtcgcagaaactctttccgcactttgcgcatttcacccgcttcttctccgccttcgtccgcgcctcccttcgcttctgcgtctctctccgttccttctcctctttcttctctctcttagcaaatgcttttttgtcttttgttttcctaaatttacttaatatttacctttttggaagaaaaaccttcgcccataagaaattcaacagtaaaattttgtgacggcattttaggtgaaaaacgcacaaaaaaatgaggagggaatgttgtaatgagacatggaaatggcagggagacatggcactgacagacgacggacggcgggggggggggggggg

SEQ ID NO: 29538 - DNA, 1600 bp, Heterodera glycines
atcctcattcaccctctcctttccgaaaaattctttgcttttcgaagagtgattattatagcaattaccaaaattatatacaaatagaaatataattgagaaaattcggatgccattctgagtgattttgagttaattgtatatgaatttttaggtaatttattagccactataatttaataataataataattttatcaaacattcatgctaatctgcatttcattgtcagtttaactttgattttttttttaaattagcattaggcttgcttgggcctaggcctatgctttattttaaaagttatagttcaaccagatgatcaatttgatatctgttgagcatttcattcttacactgtattaatacaatactcttattgctaaattaatatttgtattttttctacatcatgtattttagcaaataattggaaaaaactgtttttcttgtaaattttcatcttttaagtgttagttcatataattaattacccccgagaaatgaaaatttccgattaataaaaaaaatttaattgaagatgaaaagcacaacaggattaaaagaacaattttatctgctgaatatttcttcttcaaagagttgccaaattgaacttaaaattgggcccaaaatttgcctcaatttggtcatcagtttcacgcaaagaaacgaatggatgaaaagaatcatcagcaaaagatggatcgtcgaaaaaaccagcagcggtatctttgaaaagtaatgaattttatcaacgatttaaacataaaaatcaattaaaatataggcaatttaaaattttgtttaattattttttatttgccaacccaaacgaaatccatttttggtgaaaaagagctgtcgagtgcttaaatgaacaccaattcctacggtatcaccaacaccgtaggaatatttggcaattgttcctttttcttttccgttggtccaaattttgccatcactttcatatgagtaaatgcccttttcattttgaattaatccatccaattttatctgctgtttgacggcgaatccaaagctgatgatatacaaactgcaaataaaaaattaataataaaggaatataattaataataattcaaattttataatctgattaattggaaaaatataaaaaataataattacttattcttatttttgactgaaatttcgtagtaaaaaatgttagatgaatccttgttgagcaaaatcgaatatttagcgaagacagaacaccaacctttttagaagaaatagaatttatttatataattttaaaaaataccataagaatttcttttataattgacaatcagacttttgttgtcaattatttcgagaaacctatgacaaacatttgcatcccaataatttggtagtggaaaattgagaattatcttaacatttatttcaattaaacaaattttaaaataattttgttctcttttttcacctgaacttttgcggggtcgaatttgaattgcggtccaaaatttgtctcaatcaaatcgccaaaatcactcaaagaaatgaacggaaacaatggaaaaatcaaatgagggcgaaagaataaatcggaagtatcttaaaa

SEQ ID NO: 29539 - DNA, 1725 bp, Heterodera glycines
  misc_feature (19)..(19): n is a, c, g, or t
  misc_feature (826)..(826): n is a, c, g, or t
  misc_feature (1343)..(1344): n is a, c, g, or t
ggatattcaaatcggaaanatatttgacgaaaaatggcacaatatgcaaaaaaaaatctgaaaatatgttcaaaaaatggcaaaatatgcatgaaatatgcagaaaaacccaaaatatgcaataaaagttccgaacttttatatgcaaataccaaaaagaagatgtttttcctactaattagacaacgtagaatccaggaaaaaatatgcatttgcatatttttgacgccctggtttttacaccacaaatttttttttcatttttctaaaatatttgctaaatatttcggacttttcaatattttaccaatatttagttgactttttcgtaaataactgaaaagaaactttgttaaaaattatcaaattaaatttggaaggcaaaattaacctttgtttattaaatgatttgaatttccaattgtttgttcatcactttgctgcaattcttcttcattttgctgttcatttttaattggattttcacaaatttcttttttcatttcttcgcttttttctccctcaatttttataaatattttcccaaattttccctcataattttcattttccgattggttatttccgatctgttcattattcttcacccttttctgctgctgatcaccatctctttcttgctcctctttgatttttatttgttcaaatccgcccgatttttgttgatttgtttttaaatttccccaaagttgatcaaaaagggcatcattttcagtgtcctcaatagccattaatgatggaaaatgaaagcaacaaagaaaacttatgagaaaagaattgaaatgtttcatttattttgctttanaatgttagtactgtttttatttatgaaatgaaaaggataacatttatttattttgcaaatatttatatgaccagaatcaatgaaaatattttcattgttttgtcatctgttttataaaacgtggcaataagtaagtaagttagtggaccataaatgacagaggaaatttgtgaaaaaattgtgattttgcaaatttttaattgcttagccaaaagccatacatggatttcttgccggggattggatagagcgtgttgcgactttttcgccgctcagcaaaatcgacacttacgccgtaaaatttgcgcgcgacatttgcgcctggacacgcgccgccaagcaaaaatggacatttgcgtcgctcaccagtcaaaaaatattttaaataaaagatttcaccaaaaattgtcaaggggatcgaccacctaaactattatttcagcggctttgtttcgctgagaaatgcacgaaaaaataggtttttagctcccggaaattatcattttaatcggttacnnctcagttgggcgcgccacggttggacgccggcacatgtttttccactatatctcttttctttgacatccaattccaacaaacttggtttcattcaaaaactcttcacatactctactatcctgcattcaagacatttggctaattgtgaactcctcctatgtttcactaggtcggattctttgtctctatgaattcttgctgtgcccaactgctgcttccaacctatactatgtctttgtgatgtctctggacttctagacgatgcattcctcgttcacatggatatgattcccatgggcttcaatcaatcaaacaatcagttaattgacttattgataacaatttactagcttcacgctgcaccttctcaatcagatcaa

SEQ ID NO: 29540 - DNA, 869 bp, Heterodera glycines
cggtacattcctgacgccccgcccctcgcgcaccccaagacttgcgcagcaaaactcgcgcaacccttgtccgattgacttcaaatttcacaggtcgtcaatccagcagcctctaagctgaacgacgaaagaatttcatctctgacaccatttcgagcagtacattcccgacgccccgccccctcgcgcacccccgagacttgcgcagcaaaactcgcgcaccccttgtccgattgacttcaaatttcacaggtcgtcaatccagcagcctctaagctgaacgacgaaagaatttcatctctgacaccatttcgagcagtacattcccgacgccccgccccctcgcgcacccccgagacttgcgcagcaaaactcgcgcaccccttgtccgattgacttcaaatttcacaggtcgtcaatccagcagcctctaagctgaacgacgaaagaatttcagctctagcaccatttcaagcagtactttcctgacgccccgcccctcgcgcaccccaagacttgcgcagcaaaactcgcgcaacccttgtccgattgactttaaatttctcaggtcgtcaatccagcagcctctaagctgaacgacgaaagaatttcatctctgacaccatttcgagcagtacattcccgacgccccgccccctcgcgcacccccgagacttgcgcagcaaaactcgcgcaacccttgtccgattgacttcaaatttcacaggtcgtcaatccagcagcctctaagctgaacgacgaaagaatttcagctctagcaccatttcaagcagtactttcccgacgccccgccccctcgcgcacccccgagacttgcgaagcaaaagtcacgcaccccttgcccgatt

SEQ ID NO: 29541 - DNA, 1129 bp, Heterodera glycines
atagtattattatgatttaatataagtaatattaataatagcatatcaattaaaagatcttggcatgtatattcatcatatttgcgcagtgcttcataagtataattgattatataaataaacctggctacatataatctatgaattcatttaaaccctaaaaataaaaatagtaacgaactaaaacaattatttatttaatgaaaaaattaaaatttttgaaaataaaaagcactggaaataatatagaaaatgtattgatgtaaatatatttgctaaacaaaattgtattgggtttagaaaatttatattaataaacaaataccaaaattaaaaaattgaatttacaaagccaagactaaaaatgtaaagtcaatacactgaaattcgttaatgatgagtgttaagaaaatgggaattgatttttttacgaattttttaaaactgttcaaattttaatttttcttttgtatataaaaatataccattaaacaacaccatcagcaaattttttttaaacaaatattttattttaaatcatttaaaaatgaatttaatcgctgaaaatgtaataataatttgagtttaaaaaaatataaaataattatttttaaaagaattaaatataattcggtaaaagatcaagaaaattgaattattatcaacgagaaatgttttaaaaatgtatgtaaattttatttaaaaatttaagaatttaacagttataataatgtttaattttttcaaccataattaaaattaataaaaataaaattttaatttaaaaggttaaaatatttggacaaattatgtaatataaaagaaaaaaaagattaaatataatattgactaagtttataattcaataattaaaagtgcaaacgataaaaaattaatttttcagataaactattatatatttaattaataaaaaagcaagaaattttctttttaattaaatatcccattaattaaaaataaaattaattttatgccgaatctcaaagtcccattgaaagaatgaaacttcaaataaaatattaaataaaacccaaaaaacaataatccaaaaacatattatttctataatcacaatataaaaaatgaataattttatttattaattttt

SEQ ID NO: 29542 - DNA, 944 bp, Heterodera glycines
  misc_feature (931)..(931): n is a, c, g, or t
tagtctcagtgtcaataaaatatttaatttaatatacacaattcaattcggtctcgaaaaataataaatttaattcgacaattattttaaaaataaactaaaaaagaatactacaaaagcattccatctccgaacaaaaaaaaaaaaatttacttcaaaccaaaattttaatttcaaatcttgacccattaaattgattggcaagtaagtttactagagaatttttcatttttacaaaaaacaaatctactaacttttttctgaaagttcacccaatattaagtaataacttcttcattcgtttcttcataaatttcatgaattttttcgcttaatgatacgaaagctagcatttattttgagcagaatactggaagaaaaaacagtgaaaaaagttgaaccatgaaattacattattgttatttgaaaattgtaaaattatttattaatattcaattaaaaaacattgttttagaataattaaataaaaattttattcacaatgagactatttttggttcgccaacactgagattatttttcggtacgcctttactgagaacatttttcggttcgccttcgacctagcatataaaagcatattttgggggtcttcaagaataaatgcaaattttgccatttttgggcttttagaccatattttgggcattttttggaaattttcacaagaaaaatgcgaaaaaagcgaaaaatacacccttaaggatcgattttttggggatttttaaaaaaatacatccttaaaatcgataaactttagcttttgtataacttttggaaatttttttttatttatttaagaagtgtaattttgttttttcagcatatagtaaaaatttaaaaatttggaaattcaaaatttttgcaattgtctaaaaaaattgttagcctttgttttggtgttttcaantgtctattcttaa

SEQ ID NO: 29543 - DNA, 1199 bp, Heterodera glycines
cgccctcaaaggcttcgctcaatttcgcaatattagccacaattaccaccagcacagtaacattatcaccacatccctttcgcacagccgccgcactcatttcgtcggcaatttttgtccacagtccaacagaatccttctcctcgttgaactccgcagttttagcaagcattttgtactgtccgatcacaaaatcaatcgctgcgtcgggcgaaaaagccttccaaaggccatcacaagccaaaatgatgaaacttaatgcgaataaagaaaactattaatacaaataaacaccggaagagttacagatcgtctggggttaacgataacttcttgatgtccggggtgcaaattacgccatgtgccttcatttgaccgtcaccaatcgaacgagacacctctaaaatgccaaaaactcggccatccctaagggaataatcaaaaatttgatgaacattccttggatgagactgacttgactgttccgccggacttttgaatacgcattcgttcgtcaaaaacaagagggttgtggtccacagtgatttgcagcggaatatttgtgctcttttcagatttgtgtcgacaaacaatagcctaaacaatggtattatacaaataattgttttaaaataatcatgccaattaaaaaaaatataaaaagatacccaatttcaattttataaaaaggcttttggtttgcaagtttttctcttagtttgtggtgtattcccaaaggcttcgtaatcgctgatcacgaatttgacatccttttagaacaattccgaatagctacacggattaagtttccttttagtcgaaaatgcatgcgatttatgatcagtaatttttaaaatacatcatttttattagcgctaaaaacattaaccttcgagtcgccaatattagcacagtaaagcgttttatccaataaaaaaatggttgtcgccgttgtaccatctttcagcgttggtttcctaattaaattttagaaagcgtgaaatacattatttcttactgtcgtcttgcttcaacaaggaaaccatcatcgataccccttataagtatcgacaaatactttacgaatggatttctcgaatactgacatagcactctttgggggcacatctgtatatataaaaaataatgtttcatagaaattttcccacatttcttgaaaacagcaacgaacaatcgag

SEQ ID NO: 29544 - DNA, 594 bp, Heterodera glycines
ccccccccccccccccccaacggacccgaacaaaagacaaccgccgaacaacagccaagtgagcagaccggcggagtatttgactttggtcagcacctgttggcgacagttggagcaaaagacctaaaagtgccaaaaagggggttaaaacgaatcttttaatggcaaattatcagacattttgcggccgaggcccccagtggggctgtcccccgtccgccatgtacacgtaagtggtggtggtgttgccggccggcgcggcgcccggcgacggttgtggcggggcatgctgggggttgttcatgtttggctgataggcggcagctgtcaaacagagtcgggcataagcataaattgccattgagaggattgatccaattccttgccttgatcagttggaacatttgggttgggataggccgggtatttctgagcgtcgtctaaaacatatttttttagtttttaaaggcgaagaaatcgccaaccgtagggagggggtgcgtttggctgctgactcattttttgctgatgagaataatgaaagcttttctttgttgttgcaaattaagaatggactaaacagaaacatcaaat

SEQ ID NO: 29545 - DNA, 1578 bp, Heterodera glycines
  misc_feature (63)..(63): n is a, c, g, or t
aaatgcaataaaaagaaaaatacaccctaagaacgacccaaaattttttcaaaaaaacatccntaagaatcgaccagaaaattttcaaaaatgcgcccctaagaaatgaaaaatttctcaaaaatttatctccaaaatttatttattttattttcttgacgataatttttgattttgaaaattatgtatatccttaatgacttggcaaaatatttttgctttttgatgaaaattttcgattttacacccctaaattcggaactttttggcacctattttcccatttttagcacctattttgggggttttttagaacctaaaacctacttattttggcagtttttagcacctaaaaatcgaagccctagtaattaattaatttaaacgaactgactcattggatggatctctgatgattcgtgcataaaattaatttggaaactattggcagcattgttcacagtgaaaaaaaaagtgatctgttcatcgtagttaaaaagacttgacaatgcaaatgaaaattggcctttttggctgacctgaaaatttaaatgaaaaattatttaaattttcattttgttcatttcgaataaacaattaattaatcacccagcaccctaattaattgcttcaaggcatatttaaaagcaaaaaatctaaggcaaatgccttcggatcaagattcaggactgtaaaaatgtcgggatcaagaattgggctcgcaatgtcaaatttttcgggtcggggcgacaaaaaaagtcgggattagcacagtcaaaatttttggtgtcggactcagtgatcgggacgagaaaatgaccgggatcgggatttgggtcggaaatccaaaatttcggggtctaacgtcgggcgggatttgtgacgtcccagaccatcagcaatttcaaaaattacttttggcacatttatttcaggctcggccaacaatgaaacatttccttgcacctggaaaacattgaaaaaaattttcatcaatttttttttcaaaaaaaattttacccgcataaaatttattgtccaaattggcattttgtttggaaaattttcgaagctttgcccgttcagcttcacttggtattccgtttcaaaaacggcaatatggatttcatatggttggtttgctttgaacgcataagctttgtagtccgaatcttgacgttttccatactaaaaaaaatcgtttatgagatttacttggataatggatttatttttatttatttatttatttttttgaaaatataggtggtttttgtccaaaatacatgaggatttttggttgtttttttatacgaattgtttgaaataaacttacgtaaaaaacttcaaagttgaccccggttttcggattgattttcatttgtaaaattgtcgccccaactgaaaaaataaaatttaattattaaatttggacaagctcccgaaatcaatcgaaattctttagatttaaacaaaaaaaaatatttttgaataatcttacatttatttaaatttagatcacttaaaacaaaatttttattagttcaaggataataaaatttcaacttaaagctaaag

SEQ ID NO: 29546 - DNA, 968 bp, Heterodera glycines
taaaaaaatgtattattaataaaaccaaacatttaaatttattaaaagtaatgaaaattaacccaaaaaatacaaagaaaaataatgtacaccgcccggcttcgaacttcgcccccccccaaaaaatgatgcctcagaatccccaatcacacagggattctgaggtctaaacgatgtcaaaagtaaaatctgatcacgtattcgtgatcagcggcccaaataacccctaaagacatgtttttggaagatttttgtttttttgaatttttaaaaaattattagaggtttttagtccacatcgaggctcaagacgggcgcttcgcgcccgtttttttaatttgttgaactcatacgggcgcttagcgcccgttttttagcttgttaggcgcttcgcgcccgtttttcaatttttgttggccttggacgggcgcttcgcgcccgtttttcaaattttgttggccttggacgggcgcttcgcgcccgtttttcaaattttgttctggttgtacgggcgcttcgcgcccgttttttaaatttggtgatttgttagaaaaggtattggaagaggtacaacagtgattagaagaggtacaacagcgattgaagagtgattagaagaggttcaacagtgattagaagtggtacaacagtgattagaagaggtacaacagcgattagaagaggtacaaccactgtcgaaaaggtacaataattgttggagaggtacaaaaattgttggaatggtacaataatggttaaaaagggtacaatcatggttttaaaattaaataattaaggaaatcgtttattaaaaagtaagattaaaaattgaatgtaattaataaatttttaaaaataaaataaatttccttttattaattaaaaaaagtgtttgaaaagtacaaggattgaatatttatttaatggagaaattaatataacaaattctaatttaaaaatacaggagt

SEQ ID NO: 29547 - DNA, 1201 bp, Heterodera glycines
  misc_feature (33)..(34): n is a, c, g, or t
  misc_feature (62)..(62): n is a, c, g, or t
  misc_feature (1146)..(1146): n is a, c, g, or t
  misc_feature (1156)..(1156): n is a, c, g, or t
gaaatgaatcagtgtgcagaaagactcagtganntaaggtcaataatctcaactttactatnttcgcttaactaatttgtgaaattgttcacaatttcagctcctcattctaaaaatataaatggtatcagggttggggaaggaccgaatttataaaaagctcaacaaattcacatctacaatttctgttaatttctacaattatttttagaggagaagaaggtaaattttcgaactttcacaagggtgatcgggaaaattgaaaccggaaattgttgacgctaatcaactcggtccttctgcaccactgataatgtttaatatttagactgtaatgagatgagttttaataaatccaagagaatttcggagtttcgactccttaggctacaaaaatgaaatgaatcagtgttgcagaagaactcagttgataaggtcaataatctcaactttactattttcgcttaactaatttgtgaaattgttcacaatttcagctcctcattctaaaaatataaatggtatcagggttggggaaggaccgaatttataaaaagctcaacaaattcacatctacaatttctgttaatttctacaattatttttagaggagaagaaggtaaattttcgaactttcacaagggtgatcgggaaaattgaaaccggaaattgttgacgctaatcaactcggtccttctgcaccactgataatgtttaatatttagactgtaatgagatgatttttaataaatccaagagaatttcggagtttcgactccttaggctacaaaaatgaaatgaatcagtgttgcagaagaactcagttgataaggtcaataatctcaactttactattttcgcttaactaatttgtgaaattgttcacaatttcagctcctcattctaaaaatataaatggtatcagggttggggaaggaccgaatttataaaaagctcaacaaattcacatctacaatttctgttaatttctacaattatttttagaggagaagaaggtaaattttcgaactttcacaagggtgatcgggaaaattgaaaccggaaattgttgacgctaatcaactcggtccttctgcaccactgataatgtttaatatttagactgtaatgagatgagttttaatnatccaagagnaatttcggagtttcgactccttaggctacaaaatgaaatggatca

SEQ ID NO: 29548 - DNA, 1111 bp, Heterodera glycines
caatagggttcgagccccgcccccgcccccgcccccgggggcgggacaggttttttgggctcacccccgcccccgcccccgtgactctgacccccgcaacccccgcccccgcgaccttcacccccgcgggggcacgggggtgaaaatacacccctaagaatggcatattcgtgggaaataagacaaaaaatttagacaattttgaattttttttaactatcgagaaatttttatgaaataaaataaattttacttgttttttattttatttgtggattggtggatagtgcttcaatactaacagtacttttgtcatgagttcgattccggctaacgttttcctttaatttatttattttttctgattaatacagggtttctttatgttcttgtttctaagaaatgttctgatttgggggtaatgccttattttcatctaaaagaagaaaatttctgaaaaatttggctaagttctaacaaaattcatataaattcttaaaattttccccggtggcgcctatcggcaccgccggcccccaaaattcctatattttttcttaaaaattatcccaagctcgcgaattttgctcattttttgtacaaaatttgttaacaaattgcattcaaattttcaaaaaattttcccggcggcgcctatcggcaccgccggaactctcccctcgcacattcatcaagtatttttttgaaaaatgtgcctgcaagaaaaaaaatttaaaaaatctgagttccaattttgagtaaatcacgataatttaatatagttaaaaaacgaaaatttattgaaaaagtcttaatttttttggtgaatatctgttagaaataaatttaaaattcgcccctatcggcacgccccccccccaaaaaaaaatttttttttcttaaaaaaaattacccaaaaatccctaaattttggttactttttagtcgaaatctgtgcaatttatgtcaaaagaaatagtatcgaggcgatcaacaaataaaggaatgtggagccaaagaaatcattcttaaaaaatattttttttgtgagatttttggacctaattcaaagcaaacccccgcccccgtccccgtgggggcggaattatcg

SEQ ID NO: 29549 - DNA, 1596 bp, Heterodera glycines
aactcgctggggggttaagcggagcgggttggcgccgcttgtgcatttgtgtagtttttaaagctgcatccgatggcgttttcagattttgaaaattttcaaaatttttcgagctaggccccctcgaaaatttttcgtttttgaattttattattttttgccgatttttcccaggaaaacggagaccactttcaagcaaccgtttttcgagctctatcgattggtggcatttttgaaaaaatttcaaaattttccggaaatagaaaaattttttggcctgaccgggacatttcagtcccgggcctataactcgtcaggtgttgattttaacgaaaaatcgtccaagagcttttttgtagagaatttcgagctctatctaatgtgctttatccggtatttttatctttaatataaaaaaagatataaaataaaaatgaatttttaaatgcaaaaccaaaggggggaccccatggatttgcatttcatgagaaatttttttgctcctaaaattgccaaaaaatacttttctggggtagtttgaggtgctgaacacgaatatgcactttatattgcgttttggattttttggagggaggtaaaaaaattttgaaaaatcgtcaattttttggatttgggaatttaagtgattctttgaaaattcataactcgcctcaaaatggtccaattcagctcatttaaagcataaaaaatagcaaaaaatcgggagaattttatgagatttatttgaaatttataccgcaaaaacaaaaaaagttattccagaaattctggaaattttctatttttcagaaaaaaatttatatctcggttctgaaaagtcattagagaagagtaaaatactacaaaaatccgcaattttttgctctattatataaattttatttgacctttttatcatcttttaaaataaagatacaaaaataaaagtgattttggcattcgggaccaaagggggtggacatgatttttgagtgaaaaaattttttcaaaaaaatcttccaaaaacatgtctttatgggttatttgggccgctgatcacgaatacgtaatcagattttacttttgacatcgttaagacctcagaatccctgtgtgattggggattctgaggcatcattttgagggggcggggggcaagttcgaatccgggcggtaacacattatttttataagtatttttttttgcttatttttagatgtttttaatttatttaaaatagttttgatttattatttaatagtaaataaatttttaatttacatttttttatcaataattgttttaaattttaaaattcacattgtacctcttctaataaatagggatgcgatttttaggtaagaaaaatcccagaataggtacttaaataggtaaaaaaaaaatctcaaaataggtattaaataggtacaaaaattccaaaataggtaaataaaattttttattaacgatttttagtggaaaaaagcaaacaaaaggggaaaattttggttctatttcaattataaacgaataatttaaatatttttaatatgttcttagaaaacatagacattttaaattaaaaattttgttac

SEQ ID NO: 29550 - DNA, 1442 bp, Heterodera glycines
tgatcggaatggttggcttggccgggaatttgctggtcctcctcgtctacagccatctccaacaacgcttccactccatcagtgtttatctgatggcgttggctgtttcggattttctgatgatttgcactgcgatgtttttgtttgtgttggaggcgtggaggcatcacgggccaatgggtaagccaagggaaaggcggcgaccattggcatttttttcgtatttttcgttgctttttaggtttggcctatgcttacggaatcggcgcccccttcttcttcccgttggcctccattttccaaaccacttctgtttatttctgcgtcggtgctgccattgatgtcttcgtcagtgtcgcactgaaagggccaatcagcgagtcgtactgtacagtgaggtacggtagtacctactgtccgcccttttgtgcggattccgttgaaatttctaaatttaattctctccgaccctaagaattgcgcaaaagttcgttgtggtcacaacttgtctggctgtcctttacaacattccgcacttcttcgaacttcgctcaatcgactgcttcgagacaagggacggactgaacataaacagtctccaaatttgtccaacggaatttcggtaaaagagctgaaaatggacgctaaaatgtgaaaatgaccaattcatccatttaaagcatgagtcacgtgtattactccatttactacacgtacatgtacacggtaagcgatgccatcgcaaaaatgggcttctttgcttgaccatgccacccatttatgcaggtgttcatggccgttggtccgctcgttttgctaattgtgctcaacatttgcattgtggtcaatgtgctcagacgtccgcgcgacccaggtcaaaacagaacaatggcacttaaacatgcaaatggcactgccattaatttgatgcgatggaacatggacgaaggaagacattccgttcagattcggacatcgtttcgctgatcctcgtcgtttgtatgttcattttctgcaattttaccgcacttctcgtcaattttttggagctaacttttgctgaacagcttaaacatgtgcgttctcttatccatctttctgtacattttccgctttttccaggtgatcgtttatttggttgatctgagtaaccttctcgtggtgataaattgctccgccaatttctttgtctatctgatctttggccacagtttccagctgtacccatcacgggaaattttctttggaaaaatcgccgtccggcgcattggaggggaaatggccaacggcggagcacgtgccaatttgttggtaatggtggaaagtgaagaaaagagcaatggcagaagcaacaacaacgccacgtcaaagatcggctcggcgaaatgcttcaaagggacggagaagtcgtcaatttacaaatcattggacagactctagag

SEQ ID NO: 29551 - DNA, 903 bp, Heterodera glycines
tttaatttgtgcgtttttcagaggcgatcatttttatttttaaatgtttttacgaaattttgtaaaaagaattttccattaattttcattttaaacgactccgatttaaacgcctccggcataattttggtgtccatgaatttcgtcagctttaatcccttgctcttcctcctccttttgggtggcataagcgcggtaaatgacggaataaatccaaccgctgaacagcaaataaaccaacatcaaagcaagccaagccgacgcaattgcgcgagcctctgaaaatttttttttggaaacatttaaatttcatatatttttttgtttggtaaaaaaactctcagaaaatccgcaaattttcctgctcctggccttataatttattttgaaggaaaacgccggcgcgcgacagaatgccaaaaaaccggttagaaaagaaacaccaactatgcaagaaccagccaaccgggattttttgagattatttaaaaacggcgggatttccgttatctttgtttaaaataatcgaataccttagaactcctaatagctaagggatatttttgagaaaattttcagaattttccgctaagaattttttaattagagcgaaagttccgactaattaccgaaatgccgattcccggctctaatatgaaatatttcggctggaggagagcagcccttaacttttttttgtcaaaaaaaccaatttttaattgatattttttcgctaaataataaaaataatacataatttttacctgaatcgttcgttgctttgcccgggtgtgcttttcgccaattgtcgtcaagcagtgattgtgggtccgtaatcagaaagtacaaataggttaagcagccaaaaactgcaagagccaacgaaattccctaaataagtaa

SEQ ID NO: 29552 - DNA, 1085 bp, Heterodera glycines
  misc_feature (64)..(65): n is a, c, g, or t
gggtttcagccaaatcgcattactatctacggctgagccctacaaatggtcggtttgaatttcnnatgtagggtaagaataggtattctcagaaaatggctatcccttttttctacatcatttgacatttgggtttcagccaaatcgcattactatctacggttgagctctacaaatggtcggtttgaaatttgcattgtaggtaagaataggtattctcagaaaatggctatcccttttttctacatcatttgacatttgggtttcagccaaatcgcattactatctacggctgagccctacaaatggtcggtttgaaattttcattgtaggtaagaataggtattctcagaaaatggctatcccttttttctacatcatttgacatttgggtttcagccaaatcgcattactatctacggctgagccctacaaatggtcggtttgaaattttcattgtaggtaagaataggtattctcagaaaatggctatcccttttttctacatcatttgacatttgggtttcagccaaatcgcattactatctacggctgagccctacaaatggtcggtttgaaattttcattgtaggtaagaataggtattctcagaaaatggctatcccttttttctacatcatttgacatttgggtttcagccaaatcgcattactatctacggttgagccctacaaatggtcggtttgaaatttgcattgtaggtaagaataggtattctcagaaaatggttatcccttttttctacatcattagacatgtgggtttcagccaaatcgcattactatctacggttgagacctacaaatggtcggtttgaaatttgcattgtaggtaagaataggtattctcagaaaatggctatcccttttttctacatcatttgacatttgggtttcagccaaatcgcattactatctacggttgagctctacaaatggtcggtttgaaatttgcattgtaggtaagaataggtattctcagaaaatggctatcccttttttctacatcattagacatctgagtttcagccaaatcgcattactatctacggctgagccctacaa

SEQ ID NO: 29553 - DNA, 1296 bp, Heterodera glycines
cccgttgaatcgaaaacccgattatcaatagttaaagtgctcagttagctagttgagtgcttccctttgttaattagtcacctaatcactctctaattactctttcaaatgctttttctctctcagttcgcttctgtgggctttgcgcgacttaaccgaaagtttggacaacgaattgctcttttcggcctctcttagcgacgtccgcgggcttaaggaacgaattgaaaaattggaaggaatcgtcgaaaaaacgcagcaaaaatttgcggacgaagcgaaatgaatggaaggaaaagcgaaggataggaaatagtcagaaaaagaaagaaactaagaaagataatgagaaaacggactgatcggtcgaccgcttggaaaaccatcgatcgatcactgcccaatcattggccattgatcagttccgaatcccactccgatcactgtccatccttggccaactgatcagttccgaattccgctccgatcacttcccccccccccctttccgcaacgaataaacccaaaagcactttcccaaaaggttgtccatcagcccaaaacccaaaaaaatctcataatttatgaaaaaccaccaaaaattcactcacttatgcttagtcttttcggtcgctttttctcttccgctctctcctctttcctcactctcttcccaattcatttgcctatttttacgcaattcgtccgtctcctttccatgtaaataaatgacgtcatttgaatgtttttgtattatttgtacctattaatgtaaattcgacaaaacctccgccaaaaaataaaaacctcaaaaacatgtaaattgtccttttgtatgaataaatttgtaaatgataacaaaaataaaattctttttttgtacatttacaataattacattagtaaaattccaatttaatttttggcttttgaggagaaatcattcgaattattaagcaaataggaaattggaaggaaaggaatggtccgccggcaaaagttaaaatggacggaaactttggcatttataggggggggggaaggtcaaaactttttgaattcgagagttacacggtcagtgccatcttcgcatcggaacacttgcttgccaagttcgtctcggaagtcggcgtgcggaagttcgaacaaacggacgtagcccaacttcgaaaagagctgaaaaggaattatgactattgttctttattctctgtccattcccttgaatcgatcggtcgatgattcaaccgattgacccatccatcggatctgtcggttgatctttcagcgaccgat

SEQ ID NO: 29554 - DNA, 1553 bp, Heterodera glycines
  misc_feature (72)..(72): n is a, c, g, or t
  misc_feature (91)..(91): n is a, c, g, or t
  misc_feature (119)..(120): n is a, c, g, or t
cgcaaagcgatggttgatcaataccttaaaaagaaataaaacaaggagagagttgtggaaaaactagaaganaatggtgtcgacctaagcntaagggcgttagatagacacctttcaannaataagaagtagaatcggaaggaattcaagaggacatggaaaaagcagaagtgtcacaatgtttttcaaaatttgacaataagtttctcttcataattggtcacggtgatgaatatcgaaagtttaagcagactaatgaaagaaacggcgcaatttatatttattgcctgaaatgtgaaagttataggaagcaaaattctgatgggttgttagctttacatattttaatgattataaattatattaagtatcatcgcaagtgcaataataagagaaggtcaattagaccgaactcacaaaataattcataaccagcattgtaacggtgttccgcttgaacagcttactgctgaacaaattgatagaagccaaagaagagatttagcgcaatgttctacggatcctaaatctatatggcgagaagtattgtaaaattttaataaatcccaaatagaacattttagggatcagaccggtccagagaacatgatattgctgaggatattgggattgaagatacgactggaatatcatttaattacccgaattggcagacagtacggagtgcatataaccgtagaagaaaaaataatttaggggattcgttagacccctttaatgttcccgaaaggtttcaattgagtaaacgtggagcaatcaagttacttcttagaaaaaatatttctgaagaagacatgtaagtatgaatttcatggaatattaggtaagttgaaatattctaaggtggatgcgattcagagatagagaattaggcgtgatggtttttatatcggatacacaaaaaagagctgctagccattgcaaagttttagtatcagacggaacttttgaattggcacctttacagttccagcaaatttggacaattcatggattggtcagacttagattagatttatgtttaatagagaagtatttaagcttgagacagcaaatggtgctgaatggactccattacttctctctataatgaaaagacggtagtatatatttatttattcttttaataaatgaaattacagaactcaagcttcatatgaagcagtcctttcgcagttaaatgaaatatggggtgaagaaatttttgaaggaattgatagaattcatacagattaaaaacagctgaaatcaatgctttgacaaagcaatttggtattaaaaagtttatggatgtattgtccactatattagagcgactgtgcatcacataaaaacgaatttatcaaatttattcagagaattcaacgaaaaaaagaaatttggaaatgggtatattaaaaaacaataacttgatttaccctattttgttagattcgacgaatatttgcattaccttttcttcgtaaagacgaaattacaaaaatgtggtcaaatcttgtaaaattcaaaaacgattttgagggagtgattaa

SEQ ID NO: 29555 - DNA, 1566 bp, Heterodera glycines
  misc_feature (1551)..(1551): n is a, c, g, or t
gcaaattccccatccaccgcgaaatgtgacttcaatttggatcaaattgtggttgctttttctcagtctctgggtgtttcttcagggcattcatgttcgacaaattcaacgggaatacgccgtaccgcaatttgcccatccgccgccaaacttgccgtatcatccaccagaaaacgttccggtagttgggtcttgtttttcgtgcgtttctcatattttcggatgcttattcaggcaatccaaccacagcaacgaccgcgccagctgagagacgtgccactattcgaccacccgctgccaaacggacaggtaatttcagaccctgtcttctacctaacaccgaaacatcttttctaagcaaatgcatcccaaccctccgagagtgctggaagtgatccgacggctgggcgagtggagaggaagaccaagggacccaagacgtccgcctcaatgaatgaatggaatttggattttgataaaatttgttgttttaattttttgaattgataagggttaaatcccgttacctaaattgtttgaaaagtattaaaattttaagaaattagatgctaaacctaacctttgacaaagattatgaaaaaatgaaaagaaatgacgaaatttttggaatgttccttctttttattatctatggatttttttttcatgtgcattattttggtgctagtaagatattgccgaatgaataattggtttttctcttcattttaaaacatttcacgtccccatgccctgcccacttcccgcggaattgatcaaggaaataattgacgctctcccccctccaaaaacacatcggcttttgcgcgtaaattttgttttggcatactttgttaaatgtcggttttattccatgatgagaagattgtttcgcccagagcatatttcaataccaatggcccgaagaaccggaatttatttctttttcgatgttcgtactccccctatttattttccactctaccaataataacatttaaataaaattataattttttatttcttatttgattaatttcgatcaatattttttgataattaaacaaattgtatttttcaaaaaagacctttctcgcagtagcaactcatcggcttttttttactcccttcataaaatgtctcgcttttgccccctcgcccaaatcaaggaatcgggtcggcataacaccccaaaggggaaattgagtgagttccaaacctaccaaattaaaataaagaattttgataaacgttttaggtcttttttacgctctggaaaatgctcgcaattaccaattgattggaaagggataacggaaaaaacttttcgttatctcatgaaaacggaaaagaaacaaagggaaatggccatggaattgatggaaaaggcagggataatcacggacgacaaaacttttggtacccaacaccttgaggctgtacaaaaatactgggacagggaatttccgggcatgtttcgcattgtggcttttgaaatggtaacaaaattcgcttgaaaaatataacgcattacttatttttagaagaccngggcttaggccaatt

SEQ ID NO: 29556 - DNA, 783 bp, Heterodera glycines
ggatgacatagaaaaaagttataaccaaaaacatccttgtgccgaaacgggagcgcctaaacgcgagcgctgaaactcagtggacccctccgggcataaccccgaaaaactgcttgaatttcttatggggtgctgctccctccacctattcaaaagcatttttgtgaactgaatgtaaacgaactcctccttctgctgttcaggtacgttgaccattccgtgctggcatttctccgtgccaatcagcatgtgtttgagcgagccggcaccatgttggaagtgaatgtgctttcaagaaaaatggtgcaattgttgcctggaatatgcccaatttttgcacaaaatattcgccattatgcctttgcggatggtgaagagccgttgctcaatttgcgtgaccagactgtgcccacaattctcacggattgtgcccgactgaattccatccattccaattgggtgttccccgacgcaattgctgatgatgcgccaaattcaagtccgcgtcaagcgttgtccatgtggttgcacacgccgagcagagacgggcagccgaagcaattgcgttgctatgtgtcagcgaaggcaaacatacaaatctggatcaacaagttcaaggaggtcgggccgggaatggccaccacctttctttcttcgtgcatttattattcgcgggttttagtagtgaatatcagtctcggtttgagaaaagtctcgggttttttttggtcccggtcttcgagaccgagactttgatgattgaaaactttaaaagcccgacct

SEQ ID NO: 29557 - DNA, 860 bp, Heterodera glycines
ggactcaccccaccagcatttcaaagtcatcccaatctctgggactcaatccaccagcatttcaatctctgggactcaacacaccagcatttcaatgtctgggactcaaatctccggcattccagacactgggactcaacccaccaacattcaatggcattgcaatctctgggactcaacccaccagcattccaatctctgagacaacccaccagcatttcaatctctgggactcaacacaccagcatttcaatctctgggactcaaatctccggcattccaaacactgggactcaacccaacaactttcaatgacattccaatcactgaaaatcaggccaccagcattccaatactgggactcaacccaccaactttcattgggattccaatctctgggactcaacccaccagcatttcaagctctgagactcaattctcaggctttccaatcgctgggactcaacccaccaacatttcaatctctgggactcaaatctccggcattccaaacactgggactcaacccaccaactttcattggcattccaatctctggaaatcaagccaccagcattccaatctctggactcaacccaccagcatttcaatctctgggactcaattctccggcattccaaacaatgaaatctccggcattccagacactgggactcaacccaccagcatttcaatctctgggactcaattctcaggctttccaatcactggaactcaaatctctggcattccaaacactgggactcaaatctccggcattccaaacactgggactcaaatctgcggcattctaaacatagggactcagcccaacaactttcaatgacattccaatcact

SEQ ID NO: 29558 - DNA, 1645 bp, Heterodera glycines
  misc_feature (1592)..(1592): n is a, c, g, or t
  misc_feature (1621)..(1621): n is a, c, g, or t
acaccaccactctttgcacttaaaaaaatttcaaaaaactttcatttattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttatgaattaattatgcaaaaaacaaataaataatgaactctcttccttaataattttcctgcaccgaaggtactcactcggccgcttcgcggcctcgtggtgggccttcccgtaggtatatttgttgtgcaattttatagtccagccttcgctagggctctcaccgcggtgtattttaggtgtgtctttgatgtatcaaaatttctctcggccgtgttgttgactgaaaaataaaacgaacttaaattattgcaatattgtttatacgaagtcttttgatattattctgacgacttccatgataataaatacttatacaaagtttatctttttatatatttcctcatcccaaacatggatggaaaataggcaataaatcgacaaatattttcaagttttgccatgctatttatctttcgggactcaatttatgacgaaaatatgggctccaattattttttattttctactaacgcttttctagtggatcaatttatagattcaagaaattccttgcatgaattgaaaagtatttatttttattaaaatttgctgcttattttccgtaagaaagtttttggaggaatttcacaaccttgccataggaaaaactcatatctgactcgtaaaaacataactcgaacagtaggtatatttgttgtgcaattttatagtccagccttcgctagggctctcaccgcggtgttttttaggttgtctttgatgtatcaaaatttctctcggccgtgttgttgactgaaaaataaaacgaacttaaattattgcaatattgtttatacgaagtcttttgctattattctgacgacttccatgataataaatacttatacaaaggttatctttttatatatttccgcatcccaaacatggatggaaaataggcaataaatcgacaaatattttcaagttttgccattctatttatctttcgggactcaatttatgacgaaaatatgggctccaattattttttattttctactaacacttttctagtggatcaatttatagattcaggaaattcagtgcatgaattgaaaagtatttatttttattaaaatttgctgcttattttccgtaagaaagtttttgggaggaatttcacaaccttgccataggaaaaactcatatctgactcgtaaaaacataactcgaacagtaggtatatttgttgtgcaattttatagtccagcctttgctagggctctcaccgccggtggttttttaggntggcttttgatgtatccaaaatttctctncggcccgtgttgtttgactgaaaa

SEQ ID NO: 29559 - DNA, 1213 bp, Heterodera glycines
aaaaaacaaacaagcaattatcagatcaggtttcaggatactttttcagatcaggatcaggatctcgagaaaatcctgacaaattccgacccagttccagggatgaatgataaattatgctgtattacaaaaatgtatttttggaatttacaaattcgatgggcaacctggagtatcttcacccatttcgccaaattcgactgtgcattcccaattgcccacagcagaaaattttgtttgcaaatcctcttttgccagccggataaatctttcccaatcagtgccttctgaacacatccatcgatacagcgaagcttaattgtttattaaattgtccttccttattaagtagcgctgagcgggaccgggaattttgacaaaaaccggggccggcaattttcgggttgaaaaaccgggacttcggtactcagttgtacttgtacgtgtttttcagtaccagtcccggtcccgctcacaatcagctctattattaagcgatcaacaaagtgaataatgggtccaaattaattcacgaccataaaattaatcagagcaattttaggttaatttatccatgtacccgggtttggcttcttaactcgtctggctggaaccatgcgacttggtttttaaacttttttaattttattttaaaaattcaacaaaattttcatgcaaatattcaaaaatatttgcgcattcattagctgatacgttgagactttttcaacatcaatactataaataaatccatcgttgcacgtaagagctttaatataaaaaaaaaattaattactaaaaatattaattaattaacatttcaaatataaaaaattatttgccgagccgctgacaagttggctggcgaaaacaaaaccgcaaatgaagaacagccaaatcggaatcgggtgcatttttatttgaataagaatgtttttttcccaatcttataaatttgggctgcaaattttaggtaagaaaattgcaaaattagtcaattaattaggcagaaaacatacgagcaaaattgcttagaaaaacaggcgcaaagaacacaaaatagaggtcaaaatatgtgaataaaataatttatttatttatttttaggctagcaaaaatactcataaaaataaaggattttttttcaaaaattttgctcacaagtaaaattttttacttctgattatctttcatgagccttggtttttctctt

SEQ ID NO: 29560 - DNA, 1425 bp, Heterodera glycines
attttagattttggaagtcaaagtgaaagtcggtgatattgtgcaacccaaacaaacgctgttcattctttcggcaatgaaaatggaaatgaatgtcgactcgccaattgcgggcactgttaaggtaaataaagttaacagttcgttttttaactgtttctttgctactcaaaggctattcacttgaacaagggcgagaaagtctcacccaacgatttggttgtcgaagtcgaacagtgagattaatattatacaaataggttgtgattattgatcatccattcccttcactttgttcccctatttatttgtgttttgtttggttagaccccatccctcccttaaattaggttttatttgtattgtgtcatcacttatgcgatattttccgtgatattcaccgaatggaattgatttaacaatttattttaaagatgtgaatagacagggaacaataaagatatttatttgcgcactgtcgttaataatttaaaatctcggattgcaattttccccttaaaaattagccaaagcgttaattattagcctctttcaccaaacttcacttgaccttaggcaaaacatgtctgaaattggggtttgttaattagctgatttgtaatttgcgagttgtcaatttactgtgcaataagtgcgagcagaggagaagggaacgaagtgtttgggtactcccccatggatacgccaatgtccaaatgggtgtatttcaacggctgtgccgagtcaagcccagcctcgtcgatgcgcgagacgcgcatcagaaatgccgctgggcccatgtgccctcgtggcgttctcacgcttggcaaagcgttcgattgcatcaaatcggccgcttcgcatttcgcagagtgaaagtcgaagtcctggcaaaataagtgccaaattatataaaaagaaacaattcgctctaaattttccatggcaccgtttgttgagactctttctccattcgtttcgagtgcccaccatttggttttctgcacttgcctcactgaacagtcgcgacacttccaccggttgtccgaattcgtcgcccgttttcctcaattgttccgcgtaatttgccgccctcgccggtccgttgtccatcgcggcggagcaatggccataagtgagtatcaaatggccagtgagcgtagcgatggtgaacaaatgtgggttcttcgctttcatggcctagtgaaagttgccaatgtttgctctttctttggctttcggaatttcgtggcaaattcactttttctttggcctcggccaatgggtcggccattgccatccgaccttcggcgtcggtgttgtaaatgtggacgcgctttccgctacgggacttcaaaatggcaaagggtggccatgagtttcactctcgtccaacggggggagggggccttaccacgtattcgt

SEQ ID NO: 29561 - DNA, 1049 bp, Heterodera glycines
gtaatttgcagagactaaattgtaaatgtcattcactattgtttttaccgaattccgctttttcctttttggcatcaaaacggaacatcgcctcaatacatcggaagccaacttcaaaatgattctatgggctggcacaagcttaagaggattaaattttaaaaaacacaacaaaaattaccattcactaaattacccaatttataattaataaattaaatttttaatttgaagactcgcctcttttgcgtctccgtcgcccaccaaaaaataaacatccgcgtcctctcccgcgctcaacaaatgcttcattcgttcagccaacggtttggacatgctaagcaattccatcattcgtttaattatctatttaaatgcggtaaaattattggcaatttcaaaattggcaagaaataaaaaccacggcacaaaatcagcaaaactttatgttcagttgggctttgtgattattttgaggaaatttgtagcaaaaaaaacatgcaaatgtttcgttgtgctccttcccccccccctgtttttatgcattttttcatcgctttgccatcggtaaaaaaaaattgatccgactaaaatgcaaacgtaaacaaatatattttgaaaaatagatgcaatgtacgataaattacctaaacgtattaataaacaaagatatttttgtatttttggatagaaaaaaagtgggagaaaattgtgctctaatcgaaagcttaaaatttggggaagtttttgtatagcaaaattctggaataaaagcaaccgacaaaaaactatgcttgaatatatgcgaaaagttatgaatttcgggtttctcattgtaaattttttcttaatatatgtaagtatttgtttttttcttgtattaataaatacgctaaactttaagctttcgatgaataccaagaattttggattaccaagtaataaaaaagttatgatttaatcattggacgcgtaaatattgattggacgcgtaaactggaacagagccgaaaattgaatatattcaaataccattgggtaatgtgaaa

SEQ ID NO: 29562 - DNA, 1286 bp, Heterodera glycines
acgttttttgtcactgttctttcttctctttagtatccctggtcatttctcccctctccctaattaccccttaattacctcttaatccccccatattaattaattaatccttcacacccaacactttctccttcctttctctcttccattgtccttccttttggtgtctcttccccttttgaatgccttcgcttctcttcttccatgggaatgacttttcgccttttatggccaacataaaatgcaaattcaattaaatacattttcccctttctcccattttgttatgccattccatttttgtttgctttttctgtgggatttgtttggtccttttatgaccgaccattcctttgccactgcgatgcgcgggttgggggggggataatgttttggtgccccccgtccaaaatatttgttccatcctcgcgaaaaaagagaaataagcagcggacggtgggagagttgttgttgtttttttttcaattttttcatttcgcttgtgagtttttaaggtttgatttggggcggagttctttttttgtgcttttggtttggctcaaaggttcggtccaatcgatcgaatgacttttcccctccccctttttactaattagatgtcccccattttttttctgcttttccatgtgctttctcccctcattttcccatattgcctatttggttgcattatttatgcaaatttatagtgcaaaaagatcccaatcattcgcccccccccctcacattctccccttttcttggtccaatttgtcatcttttcaaaatccaattcatcactctgtgggctttggcttcttctccgaatgaccactaaacgtcgtcggattgtttggctttggtaaagtgacaaagaaaaccccgggatttaaggatttgtgacgaaatcaaatttgtgtgttttgctcttcgcttcgggagaatccttcggctttacgccgctctttcgctcgactcgcaatttgtccattagctagagttgaccttccgcttctccttccttctcctttttctcttttcctcctttttgcccctttctcccttttctttactgtttctctttttttatttttatttcaaatcgtcctttctcaacgtctcaactccagcgcgtcgcaatttccgatagagaacctcctttctatcaaacaaaaacattttgaaaaagactttgataaaaattaatcacttggctcccattttattatttgttgttcattgagcgactgcgccacggcttccgcaaccccctcaactctttttct

SEQ ID NO: 29563 - DNA, 896 bp, Heterodera glycines
ttttttttggtttcccaaaaatttcttcgaccctggcttttttttttttccctttcaaattccccccaaatttttttcaagcttaattaggcccttttaagctttttcccaaaaatttcgcatgaattctcattttaaattttttatagattttaaatgtttggattttttttggcttaccaaaacttcttcgaacctggctctttttattctcattcaaatcgccccaaattttttttacagcttaactaggccatattaagcttatttccagaaaatctcgcatgaattctcatttataaattttttataaaaaatgtttggattttttttggcttaccaaaacttcatcgaacctggctctttctattctcattcaaatcgccccaaattttttttacagcttaactaggcccaattaagcttatttccagaaaatctcgcatgaattgtcatttttaaattttttatagatttttaaatatttggatatttttttggcttaccaaaacttcatcgaacctggctctttctattctcattcaaatcgccccaaattttttttacagcttaactaggcccaattaagcttatttccagaaaatctcgcatgaattctcatttttaaattttttatagatttttaaatgtttggatttttttttggcttaacaaaacttcatcgaacctggttctttctattctctttcaaatcgccccaaattttttttacagcttaactaggcccaattaagcttatttccagaaaatctcgcatgaattctcatttttaaattttttatagatttttaaatgtttgcattttttttggcttaccaaaacttcatcgaacctggttctttctattctctttcaaatcgccccaaatttttttt

SEQ ID NO: 29564 - DNA, 1490 bp, Heterodera glycines
  misc_feature (1447)..(1447): n is a, c, g, or t
  misc_feature (1457)..(1457): n is a, c, g, or t
tcctttagcatttccgccaaatgcgccagcagtggcctctatcttcgcaaattgcccgtcgtcgcttattccgccgcttgttcagtttcgtcggtagtgttggaattattgtcttctaattaccccttaattattccagaaactccctcccattggtctcgactcgtttttggatgcttttgcgaatatcatcgagaattcatcgcatttacacttgggattttaacacatttctcccttccctttgtccatcgtttcgcttttttcactttgattttttgtttgccccatttttaacaaataaaaaattaaattattttggaattcctatccaaaaaggatatttgcacactttttttgcgtgaattgtgaaggctttgtctgatttggtaaacacagctgcgttgaaataaaaaaaaaggggagggagcattttagactgactttccctctggcataacaatgagttaattaatgcactaattaccccccccccctttttcccttttattttgtttggttccatttaaagtcactggtttactacaattttatgccacttttcgaaatttctctaaaaattttcccgaaaactgtgctaatgaaaggccctttcacattctttttagtcctcctccatttctcctctaatttcgtcttcatccgtgctcaaacatgcaattacgcagctgtgcttggccgtacgtttttactagtaaatcccctacttttcccttttctcttccgtctgatcattcccttttctctctcttctcttcttttggtcatttcatttccctttctctctctttcttcccttttctctctctccccatttctctctgtcactgctttgtctgatctttcttcttccgccgatcaatcaaatcattcgctgtgtctaggacagactttttagggttagaagcttaattaagcctttcgtattttgataatttttgggcctgaaaatcctttcactgatcattcccacttttttaagcttgtttggccaacacttgtcctttgccgttcgcttgcgatttgctcactcaactttgttgtgtgttgcaatcgaacaatggcaatgattgcaaaaagagacgaaagcgattcgcgaggatggacagaaaaatgatagcgacggaaaattaatcatctccaatttatttgagaagatttatttctttgttatgtgtaaataaatacatgaaatttcatatttattaagggaaaaaaagaaataaaaattggaatttgaggcaaagctacgaaatttgaattaccataataattagataatttaaatatatttacaaaaataaggtgtcaaataaataaatgaaggtcaagcggatgtccgtcacattgggcacagaatttgttattttttaaatgagtggatttgtttgaacatgccaatgacagatgccgtgaagtgaagggncgcactttgngacggactcaattttcccgcccaaaacgacccc

SEQ ID NO: 29565 - DNA, 892 bp, Heterodera glycines
agccattagtttcgtggacacaaaaaccagtcaaaaatgactgtcaccacgcctagtcagagtgactagtctaattaattagcaatgtttgatcggtcgatgggtggcgagaatgactaataattgtgcgtgtgcgtttgccttttccacgttgatgatgcgccccttgaagttggagcggttcagcttctgtgcacacacattggccgtctccgcatcggccagcgtcacgtagccaaaacaggtgggcgactgtttgtttttggtggtgaaaatcttcgccgtgattactttgccgtgctttgagaacagcgccttaaaaacacagtgtttttgttgatgaaccatctcatcatcatccatccatttggtgtggaacacagatggggcatgtcatcagcacaaaagttgtacagagagcagttttatgcaagaaactgtttttggatacgccaatttttccaaaaaaaataaggaaccgaaacacttaaaaaaagagaaattctctggcattagaatttttttgtttggatatgaaaagtgatcatattttaaaccatgggaagaggtgtcattccgaattccatggctaattaatagccgatgaaggcaatgctaaaaaatgcaagtggaatgtgcctgtccgtactttgagatcggccgctttcgtcgtggtggtaatgttgcggatccacaggcttgacgacaaattgttcccgttcaccagctgtgccgtcgatgcaccgcccgttgttcctgtcggtgtggcagccgagtgcttcttcccgccggcggcatcatcgctcggctgggcagcaacagcgtccttttccttgccgattttgtcctggcgtaggtgctgttggtcgccgttgatcagtatcacgtcatc

SEQ ID NO: 29566 - DNA, 1448 bp, Heterodera glycines
  misc_feature (60)..(60): n is a, c, g, or t
  misc_feature (189)..(189): n is a, c, g, or t
  misc_feature (254)..(254): n is a, c, g, or t
  misc_feature (265)..(265): n is a, c, g, or t
  misc_feature (300)..(300): n is a, c, g, or t
  misc_feature (327)..(327): n is a, c, g, or t
gtttatttgcaaaatttaattatataaattttataaatgatattctattttgtataaatntaaaaatataaaattttaaatataaaaatttttaaaatttataatgtgtataaatttcaaattattagtgcatttttatcgcataacaagcttgaatacagtctttttgcacaagttcaactcaattanagcgaagattcatgattattttgcatatttttaattacaaatttcgcgttttttttagcattttntaactgatttntattaatttttcattaaatatttataattataatntaacaatgtttatattttaataaatanattttaaataaaaatggttcccaaggtgttcaactgtaccattcgccgttcacttatgtgccgttggaccgggacgatgtggcggtgcaacggcagtcgctgagtcggctcgaatttgtggacattttgtacgccggatatgacagtaccacaaaaaatgtcaccccagcactgtatgtggagggcgtgccgccgttgatgaacggtatccgagtggagcgcagtgcatacgatggcatttacttttgggagccggaagtgagcataaaatatttacaactattatataagatatgttattcatacataatatttaaattttatcagtttaatatacaaatttataattatttaaaacctgggcctacagatatatatatatatatatatatatatatattatatttaccaaatacataacaaacgacaccgaagcaaatgagatttttaccataaaaattcagattttttttttgtctaaaaatgaataacgctacgcggggaaaattgagaatttttgccatttttaatagatttgcacaataaaagctaatttgatggattgttttgaaaaattttggaaaattttttgtgaaatttgcgtaagggagatattgggtagaataccaataagcaaaaacgaaaattttatccgccggtgatagattaagaaattttggcagatttagtaatatgttccaccaaaaaatgcctgcctatatgaatttaatcttttcattaatgatgaaataggaattcgtgcatcagctgtgcagatagatgaagctagaaaatttttgaatttttataatatttgctttaaaaatggcatttttctaaaaaaaatttctttgtcgagcgctcaaaattgaggaacaaaaaaaaaaaaactatatgaaaaggttgattcaacgaaattaaaaataaaaattctattttttttaaatgcctaaagaaacaatttaatgttttcaaaaaaaaaattttccccattttcagggtcccgttcttattgcgaactcaacaatttcacataatcgtggccatggaattgttattgagagcacattggatggacgagcattaggaaccaaagtcgaattgaggtagcaatttaaaaa

SEQ ID NO: 29567 - DNA, 1339 bp, Heterodera glycines
ccattttgaactttttccgtttcaccattttccattatttttttttgtacaattaattacatttggcccatttttctttcggttttcactattggtctcccattttcgcttattctttgatctttccgtttaggattttgatttctcttcacttttattcaaaccattttcagatgcttctttaaccaattctgcatttttggatgtttttatttctattaaaattaattagaaagcattataataaaacccttctaaatttgtctaatttcgagttttgactttccaaaaccatttacaaaatatttccctttttatgcctttggccaatcattttgcctattataaattaattcttcaatttgttttcacctgcttttccctcattttgttggtttgaaaatgcccttttcaccaatgtgcccgttttggacgccgttcgcttcaaattgtcgcccgccaccaaagcgacgtctttcaattccgggccgaaccctttcatacacctttgccccaattttataaattaataatttataatttttggtcgaactttgatcattgagaagtgcaaatggcgattgaaagtctttttgatgttcgccacattttccacctgtgcaatgccacgcacactgatctgtttccggcggtcaaaatcgtcgttcattttgatcgaaaatttaatattttgacctattaattatgatatcaaaagattataaaatgcatagagagaattaaaaaaattcggtattttattcaaaaaattatggtgagacgccgccggggaaaaaattgagaatttcgttccatatttacaacatttttgcaccagaaatgcaatttttgtgggttttttggaaaaatttggcgaaaatttttggttgaaatttgaatttcactgcatgtgcacttttttgcggcatatttttgctcccaagtttttttgaaaataagaataaaaaactcgaattctaaaaacaggatttccaataaaaagtccaagcgacgatcttttttgctttcactcaccttttttcggagcgcttaaaagattttgtcaaaaaatgacttatttagtgatttagagccaatttttttttaaattaaagtttttagtcagcctcgatgtatttacatcggtataatttattttcttgaaaaaagcacagatttttctaatttttctcccctatttaaccattttttcgtccctaggaatccattccctaatgattaacaacaaatgagtggtaattgtaatatttttcgtgtcacaacttttataaccttagaaaaaagcgatgtggtgaaaactgaagaatcgattaagtga

SEQ ID NO: 29568 - DNA, 808 bp, Heterodera glycines
ctctgatcaaatttgtctaattcttctgatcccccctctagggttttcattggtcaattgcccatttcttttgatctggttggcccaaatttatttttatcggatttttttttgggccacttcttttgatcaagttggcctttgtaccaccctgaggggttcacatattatctcacatttacgcgttatttttatgcgtttttgatcaatgccattcattcttctcttttctttgaccaatttgttccaaattttctgatcaatcccatccttccctcatttgatcaaatttggacattttatttgatcagttccatcatttccccattttcctttgatcaaattggccaagtcttccccaatcgcctttgaacgaccccattaatccgggatttttcactttaccaattcttcttttattttggtctcttctatttctgttcaacaccatccctcatttctggtcaacccatctctttcatttctggtcaaccccctttccccatttccctctcatctctcaaaatatttccttttaagtacaaatcagttccattttccccatttattttggtcaacttgccacaatcatttcgatcagtgccatccccgcccatttattgatcaaatggcataaatttcctttggtcaatgcaattcctccatttttctcaaattgcgcgtaattcttctgagcaacgtatccctttctccttgatcagtgccattctctcccctttttcttttttgatcaatttgtccctcattgattaaattcatttattttgatcaggttcaccccatttta

SEQ ID NO: 29569 - DNA, 1532 bp, Heterodera glycines
  misc_feature (1508)..(1508): n is a, c, g, or t
gaaaaagtgagaaatcgctcttcgggactcagttgggcgtcgagaatttttttctatagttttcgcgaattctcctcaaaaagttgtaagacccttccactactttcatacccgtcccattagccgttaagctcaaattagtttttgaaacgacactccttgtcaatataacatatatattaattagggtgaccagttggctatggtgtgcatacgtggcttggtaatatatggccctcatttgttattttgaagcacacacgcacttaatttcattagtgtgctgttgtcaagttctcgccctcaatgcggcgcgttctcgcccgtcttttaattttttaggggatattcggccgcttcgcggcctcaggacgggcgctcccacccctcagaatccccaataacacggggattctgaggtcttaaccatgtctaaagtaaaatctgattacatattcgtgatcagcggcccaaataacccctaaaatcatatttttggaagatttttggtgaaaaaaattttccactcaaaaatcatggtcacacccctgtggtcccaaattacaaaatcacttttatttctataacttttttcaaaaaagtgataaaaagctaaattaaaatttataaaatagagcaaaaaattgcggattttttgagtatatcatttttataaaatactttttcagaatggagttatgaatttttttctgaaaaatcgaatttttccagaaattctggaataacttttttattttggaagatagaaattacaaataaatcgcataaaattctcctatttttttggtatttttcaaactttattacactaaatttgttacatattcgtgatcagcggcccaaataacccctaaaatcatatttttggaagttttttggtgaaaaaattttccactcaaaaaccatggtcacacccctgtggtcccaaattccaaaatcaatttatttctataacttttttcaaaaaagtgataaaaagctaaaataaaatttataaaatagagcaaaaaattgcggatttttgagtatattatttttataaaatactttttcataaccgagttcttaatttttttctgaaaaatcgaatttttccagaaattctggaataacttttttattttggaagatagaaattacaaataaatcgcataaaattctcctatttttttggtatttttcaaactttattacactaaatttgatcaaaaatgaagaaagttatgaattttctaaatttcactggattttccggggctcaaattttgacgatttttcaaaaaatttttaccaccttccaaaaaatctgaaacgcaaaataaagcgtatatacgtattcagcaccaaaaattaggccataaaaatgcattttggctaatttaggagcaaaaaaattttcatgaaatgcaaaaccatggggtcccccctttggttttgagtttcaaaatcacaattaattttataactttttttaaactcatggtatnaaacatgagataaagcacattaga

SEQ ID NO: 29570 - DNA, 1015 bp, Heterodera glycines
  misc_feature (828)..(828): n is a, c, g, or t
tttcagcacaaaaaatcaccgattaagcactgtaaacatcaccaaattatctcaaaataagtatgaaaaaagcacaaaaaaggcaacagcacaaaaattcgaaaaaaataaaaaaaacacaaaaaagcaaaatcagcacaaaaattggaaaaaacataaaattaagggattaaaggcacaaaaaattgaaaaaaggaagcaaaaaaaaaaactttgttgcttcctgattataaaaacctccaaaatagttgctaaaaatggcaatgagatacacttttcggattgattcttaggggtgtatttttcaattttattgcatatttgttaataaattttttgaaaatcgcttaaaatattttagaaaattcctcaaaatgataaaacaacacaaaaaagttatttttaccacttgtgcagttcgtgatactgcagattaaatcaccttcctggcaatcttttgcagtgaaattttggtaaatttgagtgttcgaaatcgatccttcataacatttaagaccttaaaataatgttatttatcaattaatattttctttcagaaaaaccttcggagttgtccatcatcatacaaaacagaaaaagaaacatagcaatcggaatagaatacattgagttctttagaaataataaatgacttaaataattgaatttaatttggttttatttgataatataaaataatagcaatgattcgtatttattcaaatgcaaaccaataacttttttttgtacgaaaagtcataaaaatttcctatggttttggcccgaaataaacagtcatcccttgcattttcattgcttttaaatatntgaacaaatagtaaataatgcaggatcaaaaagtcctataaatcaaaaataatttgtcaaaaattacaaatttttcggtaccaggaacaagttcattgtcaaatacgtttagtaaaacataaaaaaagagagattaaggagaaatcggcataatataaaatgaaagtctggcagtcaaaatctgtgc

SEQ ID NO: 29571 - DNA, 1176 bp, Heterodera glycines
cagtccccccgaaccgatgcgcccagatttatggggagaccgaatctttcgggattagcttccctatagtctgtactttaattctgcgttggattttgctccccataattgcgtgagtaccccaaacggacacttgaataaatcgatttttttatttcataaatattttttcagaaagtgctctaaagcgcaccaaattttatttacaagtcaattttagcactctgatgctttagtatcaaaaaggaagatggagaaaaaattttttaaaaatttttccttatattttggttatatcgttttgcttttggtggggtgcttggaacagtggaatcatgcgcacccgtccgatctggcaagttatgcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtagtgctctgaagggcgtggggggggggggcgggggcccaccacgaggccgcgaagcggccgagtgagtaccttcggtgcaggaaaattattaaggaagagagttcattatttattttttttttgcataattaattcataaatatttttttcagaaaatgctctgaaacgcaccaaattttatttacatgttagtttaggcactctgatgctttttctatcaaaaagggagatgaataaattttaaaaaatttttaattcctttttaaacaggccaaaaagtttaggcttgtgtggtaagtgtgaagaactgtgttcctccaggcaaaaaattctaagaaaatttataagcatttgtagggttctcagcagtttccctgcaaaatttggtgagctttcgatcagtctagaacgttggggatcaaatgcaaaaaataattaaaaaaaaataatactggtgtggtaagtgtgaagaactgtgttcttccaggcaaaaaattctaagaaaatttataagcatttgaagggttctcagcagtttcccctgcaaatttggtgagctttcgatcagtctagaacgttgggtgatcaaatgcaaaaaataatttaaaaaaa

SEQ ID NO: 29572 - DNA, 1902 bp, Heterodera glycines
  misc_feature (58)..(58): n is a, c, g, or t
  misc_feature (102)..(102): n is a, c, g, or t
  misc_feature (116)..(116): n is a, c, g, or t
aaaaagccattgattttctgcgccattttcaccgacttttcggcacgtgccaataaangttgagtattggaacaagcagcattttgcaaatgggattctttnattgtttcttatgnccaagaatcaaaaaccaaatatcattcattgaatttcgggatgaccaagcgttcagccgaatgcgagactttgcaccgtccatattcaatgaattgccttctctccgtatttttgagtcattggaagatcccttccccgcgtttcctgccatcgacagtaccagtgcggtaaatggacagctattggcacattggctgatcaaggcgcttccgaatgaaatccctaaaattgttcgttgttcaattgagtcatccgaaacggcgggtgatttgccagcaaaaattggcgcaattaaatcggtatataaaaaattgaaattatttctgtttgtaactaactgttaatccctttaggcattttcaaaatcttctttttctgccaatttcataatccaaatgacgatacctgatgaaacaatcattgcaccattcgatgtgttcaacaaaaaaactggaagacgtctattgctggatgattcccacgatcaaaatctgctgctaatttcatgcccaattaaacgggacaaaaaggcatggattaaatggagggaagaggctcttcaaggaagtgagaattacacgtggaatttaattgatctcaccgcgggggacgctgacattggcgaatggtgaaaaatcattttgtcaatgcataaatttttatttttaggaattgggcacaattccccgatttaatggcgaatatgcaaaagtgaaaggatggataaaaataattggagatttttatgatctattttttacatttcatttatcatttgatttttaaaaaatatattctgaaattgaattccttttctgaagttaaggcaattaagataaaatggttacgaacatttaaatatttcctatttaatacaaaattaggtcgataattcaaattcccggtttattaacaatcttaattaaataaattcaaaactaacaaaatgaatatcatttcttatccagtatgaacatttgccattgatctgtcgtccgtaatcatctataattagaacaaattccaatggtgttcggcttgccaaatgggctcgattctctttcccatttggcccatttttgctcatcacgcgcaattggacaacggaccagcaaaaaatgtttgatatgtttgatgccaatctttttcaatgcaaaacgttcccccgtcattctattgatcatttcaaatggcacaatataactaacatctctccatggaggaaacctaatagcaatgatgaaattcacgggagaagaagcattggcaaaagcctaaacggaaaaaaggttaaattagcaattaactattaggtggaacgcggacagaaaaattaagtgttttcttaataaattcgggataattaaattttataggtttctgagccaatttttagtcgatgacaattaatttatacgcaaaaattgatatgttccgttccaccctattttctgttactatcaccgatttaatgcttataattttcggcctccattggtcttctcgaatttgactgcacacaatcaactttggaattccatcagaacgtggcgtcaaaagccaactgaccagagcttgttcaatcgaagttttggcactttcatcggtcgaaaaacagggaaagtgccgataggaatagaacaagcgaagagtttggcactcgttgagaatggaagtgacaaattgtcgtatctgatgagactgtttgtttttcatgtggaaatagatcccgcggatattgtctttgatctttggccaaatgttgaggacgacaaattccaaaat

SEQ ID NO: 29573 - DNA, 990 bp, Heterodera glycines
tgaaaaatgctctactccaaagagacttagttgagcgcactgcaaggagaaccctaaacacagttcagcacaaaaaaatttaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaaatgaagtgcatatatctcagcgcctagtgcatgaatag

SEQ ID NO: 29574 - DNA, 934 bp, Heterodera glycines
  misc_feature (911)..(912): n is a, c, g, or t
acttttttttataactggtcagaacgaccagatttgcgagagcatcaaaagcaaggaaagcactgtagatgctactccagtaatctgaattaaaatttttattaattttaaagcttcactattttatttttttgcaaaattaattcataagtattttttcagaaagtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattttttgcaaaattaattcataagtattttttcagaaagtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttttatagcaaaagggagatgannataaatattttaaaaattttta

SEQ ID NO: 29575 - DNA, 1624 bp, Heterodera glycines
atttaaggccaaatcaaataaaacttacaatattctccagaattttcccttcaaaatgagcataaaatggttttatttgatctattattaacaaagttataagctaaaaaaattacacaaaattatcgatgctgtacgtaaccaacgctttttgaatataattttttttgacacgaaaacttttacaataaaaaaataattcgtcttttttctttaaaagaataagttgaaaagaacacacaacatgcagtgggtttgaacctgagaccccccttttggtgactaacacacagaccacttcgacgaaaaatccaacttatttgcgcttggagcccaaaattgactcgccgtgaccagggatcggatagaaaattaaaaaaaaagattaatcaagtacaaaaatcagattccgtagtaaaaaacaagaacattttgcaaaattgtttcaaatttaaaatctattattttaacaatttatgcaacaattaaattttttctagtattttatatttatattttcatttatcctttattagcaaaagaaaaacctaattcaaataaattaatttaaaatttgtaaaaaacaaaaacttaacactacctttaatgtgcatcgaaaaacattaatcaatataaaaaaatattttaattgtaaaaaattatgtaaatgtctaaaatataaattaaaacttggttagacatattgctagctaaaacaacatacaaaatattttgaaatatgttcaaaaaggtaaatgcaattattgtaataaaataaaaacaatttatttgaattatcaaattttttgtcaataattttattaaaagcgttaaaaaactagcaaaatgccataattatgcattgccttgcgcctttttgcttatttaacaagcagaattgatgagaaatatgtatacagatatgaattattctataaataaaataaatctaacaaaaatttaatttttagttgaaaaagtgcaactttttatattaaataaatttttcttattaaccattacctatcaacgatttttaaatattattaaacgataaattagttaaaattaattttattattttctttatgtgcgctaatgcaagtcgtaaacacatttatttaaaaaggaaattaattaataataattgttaattattctaaaaactaatgtttatatataaaaataaaaattaatgaataaaatttattaacaaaagaatattattaatggttaagagaaatgttaattaaagaataaagaaaaccggaatttattttcttagataatgaaaataaatttcaagttcatcggttatgaaatacctacattgtacacgctagttcaagagaattaaattaaaaatattgataacacggggtttgatttatattagtttcaaaaatgctgcatttcataaaatgaacataaatatgctttttaatatctttgatttttgataaaatcgcataagtgataaaatatcagatataaaaattatagattaaaaaaattcacaattttataaaattgaaatgactcaataaataataataaatgctatattatttgaaaaagaatatacattatatttgcaatattttaaaattacttctatgcttta

SEQ ID NO: 29576 - DNA, 1500 bp, Heterodera glycines
cacatccaataagttacgccagaacatgcatcaaccacaaaatttttgtcggtgaaaaaattcaaaatcaaggtaaattcagaaacgctaggaaattgtaaaaaatttccgtgacaaccaactaggcttatctgaaagagcacaaaattattctctacaaaatgattatgaaaccgcagcaaatcctttacatgcagaaaggaaacgatatatatctctatttttgttgttttggacatttttggtagagtagagcgggaccgggaccgggccgggaattcccggtcatccgaggtcccggtcccggattttgaaaagctcaggtcccggtcccggtagggcaaccgggaaaaacaagcactggtaagaatgggggtctaagtgaaaaataggaacgaaacttcgagttaaaggaaaaaattttaaaaatatattaatatattctttaaaagtaacactgacaattgtgcaaatggcctagtggctagtatccttgactttcccttcttctttttccactggttcaatccctctacagaaattaaaatattttgaattttctttttgtatactcatggatttcctattgagaaaatatgattttatttttttaattgtgttttatcattttttaaagaaaatccgtacaaattgagcctagtaatcccaaaaccagccttttttgttgaaaatctgttaacaaatagcactcaaattttcaaaatttcccccggcggcgcctatcggcaccgccggacccacttctttcccaaaagttttggaaaaagcgctccgaaaaaagtgaagtgaaagcaaatctgaatttaaataatattcaatcatttagcccaaaaatgattattgtttgaaataatgaagaaaatctgatttgaaatttttaattaatttgattttgtattattttcacatgaaataaattacaatttgaatttttaaaatttcccaggttggtcccggttccggacaaaaaccgaggtcccggtcccggcttctcaggtcccggtcccagttttgccaaagattcctggtcccgtgacactaattttaagcgtcattactgggttgaaaaaaaacttttcttttgattttcaaaaatcagcctttaaactggtcattcagctcggagcaggacaaaacgtcgtcggccgaaacgtcgccggacgaattcttccgacgacgttttggggtgcaccgcattctgctaccctaatttaacttattttttttggctttctcaatagttttaccatattcttttcaattttaattcaccaaaattaattaagaaaaagtaaaattacttagattttaaataggtattatgcaaaacaaccgaataatttgtccagaaaatattaatttgaaaagttgtttttttttaatgatttttatttaaaattggtatcaaaaatgcttttaagaaaaatgaaaaatattcaagcaaaaatgggaaccaaaattatgccgaaattctgagaa

SEQ ID NO: 29577 - DNA, 1175 bp, Heterodera glycines
atgcgaatgccggacacctgcgctttcttgtccgttgttatgaatgaagatgtctgaattggagaaaatgaagtaacagattgctgaacatccgccaaatttgctaaaccttggccggttgaaacaggaagaccataattacgccaatactcaatagcccattttgaattcgcatggagtgtattaaaagctgaaaaagcatttatttcacagtggtttaaacaatgtgtacaaatggaataagatggtgatcaaaaaaatgttcaaaaacaagtttcctcgagttttcatgctcgctgatcatgaatctgagacccatctcgactaatttcgaaacgcgaccccgacaaaaattcttaatattcaaatttaaggacttagcacttatgtctcgaaaacggctttacatgaaaaaacagaaaaccatcatccctgcaacaaattgtaattttgttcgagtttgggtccggggttgggatttggtcgaaatgaatgttggattcgcggtcagcgactttgaaaatccaggaaacatgtctttatgaaaatggggtgggaagtgggaaaaaaatgtggagattgtggctagacaatgcagaattggcacattatatagaccaatttgagtggtggtggaaaaggcggacaaaccgacggaaatgcaaaaataacaaccgcacagccacatacatataaaacccacccattttcttctcacatacttattttgaaaatttagtcccagagatgtatgtacaagaaataagggtaggggtcactttggcgcgggccattttggcgccgcgaactttaaagtgttataacttttttcttatccaaccaaataaaataattttgataacattaaataggcctaagtgttctttattagcttgcaaaatattagaaaaaataaattctgtttgacaaaagatatagcgtgcggcgccaaaatggccagaaaaagtcagttttttgaggttttttggccataacttttttgtgtttcaattaaattttttgaaattttgcaggctattagggactatcaagcgctttaaaatgatatcaagcttatttaatttgaatgagaaataaaaatgttatagcgtttggcgccaaaatggctggcgccaaagtggccggttcccagaaataaataattttgatgattg

SEQ ID NO: 29578 - DNA, 1236 bp, Heterodera glycines
  misc_feature (1167)..(1167): n is a, c, g, or t
attattgggtcgcatcatgatatgcatccatgaaattctcctactttttgggaacagttgtgaccctagagtcctcacttgtaattgtcctgaagggttgcgcattaaaaccagataatgggcgttcgctcttgccgttttaatgtcccgaccgtagagactctgggttacaaaaattacgcttacgttccaattatgggagcccctggtaaagagtaaatcgaggaaagtattctgcatgttaagcattaaatcgtcaagtatcagtaagaggggtttttcctgttctttaatcttattcatgtccggaatcccattaaaagtctcaacaccctccccgattaatcctaaaatactatcattcatctcaccataacaataaagaattttcttaggcggtggttcaattaaattcttatgatgttttaaaaaccgtaatagccaacgggtcttaccactcccggtagcccctgagagaattagagtgaacggaccgcgaaacatttttaattcctcttatttatttgacctatttatattttcatagggaacatgtttcgcgcatttggggcatagccagaaattatcaaaaaatgatgtaccgaaatgcaaaagactgtggcttttacatctcttacaaatctcgtaatgacaggggcagtaatgacaacacttaattttatgtggacagttcattttttcaatttaattttatttttggttgctatttatagaaggggtatataaagggagtgaaaggaccatttgattggtacattgtatcaaaaaatgcaaaaaccgataatcgtaaatataattgctctcgctaatctcggtaccggaattaaactaaactctctgacgatcaccgaatgcgaatttaagtataaccctagaaaattcaatgccgcggttatcaaatgtacaactccaatcaaagccaccgcgttattatgggaatccgggaaaatgatatgtctggggacgaaaagtctgatagactatgagaatgctataaaaatttttatagaaataattaagggctcggggtgtccgggggcttcttacacaggacacacggttgaaatattgtttcgaccattaaattcgcacatgaaatagaactgaacgaatttagaaaaaatcgtcgtgccttttatgaacccngaaatattttgcggtttaaatttcaaaagggtaaaagcatgactgctttaattttctggaccggtaaag

SEQ ID NO: 29579 - DNA, 1075 bp, Heterodera glycines
gccggccctccttgtcccccaaaagtcttggaaaaaacgtgccgcgtaaaaagcggtgttgaaagcaaaaaaaggtcattgatttacattaatttacatggccggagaccccttcgcaaaattggaaaattggctgctgaccccttgttttgcaataatctgaattttgaggtctatatctgaattttagtgttctttatcctgaatttgaaaaaaaaacttggtcaacctgaatatacatatacttctgaacaattctaatgctaaaaaacaggtactcgcgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtaccggtcagtaccggtaccggtttttgcaattaccgattaccgctcaactctagattaaatgtatcaaaaaataatttaataaaaaattagttcctacattttagacactaaaacttacaaaaaaaaaatgaacattggttttggcaacctaaaagccaaaaacatttattcaaaagagatgacataactcttaattttaatattaaaaaaaactccaagactggtaaagaaacgagagagtacagagaagcaggaatatatttatttatttatttattaaatttaaaatgttttaaattttattattttatttaatgttcagataatcaatctgactattcagtggatattacaccaaatgcgccacacggtttataaattgataattttttgaatttaaattaaatttatttgcagattctgacagcgaatctgatcactcagtacaaatttcaacaaatgttcctcatggttttttaattatttaatgtttaattaatttttttaattgcaatttaattgttccattttagaaagtgataacgattcggatcattccgtggatatttcttcaacaaatttggaaggattaataatttcaagtaaaaagcaatacaaatttaaatacatattaataataaacttttaaatgc

SEQ ID NO: 29580 - DNA, 1286 bp, Heterodera glycines
ccctccccatttcattttttcctttccattcgcttccctcacattcgccgtcattccattcgttcttctttcatcattccaattccatttgtgtagattgacgaatggcgttgtctctttaatttatcaatttcttattttagatcattttgtgtgttaaggcggggagacgttcgatatttattgtgtgtgttagaagaggaagagaagaagcaggaagagtggaagatgagcgcgaatacggaatgctatcgttgccacgaattcggttggatggagagggagttggtggtgttggtgtgatttcgggtccgtccgggttctgttggtggtgttgagagagaaaactgttggtcctgtcggatggtgttagcacattgatgagaggagaaatgggaggaagaggtggtgtagagagaggtggtggtggtgtttggcttgctcttctctgttgttcctgggacttggccgtctgccggtcgtctggggaggcggggcggtgctgaaccaacgcccttcttaagggcacatttcgcgtgactgtcccaatgccggtcgtagtggtggtggtggtggtggcggtggcggctcgcgcggcggtggaggcggtgagcatttgttacagcaaccgactgatttgttttgtttttcagaaaccaagtgttataactgtgagttttgcttctgacaccgtttaattgggaatggaacataaattgtgatggtttttgtatcaatttttcaggtggacgttctggacattttgcccgtgaatgccgtgatgccggagaccgcgaccgtgggcgcggtggtggtggcgggggcggcggacgaggtggcgatgaccgcggcagcaaatgttacaactgcggtggttacgggcactttgcacgcgaatgtcgcgatgagagaagcgccagcggcggtggacgtggcggcagagacgacagggatgaccgaggcaacaaatgctacaattgtattggcacccgatttatataaccaaaaaatgaggaatttcactcgaacaaaaaggccctcagccaaaatcccactgataaatgacagtgagtgaaaagccacactaattgttgttctataaaacggtagagctgtttgaacattcttgttaaggtgggaaaagcggtcatttttcgcgcgagtgtccggagggaagcgaccgccgcggtggtggcggcggtgggcgcgaccgtgacgaccgtcgctgctacaactgcaatgagccaggtaagagggccagccgataaattccagattttttttgg

SEQ ID NO: 29581 - DNA, 964 bp, Heterodera glycines
agagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctctgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgc

SEQ ID NO: 29582 - DNA, 1066 bp, Heterodera glycines
ttaaaaaataaacagaaaatcaattagaaaaatttcctaccttcattgtgatgagacttgcctttgtgctgaattcagagatttttaaaatgaatttttatttttcaattggtaaaaaataatttcatttaaggaaaattggcttatatttgccagatgaatcattaaatttttggtttggcactttcggtaaaaaccaatcagaaaatatttttgaattaaatatttccacgaatttttcaccattattgcttactttatgtttcttggaccgcttctgttcacatcattcatcatcaccaagttcgtggtatttggcggcattggcattcgttgtttcctatgtcattcccatttttaaactttggcattagtgatgacaattctatgccattttttaacttcccaatagtgccgttttgggttttttcaaaaatcggcatgcgtgccgacatttcgatgccactttgcaaatgccatggtgtcccgttttgtgccaatgcaagttctgtgccgttcccattttgatttatgccaaatgcgcccgttatcgaggccatcgccccaagtgtaccaaccacggcatttgaccaatatttttcaagtggccaaatgccacagtctcgactccttaaaagtcccgggctttttgggtcttggttttagtcactagagtatcaggaatttttcgatatcgagcatcactaaatattaaccaagctcccttatccccgtcgggataactcttgttggtgagcggggtccgtcagaatgacaagtcggggatgggtctaggacgtttctaaaatcggtattttaagcgaatttcgacgaaacattgcataacttttgctaagcgcatcaaattttcccggcagcgccaatcggcaacgcccggaagtgaaaattttgttaaaaaaaatgcatttaaattttcaaattttttcactgcggcgccctaccaacatcccccggccccctgttcccaaaaaacgtggcccaaaatttttttttttttttttttattggaaaaaatttttcaaaattgttgattttggattccaaa

SEQ ID NO: 29583 - DNA, 917 bp, Heterodera glycines
  misc_feature (899)..(899): n is a, c, g, or t
ttggtggattatttttgaaaatattattaaatctactaatttataaatgggacaaatatgggagcttaaaattatttttaataattactcttacgcgatttttccgtcttcaacgagaatgtccgcttggaacatttggtcatcatttaccacagtcccaccgaaaattaaaattttattagccataatttcaaaaaaaaacaataaaataatattcaaaatagctttaattatcaattaaatgaaataacatcaaataaatggtaatttaaaaaatatttccattaatttgtttataatttggccaatgggttaaaagttgtaaagtgtcaatttgggacaaaactaaaggagaggaaaagacagcagaagaagaacttcacaacaccaatcttctgaataaagtcgataaaacaaagacgaaaatgaaataaaagattgattttaaataaaaccaaattaaaaaagaatttttaaattgagaaaataaaaatgttattcgtaaaaaataaatagcaattaattagtggcaattatggaataaacaaacacatttcttatcagcagatgagataaccttttaatgggactatcatttgaaggaaaacatttaattttgctgtaaaatttcctttttcgatgtttgcaattgtggcttttcgtccttttcggcattccttcgtccccccccctccgccgccgcttttcccccgcttttcccatcttcgtctctttctacaacaattttgtgctttcgttgttgttccggtccttctgctttatttgcggtctgtgcagtgagccgcttgtggagctggtcgagtgcagcgaccggtgaaggtgtccgtccgcaaaagtggacagcgaaagtgccggcacttccatggccaaattgttgntgaacacactgctgcccg

SEQ ID NO: 29584 - DNA, 959 bp, Heterodera glycines
cctcccttttcattcactcatttttcttttatgagtgttttactatgttttttgtgaatttcataaacttcactgtttcaaaaagacatatttcttatcttaaccagtaaatacccaacccgaattccaaaaattatcgacatcgacctgaaagtttatcagagtttccctggcctatactaccaaatttgaacctaaatttatcaaatttttttttacaaaaactgcaatttccctatttttaaatttataattcatttcattatgtattgtttttatgttttttccttttttagaacagaactatttgcgtttatcatcatcatcatcccttcattgtgcaataacaacaacacttcaaaagcgacctcatcgccgtttctcatcgttcattcgtccgtccgtccttcacatcaattcgctcgccgttttcgcaatggcacgtcgacgcatccaaaaggtggcaaatgacaactctctgatcaaccaatgctttaaatgttttgatccatttgcaggaaatggcggagctgcatcaggaactggtcacgacgggttacaccgcggcaccgatggatgacggcagagacttgtaccattggaaggcctccatcaaaggaccgcccgagtcgccgtacgaaggaggcaccttccatttggacatcgttttccgtcgcgactacccattcactccgccaaatgtgaaattcgacacgatcatttaccatccgaacgttggagaaaggggcgacatttgtttggacattctgaagcagatgtgggcgccgtcgttgaccatttcgaaaggggaaagagcagacaaaacgccgacaaaatatcgacaagacaaaatggtccaattcaaaacgacagccaaaactgtactttttttggaagtgtgatatttttgtcgtttgaaaaatgggatttttcaatttcggaaatggcgttttaatcct

SEQ ID NO: 29585 - DNA, 743 bp, Heterodera glycines
ccgaaaccaaaaaatcgatttttcaagtgtccgttggggtctcaaaccattatgggaacaaaattccacgcggaattaagtacaggctatagggaacttattccggaaggttcggttctccccaataatctggggcgcatcggttcggggggacttcccccgaaacaaaaaaaatcgattttttcaagtgtccgttggggtactcaaacaattatggggagcaaaattccaacgcagaattaaagtacaggctatagggaagctattccggaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacag

SEQ ID NO: 29586 - DNA, 1326 bp, Heterodera glycines
aaaaaagcgggacaaagagctggaacctaggtaaaacaacagtccacgcaagaagacaatttgttagaaaaagcaaaaaaggaaatagaccaaacagcacagaatgcagccctaaaagctgaatatattcgcacactagttgccaactcaaaacataatagaggcgttgcagaaggtaggcttaacacatattcaggtgtccctcaattcaacgaatggcttgaccaaattgttgaattagataagaagatagacgaattggcaaaaaaggtaggaaatgaaccgtcaaaggtaataaacgctaagcaacaatttgataaaccttatcgaatgaaaaatttgacagaagcgcgaaagctaatcgaagctgcaaaaaatgcgtttgaagttatactaaactattcactggaaataaaacagttgaataataaaatgcatgaattaaatgacaaattcactgttgcagtcaaagagaaggaagaagaagccaaagaaggtgcggcgattaatatacaacaagaaaagaagctagaaaaggaaattcctcaagtcttaaaggaactggagcgggaaaaaagtcagcatgatattaacaccactgctgagaacacggaaaccgaatttccctcctccgaatatgaaattgacgacagctctgagaagcagccggaacgaacggaacaacaggcagaggtatcatatgtattgaagaaaaaggaaggaaaattggaagaagaaaaaattgaaaccaaggatgataccaccattaatgaatttccaactacagaatatggaatagaagagagtgaaacggaggagacagagaaatggtcgccggatcaagctaaacaaaaaatattgaaaggaaacgaggagccgtttgagcagcccgatgaccaaaaagatgaagagacaattttggttatcggtaccgataaaaaaggagaagaatttccatctaaccaatatgagattgaagataattatccatcgtcatcatcatcatcatcatttattgcccaaaacgaagcatcggtaacgaccaaagatgaagaaggattgttaacggtccaaattaaaaaactaccaatgacaggggataatgagcaaaaaacaatacaaatggtaccatcagattttccttcatataatgacgatgatagcagagatactactgtcaatgaattgtcagaagaacagcttgcttatactgttcccgaagaagatatgccgaaatcggagccttatgatgtagatgagttcccagatctgcctgatcctcaaacgagtctgccaaggggagaggaggtgataaaaaaggagtaa

SEQ ID NO: 29587 - DNA, 869 bp, Heterodera glycines
cccccccccctgccccccccccccccctgttcaggtatggggggggggtgcgccggcgcaccccttgtacatgtatgtatatgttattgattgttttatttatttgtatttccaagcattttacaatgaatgacaaaaattcattcaaagaattcactcaaaaattttcatatttttattttttgagggaaaaaggaaaacgacggccggcaaatttttttttttatttaaacagatttaaattttattttcttacacttttcagttttttttaataattaaatttcccctaaaatttagcgcgtgttctgctggatttacaaggtgcttgccgatttggtcatgttactccatttctataatattaaatccgtttttcaaaaaaatagtagtcaattttctcgccgtatttcttttgtttttaaatggaaaagattggaatccaattaaaagcaaaatgtaattaattataaatttattcctggcctggattttcgtgtcaaatatgaaaaaaagatttgccacgaaaaatcgttgttttcgaacccttttgctttgattttttcaaacaaaatttcaaaaaaaggaaatccatataccatggttaaatgtctaggctttttttccaaaataccataccctcgagagattatattttctttttttttgtaaagcacgagggcaagcggatgaagcccgaactgcggtgccatgccgtgctctgtcgccgggcggacgagccccaacaaatgcaccaaacattgcgcagacatctccaatcggcactccaagtgagtaatcggaggggggggggggaatttattaaaaaactaaacattttccaaagtaagaaaaaatagtgaaattaa

SEQ ID NO: 29588 - DNA, 1344 bp, Heterodera glycines
cactattttcctttcttgatatggacaatcggtccctttcgatactattgatcaaattcattagcagccagcgccgctgattgacccgaaatgataatggcacaaatcaagagtccggatgatttttaatgttcttatgacacttcatcaagtgccagatttgaatggaaatgcaggagcgtactaagtcaatgcgttcttccatcaattagactcaatcagtgaggattgacctaacaaaaagcgtttaagcgcatttaaatcaaaatgctcgggtagagcagagcacgcatacatttctgcagttgtcaacaacccatttcggtatgaaaatatcagaaaggccattaagcagctactcgattctatagatgcgaagtcgactgatgactgggtttgcagaaggaacggcgatagcattgatgacttggcggaccgagtgtcatcattggtgtgaagagtttatccgggctcggtgaacatatgtattacgattattcgatttggcaccttatctaatcgctcaaaacagtcgttgggcgttggcatcgcccagttgtcacgcctggttatccctctctgctgtcaaatatccaccgcccctccccattcgataaatcctcattttctacttgtacaccgatcccaccgtcatcgccgtctgatccatgtccatccattccgcgtgcgtcgcccacactttgatatggtagcggtcgcactgtatctgctcgctgttgaacacaactttggtcggcctcgtccctttggtgaacgttttgaatttgtagtcactgtagtcttcagaaactgtccatttctccactgttttgccctcctcgtcaatttccagtatcgtatttttcattttatcttcatcacaaaacacgcggaagtggtaaaaaaggtcactcgtttccaacgcgggcccaatggtcagattgaaaaagttgccaaacataatccgcttgttcagcccgtcgtttggaatagcattttccagataaggagcaggcttaacaaatgtttaataaaaattttattttctgctgaacaaatttccccgaaaggttaaatattgaacatgttttacccatgtattcacgccatttcgtaaccgtgcatccattgcaattggcatttccgcattcattgcattttcgttgattgacatttccgtccagagcatccaaatgtacacgcgaaaataatcgcacactcttccagaacggaagttcagtgtgacactggccaagtcattcgcttgctcctccgcaaatgccgcttctccccccgcataaatctcctcactgtccccacaatgtccaagctctagagatcccc

SEQ ID NO: 29589 - DNA, 2035 bp, Heterodera glycines
  misc_feature (1327)..(1327): n is a, c, g, or t
aatctcccggccgaaggccgggagcgccctgaaagtagtggatgggtcttacaactttttgaggcgcatctgggaaaaataagggttttccgctccggtggccaactgagtcccggcggctgatttctcacttttgcttgcgtttgatggcccataactttttttctaaaactctgatcaaaaaatgcttgctggtaggaaactaagttgaagtgttttctaattttcaaaaaaaattccaggcctctacctatacttggaagggctgcagaaattggcaacttttcagtaccaactttgcccagttcagtccccgttgaataactcattaggctttgacctgagcgcagggtggccagcagacttattgtagagctcggtgagctcgatttttccaaattttaaaatttcgaaaattttcaaaatttttcgagctaggcctaaaaaacggttttcgggtttttgaattttaggattttttaacgaattttcccagaaaaacgaagaccacttccaaaacatagtttttcgagctctatcgactggtatttttttcggaaaaatttcggttttttcccggaaatagaaaaattttttggcctcagcgggacatttgagtcccgggcccataacttgtcagggcttggatttagccaaaaatcgtcttagaacatttttgtagagaattttaagctctatcgaacggtgtgctatatgcccggaaaatttcaaaaattttcgagctaggccccctagaaattttcagaatttttttttgggttgaaaatgggggtgaaattttttttctgggttattttggggtgctgagtacgattatgatgtctattttaagtttcataatttttggaattttttaaaattcgaaaattttttaaatttttttggtccttggaaatttggattaaaatttgaaaattcataactcggtgatggtttcatcgatttaactataataaagccttaaaaatagcaaaaaatcgggagaattttatgggatttatttggttttataatgttcaaaagaaaaaaagttattccagaatttctggaaatttttgatttttcagaaaaaaattcataactcggttctgaaaagtcatactgtaaaagtaaaatactgcaaaaatccgcaatttcttgctctattatataaattttattttatatttttatcacatttttaaaaaaagatacaaaaataaaagtgattttgggattcgggaccaaagggggtggacaggatttttgagtgaaaaaattttttcgacaaaaatcttccaaaaacatgtctttaggggttatttgngccgctgatcacgaatacgtgatcagattttacttttgacatagtcaagacctcagaatccctgtgtgattggggattctgaggcatcattttgaggggggagggggcaggttcggatccggacggtgtacattaattttctaccatttattttctatttttcaatttttgttcatttaaaatatttttaattttattaataataaataaaaatttttcatttgaattaaattattttttggtgaaaattttattaaaaataatttttaaattttgaataaaaaattaaagaatatcatgtttcaatttacattgaatttgtaaaaaaataaaatttaaactgatgtacctcttctaattacccttctacctcttctaatcactgttgtacctcttccccgttgttgtacctcttctaatcacatttgtaccttttttaatcacagttgtacctcttctgatcactgttgtacctctcctaatcactattttacctcttctaccatttattgtacctcttataatccctgtaaggtcaacaaattttggaaaaacgggcgcgaagcgcccgactgaggccgcgaacggcataacaagctaaaaaacgggcacgaagcggccgactaaggctgagaagcgtcctaatttccctacaaagtttgaaaacggtcgcgaagcgcccgtcctgaggccgcgaagaggccgaat

SEQ ID NO: 29590 - DNA, 920 bp, Heterodera glycines
  misc_feature (871)..(871): n is a, c, g, or t
ttttcaaaatttgtcgaagatctgtctacctacaaaaacatgatgaattatagataggtatgtggtgctgaaaggtgccgttggcgggagaaaagtctgttttagtgaaatttgaacttttaaaacttatggggtaaagtgccgaaattgtcaaaatctataccaaaaaaaaaaatcagttagattgtcattgttttgttaattttttgtgaaaattctattatattagtgaaattgtaaaatccgttaaaaataatatataaatagtagtaaagtctaaattgttaaaataaattttaaaaaatcaaccaaattgtcatctctttgcgcattttgaaaaagtttatttaattgaaatttaataatgcttttaaaaataaagaaaataaggggaaatgtgtcaatttatagaaaaaaaatcagacaaaatgccattgctttgcgcttttttgaacgagcaattacttatccccccctcctcacaatggatgccacacagccacctacctactccaatttcacaaatattctcacacacgcaattcacattcattttgcacacaggcggcgacggcatttttgtgccgtgccatcgtcggtgcgtttggccggcgtggacggcacgcgcttaattttcgcgtaacggaattggcttttcgttccccccccccccccgcccggaggcgctgtgcgttgtgttgttagcgtgatatgtatgtatatgcttcacgggccacttggggggcttacatgtctcagcttttccttatcggcaccctcatccatgggttctgtgccattggacgagtgccgagaaggggggggggggggggcggacggcacttcaatttcgttggttttgtttttcaanaaagtatattgaaagtcgggggaaatgtgatgaaaagctaaaaagaatg

SEQ ID NO: 29591 - DNA, 1418 bp, Heterodera glycines
tttgcttcgtctagacagattttctctgcaatcctccggttgcttctctatgatgttcttgggtctcgataactcgtacagcgacgtccatccgaaggtttacctgcacatcgattcagttcgccacggcgcgggtcgaatggcttcacgtgttgcagaacgaagtgcagttgaacgtcaaaagcaccggcgattgtctgaatccgttggcactccgcatttcccccccccccccaatttcagacgtcgacgccctttacgctgcgttggacgcactgaaagtgcactttgacgacgcaaaagaggcgggcgaaacgatgagcggagcgacggtcactttggtgagcaatttgagcggattggacgacgagcgggaggtgatggacggagtgggtgacatcgcggccggcttcaaagcgttggactgcgatttgctaattgtgtgagtgaaagagtggggggggggggggtaggggggcggggacggcacattttataatggaaccgcaatttggcacaaatgccatgtccttcagtggccccgacctctcattggatgagtcccaactcacaaaggcgcagcgactcggccattccttcgccatgaaattgctggccaaaacgggcggaactgcgtacaattttcagtacgttctccacatagggccggcccccaattgacgaattcgtaattttttgcttcagcgaaggtctctcccatctgaagctgttcatcccaaagtccgtccacccccggggcacgcccttcgcttttgagttgggcaaggacttcgcagtcaaagtgcaaatgtacgtgaagaatgacgacaaaccggcacttccgctcaaattcaaccaggtggcatggcagaaaagtgccgagtctgaccaggcccaggaggtgaattgggcacaattggattaaaacagatatttccgctgatcagctgcaaaaagtgcgccgttatgagaccatttcggacgcctccgccgccgccaagaccatcagattcgaccaaatcgaccaggcgacggacgccgccatcgctgcttttaatcaagcggcgcccgccgcacttccgtccggtcgcttcgttgaaaaggaacaaatcacgcgggcgttccgttacggcaccacactggtgccgtttggcgaagaagtggccaaactggtggactacgaaagggagggcaagcagctgcaactgttgcaatttgtgcgcaaggaaaacgtcagttttggagaaaaaccgggaaatggcaaaacagtgaattaattgaacggtttacaaccacagattctgccccaattcatcatgagcagcagccgatacattttaccagcgcagggagacatggtaaggaaacggaaaggggggggggaacggtcgaatgacgagtcgaaaagggacctgcag

SEQ ID NO: 29592 - DNA, 1830 bp, Heterodera glycines
  misc_feature (1733)..(1733): n is a, c, g, or t
ttttatatcatcttttagtagagttacactaggaaaattgagttaaaaattaaaaaaaatttttttaaggtggagtacaaaaatgactgttccgtgaatatttggagccattcctcattttgaatgccgactcggacacaatccttagcaaatgtagttattggcgaaaagtttgggtcataaaaaaattatgaaaaaaaggttttcttttttcgatttttgtgctccaaaatatttcaaaactaacattaaaacctaaatagcggtaactttcaatatatgtaattcaatacttaattgtttaatggttgtaaaaacatttttaattcaaaaacaaaatattggcttaaaacattggaagaaattcttatttaaaaaaattatggttgataaattcttaaataaaattttcataaaaactgaagaaattccattttaagcaaaaatagcatttacaaaaaaatcaaatccatacataaaatgtgtgaacgattaagtggtcaatctgacatcgataagtccgttaagtatcaattgggtttgcattcggccgtccggtcagggtcgttttcgcgccgccgttttcgctccaggtctgagaaaacatagatcgtaaatttttacaaagtaatgcctatttaggcgttggcccataagctttggcttgtttttgactggaaaatttaccacccaaaaatttgcaaaaaatgcactcgcgcgaaaacggaagcgtaaaaacaccctggggcgaaaatagcggcgcaaaaaccctggcccgcgtccgttacgtccctttgtaaaagagtttgtcttctggcattctaaataattggtagtagttatcaaaaaataaattatttaaattgatttataattaatttagaatcaaaatcgacacgcactttttaatttagtctgaatattaggagatgggtcctagaaaaagcaaataaggtccgagaactttaagggaaatcggggttgttatgccaacgtcaaaaagccggaacagagaccggtttttgaactagacataaaattcatcttttaaaataatagtgaatttttttcagacttactttgaaagttttgggaaaatgaaagggatattttcatcggctctcccgaaatggcactcgcacttagtggcaaatcttttgttgatttggtcgcaatacatttttgttgcttgagttatacagccccactcacgatgaaaagctgaaaattaaaaaggatatgggtaggaatagaacggagctattttagaataagttacaaacaaaattaaaattcgttaaaaacagcaataaaattttcattgttttctttcgaaaaattttgggtattattagttttattaaatacttacggttagtacaatttaaaaatgaacaatgtctctcgtggagatccgcattacaaaaaaccattgacagtgggtcctcaattcctgctgagttcattgacccacgtagacaaacgaccgcttaaaatgtggtaatagtgtactttgtccccaccacttttcgaaattttttgtttttaaaagtcatgcatttaagcaaatcggaaacgaatcaaggtcattatttttcggtaaaaggtcatttaattatttttagacacaaatctaaaactagtatatttgattttacgacttttggttcgaattcgagcttggaaatgccggactcggacccaaagaaccatggtatcatccgaaagcaaanacttaatgtagtcagcgaccccaaatttttgcatctttaaaaaaatgcactaaccctgcgtacgaggagtgatcaaaagagtaaacaacacatgcat

SEQ ID NO: 29593 - DNA, 1680 bp, Heterodera glycines
gatcagtgtacatgcattttgtcgaaatttgaaaatgttggctcttgggaaaagcttatttgcatttgatgatcaagccttaaatgtcgtgcaaaaatgtgtaatcaaaaataggcatctttccatttcttaccgtaatcctttgttccctttccgatcagacaggcaattgccatcatcggttgacgacggcgccattgccaaccgatcaacaccgccaagaacgacatcatcatcaacagcagcagaggaagcagcacagtggatcatccggggcttctggtacaaaatgctgcaaaacgaggcggccattttgaacggacgcattgacgccgcccgactcgtccaacagttcatcgacgcatatccactctgtcaaccgcacattgccgaatcacttttcccatttgccgcggcagttttcgccgaagtccaacagacgaaagccttgccgccatgtcccttcaaatagaaaagactaattagtttccgagattagcttctcctccatctactttatggcacatctctgtcccccattctctcctcattttgttaccaccgcaccacatcacgccccatttgccaatgttgaccaatcgtgccgtgccgtccccgttcctcgaccaatcaaaagatgttttcgtgccgtccccattcctctcgctctctctgccttcaaaaaacaaaaatttcaaaatatttttcaattgttgatcccttcccgccccctccaccacacctctcattatgatcctcaaccaccacaccacatccagtgcaaaagtgctgggaaatggattttcgcaaaaagcaaattatcttccatttttgccgttcaaagatgtgaaaatccgttttcttcaaagcatttccattttatatatgaatgatcttcaaaatacaaatcacagatatatttttgtttgtaatacatagtaccaaaagcttaatcagcattttcgcaaaaaaaaaatggaaattttcgaaaattctgttggctgattgtgcttttgcactgttactatttattacggccttccacatacatatgtattctcatgtgccatcaaaagacaaatcagaaaaaaatggaataaaatattttaaacccaaaaagaataaatatttttcaaactttggaacatttatttgaattaaggtcattataaagaataggcatttaatatttgcaaaaaatcgaaacaaaactgctcaaaaagtgaatttttcaagaaagtcacattctttatccatttcgcaagcacatgccaatcaaaagtatttcaatgctttttaaaatatttttctcgctctctaaaattgacttatttttcgggatttttggctaaaattcaaattttaccttaaaaagtaaaaaaaaaaaagtcatgaaaaaggtcagaaaaattgcaaaaaaagtcaccccaaaagtagaaaagtcaaaaaaaaaggtagaaaaaatgaaagaaaatttcgagctcgctcggattgaaaagaaaacttgtaaaaatgctgcttttgagcttctcatgcgataaaatatctgcaaaaaaatttccccaggatgaaaatcagaatttgagacgccctttgtcctgaattttgaaaaaaaacttgggaacattgttttaatattggatttgatttgatataccgtattttctctaatgatccccc

SEQ ID NO: 29594 - DNA, 979 bp, Heterodera glycines
  misc_feature (815)..(815): n is a, c, g, or t
aagagaagcatagaatgtcatttacggttactgatttactcattaaaaattccaaaagccgatttgacggatagaatttctaaaaattcaacaaaaggactaactattatttcttcccgtgtatccaacaagagaagcatagaatgtcatttacggttactgatttactcattaaaattccaaaagccgatttgacggatagaatttctaaaaattcaacaaaaggactaactattatttcttcccgtgtatccaacaagagaagcatagaatgtcatttacggttactgatttactcattaaaattccaaaagccgatttgacggatagaatttctaaaaattcaacaaaaggactaactattatttcttcccgtgtatccaacaagagaagcatagaatgtcatttacggttactgatttactcattaaaattccaaaagccgatttgacggataaaatttctaaaaattcaacaaaaggactaactattatttcttcccgtgtatccaacaagagaagcagagaatgtcatttacggttcctgatttactcattaaaattccaaaagccgatatgacggatagaatttctaaaaattcaacaaaaggactaactattatttcttcccgtgtatccaacaagagaagcatagaatgtcatttacggttcctgatttactcattaaaattccaaaagccgatttgacggatagaatttctaaaaattcaacaaaaggactaactattatttcttcccgtgtatccaacaagagaagcatagaatgtcatttacggttactgatttactcattanaattccaaaagccgatttgacggatagaatttctaaaaattcaacaaaaggactaactattatttcttccgtgtatccaacaagagaagcagagaatgtcatttacggttcctgatttactcattaaaattccaaagccgatatgacggatagaatttctaaaa

SEQ ID NO: 29595 - DNA, 1102 bp, Heterodera glycines
aaaaatttaaaaacgggcgcgaagcgcccgtcctgaggccgcgaaacggccggatccctaccacaaaattaaaaaacgggcgcgaagcgcccgtcctgaggccgcgaagcggccgaatatccccataaaatttaaaaacgggcgcgaagcgcccgtcctgaggccgcgaagcggctgaattagaccttagaatataaaagggcgcggagcaccctttgaggccgcgaagcggccgaattaaaccttaaatataaaaaaggcgcggatatggaagccgcgcatgcactagcaacgaagtcctttgcgcgaagcgctcatgtcagcgcccgcccatatataccaaaagtatactgtctacaccgagcaattactgtgcaaagcatactgtctacaccgagcaatcactgtgcaaagtatactgtctacaccgagcaactactgcgccacacgctagtttagatataactaaagaaacagatgaactcattgctaaaacaaaaatctcgggaaccgctggcgggagggactcgggagtgtggcattgcttaagcaactttttgaggcgcatccaggaaaactataggcattccggtccgagggccaactgagcgccagcggcgctgaaacggcttttttaaatttttttttgctgtttttgggattcaaaaattttttaaagtcctaaatgaaaaatcggcctcgataggaaatcaagttgggaggtttggcacaactttttgctcttcaccgacctcgtagggcctaccagtttttccgaaaaactgcgcaaaaattgcatacttttttggccatttcagcgccggcggaataactcgtcggggtttggagggaggaggtcggtgtaagcggcttttttgtacagctcgacgagctctatctaaccatgtttttggatttctgaaattttcagaaattttcgagctaggacccctcgaaaattttccgttttttaattttattattttttacagatttttccggggaatacggagaccactttcaagcaaccgtttttcatgctctatcgattggtggcattttcgagaaaaattttcaaagttttttttggaaatacaaaaat

SEQ ID NO: 29596 - DNA, 1718 bp, Heterodera glycines
  misc_feature (42)..(42): n is a, c, g, or t
  misc_feature (55)..(55): n is a, c, g, or t
ccgcatgagttccattttgcttcgttgataaaacggagtccnacaaattatgtgncaaatttgacatgcctgagaaaaatgtatgtttaggggtggttatggaggctaaaattctaccaaaaatttcgcaaaaaaaatttccctagtcctgccgacccctgatgtataattactttattaattaccttgatggtatttttcggcctttgtcacctttatcttttcggcattgcctttaaaacacattaaaaataaaatagcaaaaaatatacgcatttttcaaaaacttctaaaaattctttaaaaaattgtaaaaaaggtaatataaaaatatttatgatttattaatattcacaacgaataaattaaggtaaatgcctaccaattctttcatgaatacagaaaattgaagctaatgtgccacgtgtaattgattttttccaatgaataaattttaaaaatatataaaattacgtgaattttttttaaatgaaactcagtgatttttttcgcaaaaattaaaccaaaacggttgagccaattaattaaatcaaacgaaaaaattaaatggcccgggtgttcagccttcaactttgataattgttcctttttttaataaagcactaatatcagggtagccagatctgaggatttatcctcattttgtggctttttgataggtcaatgaggattgttgaggttccatttgaattttaaattttttatgaatttttaattattcctattacccccgaggattggatttaattaaattctctgcttctgggatttttttccattaggtaactttatcttttgattgatctagtcaatttttgaactgaactatgaaaatgttagtaaaatttcctaggtggaaaattttttcaaaaaagaaacaaaaaaattatgcaaaagtggtgaatgcataaaaaaatttttcctcggatgaaaaattctgtgtaaaatttgtaaacatttgtattgttctaattgaacctgaaaatatatttatgcgtattggttttttaaaaaattttcgaaatcagagttttccgtttttttgcaaaattaattcataaatttttaaagaaagtgctcggtaaagcaaagttttactgaactgaactctttctataattaataaaaattcgcattaaattttatcggcttactccccggtacaggactagcctaacctgaaaatttcaacgcttattgggttaaaaaaaaaatttttttttaaattcagtgttttacatgaattaatgcttacatatatatagaaagaagtcaggggtgggacaactctcgcctcttgcctctcacctctcgttttttgggacgagaggcgagaggtgaaaatacaccactaaagattgaacttttgagcagtagaaaaatattcaaatttacgcgaaaaaacatgctaaatctctttttatgcttccttaatgtcttaaaatcaaggaatatatttttggatgatcctaaatttaagtgtggtctggtgtctaaaccttctgactttcattatttttcgcttgggttcaattccccaacggaacagaattttttttataatttttatattatttcaattgaaatttaattaataaaaatatttcaacttaaaaattattattttttttaacagtctaaaccgcaaatttaccaagactttgatcagcttttgacaaattctgttaacatatctc

SEQ ID NO: 29597 - DNA, 891 bp, Heterodera glycines
attcataattatttttttcagaaagtgctctgaaacccctttaattttatttacaagctattttaggcactctgatgctttttctatcaaaaagggagatgaataaatttttaaaaatttttaattcctttttaaacaggccaaaaagttttggcttaactttttttttcagaaactgatcagaagcgcaccaaactttgcagggaaactccccggtaaaggactaacttacactgaaatgagcgccgagctagctgggtttaaaaattttttcgaaaatcagagtctttcgtttttatttaattatttattattttttgcaaaattaattcataattattttttcagaaagtgctctgaaacgcaccaaattttatttacaagctattttaggcactctgatgctttttctatcaaaaagggagatgaataaattttaaaaaatttttaattcctctttaaacaggccaaaaagtttaggcttaactttttagtgaaaattaatttactcatttttcgagtagtgatcagaagtgcaccaggttttgcaggagcctaaaaaggtcaaggaaaggcgtctctgcgttgatttagcagtagtacctatgaatttaaatttcctatgaatttttaaaggttcacaatttatttattttttgcaaaattaattcataattattttttcaaaaagtgctcttaaacgcaccaaattctatttacatgttaaataaggctctctgatgctttttctatcaaaaaggaagatgaaaaaaattttttaaaatttttaattcctctttaacaggccaaaaagcttaggcttaactttttagtgaaaattaatatactcatttttcgagtagtgctcagaagcgcaccaggttttgcagg

SEQ ID NO: 29598 - DNA, 983 bp, Heterodera glycines
  misc_feature (911)..(911): n is a, c, g, or t
gggggcaaacgaaataaatattaggcaaaacaatttcaaagaaaagccatgaaaaggaagcagaaagggggaaggcgccctctttgatgaagccgtttcaaattgcattttaatacgaaagggggagaaaaggtgaaacaatggatgggggggggaaaggcagaaaaatgggataagtgttggaagtaaaaaagagaaaaagtcgagaattggccaagtggaaaagggaagggagggattagagagacggggaaaaagggggaataaaccaacggtgagggcgagggcaaattcggattgaagcggaagagaataaacgacgcactggcagttgctttgcctcgagacaaatgaaatgaaggaaaggacaaagttggggggagtgaaaggcggggcgacatgcgccagagattagacccgaaaatttgccggaaaatactaaactacagtgtcttggtcatatttttaagaatcattagatattagcattccgagactgtatcgtgtaaaaacctctagatgtgtccaaaaactaaaagattacaaaaatttttttgtttcgtgaacccaccgggaagaaagaaagggggtgggggaggagtgactctcatccaacattattcttcatcccttcacgacggggaaggggggggagaccccacccctaataacccgaattcgaatgtcgtgataatttgtccccgccctccatcggcccttcctcctccgttaatttgtccgcttttcctctccaaatttattttttctggcaaaagtacgtaatttgttttgtcttaaagtaaatcaacagatgtttaaatttcgttcggttattttactttcattttatcgatctttttctttaataattggaaatttgccttcgttgttcaagaaaaataacgaacaanaattgcatgtgaatgaaatgccacggacggtccattaatgcacgaatatttgtccatttcattgccatttcc

SEQ ID NO: 29599 - DNA, 1019 bp, Heterodera glycines
caccaagacatttagttgattagccaattaagaaataagtaaatttctaaccaaaaataacttacgattcgtcccaatgaaagcacagtgacacaaacggagtacaggtcgcgagcctcgaacaagtcgacactctgaaaaggtgcaattaaccagtgaatgccaaatttaaatatccaatgaatggcacctgaaaagtttcctccgttggcactccttgggccttggcaaatgacacaaaagcgttgatgttctaaaggggagttattcgtcttctgatgcttctccctcctttctccactcacttccatacaggcgaaattgccggtcggttgttgaattttcttgaccgatccgggctgaatgccgttggccaatctgatcagataggcaggctttcgcattagtaaaatccctctaaatgtcactaacttgcacaacaaagtgccatccttcaacaatttatagaaattctcacggctctgaaaagattcgtttcaaatttggattttgccatatccaattaattcgtcaccccatccgtgctgaagttttcaccacttagctttttgacccagtccaggatcagcttgccctcttggtcattgaatttgctggcttgctaaatgttaatgaactcaatccgttagtgaacattttctgtgtttgaacctttgccaccacttggaagccaatgccaccgggggtcgcgcgagaagacattttgggagagggaacaaagggaaaactgaaaatggaaagaaatgaaaggatgaaatgaggtgattgaaatgaagggggagggggaagaaagagtgattgaatttcagcaaacatcggaaaagggggggggacaaatgctttgagaaaacaattagcttcaaaggaccatcggagggaaaggaaatgagtgagcatttggccatggacaattaattgaggaggcgagaaaaggcggaatgagttgagcacaagcagagcagaagaagaagagcagcagaagcatgagaaagatgaaa

SEQ ID NO: 29600 - DNA, 787 bp, Heterodera glycines
ttattcatcattcatttaagcaaaaataataataatttttttttttttttgttatttttttagcaaaaaagaaaactgaagtgcaaaagtgccaaaaactgtcttataatttgccctcaacaaaatgtcagaccgcagaaaagaagctgaggaaaaaatgggaaaagcaatgtaaaattaaaaatgccaattttcaatttcacttttaaatttaattttaaatccaattttaaattttgttttccttttttttcagttttatctccgccgattgttggctcaaagtgttcgatttgctgccaccttcacaacttggcctcggaattgcgctgatcagccgacgatttgacttttacatggacgaacacttcaaaactcgccgctgggcattgaaatcaattcaaattcaaagaaaaattggaaagaatggcaccaaggaaatggaaattgccaattacgacggaaaaccaatgccaactccgcaaattcaattgccacgcaaagtcagcggattcgaacggatcaacatcacgtaaaattgggtttatatataaaaatatttgacaaggaaaggacgaaggacacaagtatcaatggtcgaatatttaaatttaattattattttttaattttatttaaaatctaagtttgttaaatgcatgaaaattgctcaaaattcaattaattcataacattctttatatgattcgatagcccaaagatttctctgttattctgttaaattcaaaaaattttgtagagttttttaaaaattagggtcaaaatt

SEQ ID NO: 29601 - DNA, 1215 bp, Heterodera glycines
ccctccacaaaattatgaatgcgtcctcgcgatgcctgtagaccaaaatcccttatcacatccataaattcatttcaaaaccgcgcatgcactagcaacgaagtcctttgcgcgaagcgctcatgtcagcgcccgcccatatataccaaaagcatactgtctacaccgagcaactactgcgccacacgctagtttatatatatatagagaaaaagggggtttcgtcttaaaaactaatttgagtcgaacggctgtcgggaggggtctgaaagtggtggaagggtcttacaactttttgaggcgcatctgggaaaactataggttttccgctccggtggccaactgagtcccggcggctaatttctcacttttgcttgcgtttgaaggcccgtaactttttttctaaaactctgatcaaaaaatgcttgctggtaggaaactaagttgaagtgttttctaattttaaaaaaaaattccaggcctctacctatacttggaagagctgcagaaattggcaacttttcagtaccaactttttccagttcagtccccgttgaataactcattaggctttgacctgagcgcagggtggccagcagacttattgtagagctttggaagctcgattttctgaaatttaaaaatttcgaaaattttaaaaatttttcgagctaggcctaaaaaacggttttttggtttttgaattttaagaatttttaacgatttttcccagaaaaacgaagaccacttccaaaacatagtttttcgagctctatcgactggtatttttttcagaaaaatttcgattttttcccggaaatagaaaaaaattttggcctgagcgggacatttgagtcccgggcccataactcgtcaggagttggttttagccaaaaatgacctcagagcaaaattgtagagctttttaagctctatcgaatggtgtactacatgtttggaaattttcaaaaattttcgagctaggccccctagaaattttcgaaaattttttttgggttgaaaatgggggtcaaaaatatttttctggggtaaaataaggtgctgagtacgaatatgatgtctattttaagtttcataatttttggaattttttaaaaattctttattttttggcaattttttggccctcgggattttggcctaatatttgaaaattcataacaaatcgaagggttgatcaaattttaaggaata

SEQ ID NO: 29602 - DNA, 839 bp, Heterodera glycines
aattattcaaatttatatttttcaataaaataataaatgattggtagatttttgtaatttaattttttatatgaggtttttccaaaaaattttattcacccacagagatgtatcatgccgtttaattacgatacacaattatacttatatacatattaaattcaatgtaattattagctcaagattcgaaaaagtactttttctgctatatcttattatatttgataattttatttaaatttagtaggctaatagaaatacattttcttttcattagagctctaacatagtgcaaataatcaaaaaaatgatcgatcaaattaatatataaatggagaccgttaaaaataaaattaaataaaaaattaaaataaaattgtaatatttcacagctgattaaatattaaagtaaatgtgtcatattaacaaaggaaccaaaatttccaaaaaattaaagtttttgatccaaaaatctgatctttttttggcttgaatctatggttacgaaggttttttgatacaccctggttatgctctatctatttaccccgtttaagaaatttctactaatgacatgaaataaaattctgaagaaataacgacaaaaaatattcaatgctaaataattaattataatatatgtaattttaattaatttctaaatcaacaaatataattaatattaaagtttaattgctaatatgattcataaaacaaataaattatttgtatttttatagaaatgaatatgaaataaaatgaaaaaataattgtaacaattaaaaaatttaaaacaaataaaaaatcacccaagagtatcgcctagatattgaactcta

SEQ ID NO: 29603 - DNA, 1030 bp, Heterodera glycines
  misc_feature (38)..(38): n is a, c, g, or t
  misc_feature (1020)..(1020): n is a, c, g, or t
actttataatttttggagagcgttgctatttctactancaatcaaaatataggctcaaatcatttaaaatttgaccatatgtatattcttatacatataaaacaaaatttccatttccaatgatcgcttcagcagcaaagaaatttgtacagattgggcaattcattcgcatcaatcaaagagcaaaacctaagaggggatgtttggttttggtgctcctttgtctttttgatcacattttgctcggtcggaggaagtcgctttcttcgcagttggcctttgacttcttccgccggtcgtttcccctcggtggccacggcattctccgccgttttttctccctactatttttgctgttgtctccgttctccttccttttctttccagcagaggtcgactcccaatttgcagaggtcgcactgacaaaacgaaataattatcccattaattcgaatatttcggtttaaaacaaagaagcattttcaatttattattgaaaagtaattttcaagtctaagaaaaagtagtatttgatttatgcattgccgtacttaaatcctctccccatgcattttgtgcacttataaattgcgcagatcttacggtaatcacttggcgaagcgtctttgacagtaccaatcaaattctgtgggtttcaattttgaaaatagttatcaggcattcatgagtaaacagttgcctggtatcttttgtccatagtctccattgttgtcaaaccgttcctccgcgcaccggactccttaccgtaatgcattacgctgaggtagtcgtacggtacgttgtacgttgtactctcatattggccaattttgcgaaactgagcgtggaaatctgaaagaaaatgtgctggttttatttatttttgctgctttgacctggcggaatgttctcaaagtgcactttgatgtgatcgtcgcggtcgaagcgcatgtgctcatgccaaaggccgactttgtgcagcaattcgtggacaattgtcgcgtgtttgacacagccggngaacgctgaa

SEQ ID NO: 29604 - DNA, 901 bp, Heterodera glycines
ccatgcgaatgtctggttgaagtggttccaaagagcgtaagcatccatctgcccatagcgacgtacgttcaacctcttcgaagaagccatagctaaaggaagcagaaaattagttcccccaggcctcgtccaattccaaactcacgctcggttcatgttgctgcactcgtggttcccgcgcagaaggatgacactgtccggatatttcaccttaaaaagtggacaattaaaacgattctcgctcaacccgcctcagcaaactcactttgtagcagaagagcaggaccattgtttccaggctttgcgtgccgcggtcgacgtaatccccgaggaagaggtgcttcttgtccggcggaaagcccatcgtcgtgaagattctcagcaagtcgcgaaattggccatggatgtcgccgcaaaggacgacaggaggctgcagacggatgagcattgactgttgctggagaacactgacggtgatatcgcaaagcttgtgaatgtcctgagcactgacctgaagagagttgaaatgaaagaacggataaaatgaacgcatcacttacttcggaagtgaactgctcgaaagtcgtgcgcgaaagtttggcgatgagcgtgtccacaaggctgttcggttgctcgtccactggtcggaagtttgtttgggcccagctctgtgcaacagcagtcgaagcagagaagcagtattcctcgttcatcgtacgcgtcgtgtcgtagtcggtcgaacgtcgttgaggaaaatgtgtgtgtgtcgttggccagcaaaaggcagaatgacgaaaatgaatattagtgagggattggaggagatttgttgcttttatattctttttttgggaatgaatttctttttggaaatttagccatataaaaggcgttgaatttt

SEQ ID NO: 29605 - DNA, 532 bp, Heterodera glycines
tttcaaattttatgatgaactagtaagtttttccaaaaaatcgcagaaaaacttttttttcaaaattttttgaaaaatttctaggtttgaaaatttttaaataaaattttttcggggggaaatgacggttggggaaatgaagtgcactctttccgacccgttcgccgtccgaccccgccggcggtgtgatggatgatgatgacccaatccaccccctcctcctccctttataacgcgaatagttctgctgcggccacaattcttcgtccattcattcctcagacatttgcccgttcatcccctcttttcataactcacaaatcaataaaataaccgttactttgctttaaagcaactaaatactaatgctatatgattatattagcaattaaaaattcagttgctttaaagcaaagttacaagcattttttttatttttgtcaattttaacctgaatatataattccaggcttttttaaggcctcccaaatcaatttttatttttatatagcaattcacagtttttaattaa

SEQ ID NO: 29606 - DNA, 1103 bp, Heterodera glycines
ggggggagggggggggggggggaaagaggattttttttttttgggggggttttttttttttttttttttcccaaaaaaagtttttttttttttttggggaaattttttccccaaaaaaattttcccaaagggggggggggggggggagaaaaagccttttttttttcggggggattttttatttttttttttatcgaaaaaaaatttttttttttttttgggaaaaaattttttcccaaaaaaatttttcccaattggggagggggggcggggaaaaaaatgcccctttttttttcccagggaatttttaaattttttttttttttccccaaaaaatggtttattttttttttgagaaaaattttttaaccatacaaaatttggaaaatttttgctatttagtggaggactgcagcaaaggtctctcaaagggttttgtgggctgtataatccgattttaacctctattcaacccaaaattccaacataaaccaaaaatcctttttcagaaaattaatttgagtaaaaaatggagaaaacaacgctttcgaatccatattaattgtaagtattttaatttgattggctacatatgaaaaaaaatcgtataacggcttacaatacagtaataaatggactagtacaaaccgtaatttattattctaaaaaaactaaaaatgttgatcttgtgtcaaaacccataaaaatcatccgtccagaaagaatcgttcgtagttcagtcggttatatttcatttcacggtatggaaaggaaatgatttttgttggtcgattcattaggtttgattgataaagaacactgagcaccgcaacagttatttgtggagaacggaattaaaaaaaaaagaaacccggactcggacaaggaccctggttacagaccggactagggctctggaaaaatcctgtacagtacccggtggtaaagactaaaacttaccaattcgtgcaaaagattcccctgtaaattttaaattttgaattatatttagaattggcattttatagatcgattaattttggtatttttcacatactaatcttagaaggtgaagaatgcatttgcttcgtgtttcatagaaa

SEQ ID NO: 29607 - DNA, 390 bp, Heterodera glycines
cgggagcctagggaagaaaaattaatttaattgagataggtatcccctcattcattcagttgctttttatgcacttatttcacttcgcctaaatatttgttctcctccaatttatttattccgcttccgacttcgcctatttatttaaattgtttaatttatttgttctacaaataaacattttattgagtcggttcaaagaccgaacaattggcgacgcctctcttcgactcaagccgggttggctgagcatcatcgtctaaagccgagtcggcaatcaacaattttgaaattctaaagccgagttggctgtcatcgaatttcataagccgagtcggccatcatccaattttgaaattctaaagccgagttggctgtcatcgaatttca

SEQ ID NO: 29608 - DNA, 1720 bp, Heterodera glycines
gacaaggaaaagcactgcgatgatgctaactccagtaattctgaattaaacatatgctagtaattttaaacgcttctctattttatttttttagcaaaattaattcataaatattttttcacaaactgctctgaaacgcaccaaattttatttacaagttattttaggcactcagatgctttcactatcaaaaagggagatgaataaaaatctaaaaatttttaattgctttttaaatatgcgaaaaattttaggcttaactttttttttataaactgatcagaagcgaaccagattttgcgagagcatcaaaaagacaaggaaaagcactgctatgatgctaactccagtaattctgaatttaaaattttttattaatttttaaagcttcactattttatttttttagcaaaattaattcataaatattttttcagaaactgctctgaaacgcaccaaatgttaatttaaagttaaataaggctctctgatgctttttctatcaaaagggagatgaataaaatttttaaaaatttttaattcctttttaaacaggccaaaaagtttaggcttatattttaaaaagtttcatcgaacctagcgcactaacatcgatataatctctccaaattttgcaggccttctccattgtaaaggactaacttaacctgaaaaaatggccaacgcttgttgtttttaaaatttttcgaaattctgactttttcattaattatttattttttgcaaaattaattcataagtattttttcagaaagtgctctgaaacacacaaaactttatttacaggttagtttaggcactctgatgctttttctatcaaaaagggagatgaataaaatttttaattcctttttaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctctccataattgtttgagtaccccaaacggacacttgaaaaaatcgatttttttgttttcggggcagtccccccgaaccgatgcg

SEQ ID NO: 29609 - DNA, 992 bp, Heterodera glycines
taaatttgataatttttaccggaataaataatcataaaaatttgacgattaaaatcaaatataataatattaataaaaaattatttaaattattaaacgactagccatattaaatataattagtttagaaaaattattttgaataaaacaaaatcttttatataaattaatttatatttattttgcttaataaaattgcttttgctttgctttattgctgtggcttgtgtgtctacggataagggcctaaacacacggaataattattttattaagttttaataaaaagaggacaccgtactgaagaggcccagtctctttttattaatttttgcacttttcgcgaaacgcccatttttgcacttttcgcgaaacgcccatttttgcacttttcgcgaaacgcccattttgcacttttcgcgagaaaggggacacacccatcgcctgcgtaaaattggggaccttcgtatgaaatttggtcctgctgacgggtgccggcgggtcgttactcaaaaaccatcaaaataaaaaaatttttgacagattaacgaattttttgtttgtttgtaagtttgcagtataatagaaaacaattttatatttgttcctcaatttacaggtgcgatttatccgacaatgttcttcactggcaccgaccgactgtttgtcataatttttgatgaaatgtaagaaaaaattttatttataattgctcatttaaatttttaattagcgcttttttaggaaagacaaacgcaaaatcctactgtatttgactacgataacaattgtttgttttgcttgctcattggatttgtgttttgtgttctaccaaaatatgttttgtttggtgatcagatgatcaccggttcaattggcgattttttcaaggcatttttcatgaatttttcacgagccaaaattttcaaaaaataaaaagaatgatttttcggcgagaatgcactttatgagtccaatcgagttttatgagt

SEQ ID NO: 29610 - DNA, 1004 bp, Heterodera glycines
aggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacggaataattttttactatgaagtgtttggtttggaaactgtctaaaatg

SEQ ID NO: 29611 - DNA, 674 bp, Heterodera glycines
aatgttttgcttcagatcggtccgcagagggaggaagttggagcagtccacccatcaagcagcagtccatcggcctccaaaaagaacaaagagacgagcggaaattccaaaatcgcattgccacccccaaaattggccataatcgttgaggccaccgaaacattggacattaccatcaccaaatcattcctccaacagcttatccaactctctgaagtatgttatttgtactttctattccttttttcttttaggccttcgaaaacgcttccaaacatatcagtacccctcggcgtgaattgcccggcacttcctcccatttattgcgcaatgacactgggctttgcgtcagtgtgagcagcagcaccaaatcggtgaaggtaaatggtggcctgcctaaagtagcgattttgtcattgcctcctcccccttcgatggttgtccattttagtgttgcgccggccaatacgtaccgatggattgcgtcgcttcgtcggcggaatcgagtcgcgagattaaatggcaaatgaaagaggaccaacgcaaaattcagcttcaattggcattttccgacccggacacggaacgaacggtgaacatcacacggacggcgaaacaatacgtccatttgccacgaagggcggattcgggtacgaatttgtacaaaattggaa

SEQ ID NO: 29612 - DNA, 651 bp, Heterodera glycines
  misc_feature (623)..(623): n is a, c, g, or t
ataaatcagagcttcgatctcaaaatactgaaaatccacatttcagccataaaaaatcctcatttgccattaaaatacctcaaaaaaatcctcatttggcatgaaaaatcctcattttttaaaacatcataaaattgctaacaaaatcagttaactgccatatttttcgtttgaaaccatcacggcgcctatcagcgccgccggaccccaataattcctattttttcttaaaaaattagcccaaaataacaaaattggtaatttttggtaaaaatcttaactaatcttatttaaaacctccaaaaaaaattttaaaagaaaatcaatttatattcttttaataaattgacaaatctcttaatttttttttgcttttaaattgtttttttttgttttgtcaaaaaatgattttgaccccctctattgaattcccgattattttttttgtataaaattggaaattaattaaatttattgcaaaatgaggatttttcgaaaaaatgtttaagatttgaagaaaaaagtcgaacattttgccaatatacctaatttttcaaaaaatcatgcgtttttgtcattttttaatcaaaggaccacaaaaatcctaaaatttctcaaaaggncacaaaaatccgcaaatcctcattttcc

SEQ ID NO: 29613 - DNA, 1332 bp, Heterodera glycines
  misc_feature (408)..(408): n is a, c, g, or t
tttagaacctatttttaggagggttcaaaactcgaaaaattgagagatttgacacttctaacttttttaaaacgatcgaatcttgataaatttggtatcatccgaaagctcttgacgagctgtctaaaaattttttggtacggagatggtccaaatgccttagtaaggaattggctggtagggaattggcggtagggaattggctcgatcccattttactcatctatagatagacatttttcgcattatttctattcatgttcatttcataattttcagattttgaaagtcagcaaaacatgtcgggaacaagaggaaaaacaggaagatacagcgggtcgggacgagccacatcctcaagagtgagtctcggaataacactaaaattggatttgaagaatactgtancataccagggacaacctcgtttgggcgccagcccagtttttggactataactttttttctttgtcaatcatagtccctaaggcatttggtcaccactcccggggtcatacctcttgcacaaaaagctttcagtcaaaatcaaaaaattctttcggaatggtggcttttcaactgccaggccagggtttggaatgacaaaaataaatttgttaaggaccaaccccccctaaagtgtattggccaaaggcctttcaaccccccccccccccctttttgttttcccccaaaaacccccccattttttttggttttccccccaaaccccccccccccctttttttcccccccccccccccctttttttttttctttttttagggtttttttcacaaaaaaaaaaaagggtttaacccccccgttggttttgaaaaaccccccccccccccctctcaaacccaaaaaaggggggcccgaaaaaaaaaaaaaaaattttttataacaaggggggggggaccccccccccccccccaaaaaaaaaattttctcgggggggggggggaaaaaaaatttttttctttttttttttttttttatttttttttgggcgcccccccccccccgcccccgcccccacacaaaaaaaaaaaaaaaaatttttttttttttttttttaaataaaaaaaaaaaaaaaaaaattttttttttttttttttttttttttttttttttttttttttaaaaaatattcttttttttttttcccccccccccccccccccccggggaggttttttgtggcggcggccaaaataatttttttttttttttttttttttttcccaccaaaaaaaaaaaaaaaccccccccccccccatttttttttattttttttaaaaaaaaaaaatttttttttttttttttttt

SEQ ID NO: 29614 - DNA, 2492 bp, Heterodera glycines
  misc_feature (293)..(293): n is a, c, g, or t
  misc_feature (316)..(316): n is a, c, g, or t
  misc_feature (346)..(346): n is a, c, g, or t
  misc_feature (348)..(349): n is a, c, g, or t
  misc_feature (355)..(355): n is a, c, g, or t
  misc_feature (368)..(370): n is a, c, g, or t
  misc_feature (377)..(377): n is a, c, g, or t
  misc_feature (379)..(380): n is a, c, g, or t
  misc_feature (399)..(399): n is a, c, g, or t
  misc_feature (433)..(433): n is a, c, g, or t
  misc_feature (443)..(443): n is a, c, g, or t
  misc_feature (2168)..(2168): n is a, c, g, or t
  misc_feature (2185)..(2185): n is a, c, g, or t
  misc_feature (2326)..(2326): n is a, c, g, or t
  misc_feature (2350)..(2350): n is a, c, g, or t
atcttttttatatctaaccgaaatctaaagattaaaaaaacttaatttaccatattgttaatccttctgtattatttggcattataatattaattgaaaacaggtctgcgttctctgtatgggcaggaaaaaatgctgcacaacgcctaagatatacgtagaaatcggttattcctgaaacaggaattccgaatccttgcggcgggtccaaaatttgatgttctagtaccgcccctaacggcgccttccagtttttatcaatatgtttcggctcttgttcttgagcatatatngaaactgtttccgaatttgcatntttcagttgattccagaattcgcttaaagntnngaacgntaatttctcattnnnatatacncnnattttttgaaatttcgcanccatatgccctgcccactccccgccgaactgatncaggaatagntgatgctcttccccctcaaaaacccatcggctcctgctcgaaaattttgttttggatccctttgtaaatgccgttctataccctgaaggaaaaaatggttccgaccaacccttttttaaatgccaatggccccaaaaaaaggaattttttatttttccaagtttttttttcccccccccccccccaaaaattaaacccaaaaaccttggaaaaaaaaaaaatttttttttttttttaaaggaaaaaggggtttaaaacattttttttaggggcaaagggggtttttttttaaaaaaaatttttttgtaaaaaaaaaaaaaaaaccccccgcgggcggaaaaaaaaaatttgttggaaaaaattttttttttaaaaaaaaaaaatttttttttggggaggactaaaaaaaaaaaaaaaaaaaaaagtgcgtttttttttctcccaaaaaaaaggactaaaaaaaaagaaaaacatctttataaaaaaaaaaaagcttttcttctcctccccaagagagagggggtggagaagaaaaactttcttaaaaaaaaaaaaaaaaacccccgggcggggggggtttttttctttctcctcccagaagagagggggggggggccccttttttttatttttgtgggggggcgcgcctttcttttttttttctccccccccccaccccccccgtttgtttttatttaaaaaaaaaaaaaaaaagggtgggtgtgtttgtaaaaaaaaaaaaaaaaaaaaaaaaagaaaaaaaaaagaagggaggggggggggcgccccccccccccccccccccccccccccccccccccgcgggcgggggggggggggtgttttttttttttttttttttttttttttttttttttttttttttttctatcaaatacagacaggggggggggggggggggggggggtgtttttgtttttttttttttttttttttatttattttattttttttttttttttttatttattatcaccccacggggcggggggggggggcggggcggccccttttttttttttttttgttatttttttttttttcaacaaaacaaattttttttttttttattaatatcacaaaaaaccacggggggggggagggggggggggggcccttttttttttttttgggggttttttttttttatttttcacaaaaaaattttttttttttttttattttatacaaaaaaaaatttggggagggggggggggggggcacttttttttttttggggggattttttttttttttctcccaaaaaaattttttttttttttgaaaatttttccctaaaaaagtttggggaagaagggggggggggcccaatcccttttttttttggggggttttttattttgggttttccccaaaaaagggtttttttttttttgaaaatttttaaccccacaaaaactttgggccaagaaggggggggggggccaatatcctttttttttgggggatttttaaatttttttttttttcaaaaaaagggttttttttttttgaaaaattttatccccatcaaatgctttgagccagatagggagggccgtgcccaattggatttttatttttgagggattttttaattttatatttttcccaagaaaaatggctattctttttttgagaaattttatacccacaaaagcgctttgcgtatgagacgaaaggctgtgcacaatcgccatttantttcacagaggattttnatatttagagttatcccagaaaaaatgctatctctttttttgataattttatacacatacaaatgctctcgagcatgatagggaggcggtgcgcaatagaccttttattctcgagggaatttttatatttatactctatcncagaaaaatggctatctctttttntgataaattttatacacatacaaatgctctcgagcatgatagggagggcggtgcgcaatttaccttttatttttgagggaatttttaaatttatactctatcccagaaaaatggctatctctttttttgagaaattttatac

SEQ ID NO: 29615 - DNA, 1143 bp, Heterodera glycines
aaaatggtaaaaaatttaaaacatcattttaattatttaaaaatgtaaaaaaatttaaatattatttaaaatatttaaaaaataggaaaaacagaaaattttttaattatggaaaaatagtaaaattatattttattatttaaaaattggaaaaaatttaaaaaatatgaaaaacagaaatttttttaattatttaaaaaaattttttaaatggtaaaaaatttaaacttttttattcgatttaactttattttcaattaataattttttcacattttttgagctttttgtattattttaccgccatttaaacgaataatttcttcatttccattgaaatagggaaggcaacttttttgtcgtatttccataattaattcgatggtcgttttgttgccaaattcttcccactttttgtgcacccatttgggctgaggcaaattgtgaattatcttaaagaattaatcgttttaaaattttaattgattaaaatatttccattaaattgttttctattttattttttgtttttgttggtcaataatttgtccattaatttctcaggcgacggaatggcatttgcattttggcattttgccaagagttcgcttttacttcgggctttatgtgacgaagtgccaccagttgaaccatttttattggcttttcctttgaaatgttcaggtggggacggacaaagtccaccaacgggcgatatttgtccaacaaatgggcataatctcatcagcaacaatttggcgaagatgcttataacgcgcgcacggaaaaccggacggatttagcaactgaaaaatataaaataaaatcttttttaaaggataacccaattaatttccgtgcgtaggccgtgccatgtattaaaaatgctcccaatttccaaattaaacaaaaaaatttaacatattaaatgaacaaagcaattttaatttattggtatgtccgtcccatttcttcaaactctgtctcaccggtgcagtgacaaaggacccacggacaaaggacccacaaagacaaaggacttacaaaaaaataataataataatgcaatttctttatagatttacaccaaaaaggatctttttccggattttaagaatttttgagaaaaaaaaaagtattgag

SEQ ID NO: 29616 - DNA, 1001 bp, Heterodera glycines
cctgagcgcacgtgcacagcaatgtctgcaaaacgacgttgtcatgacaacgcatacaaaaggtaacccgttcatttttgtacaaaaggcaacgtgtacaattgcttggttattaggattatgtttaggcgtaagctttaagctatacctaggcttagcttgcttgggcctaggcttaggcttatgcgtaggctttttgtaaaatatgagttgacttttgtacgaggtgccattgaccccaaatatacgatggaatggaacttattttattagcctttgtcagggatgcgattggttaaattattaataatattatggatgggttttacaaattgaaatagggggaaaagattcacttaagcgctgatgtcgaaattttgaaaattttagcgtgattttaagagattttgcaatttcggcataaataaacttaaaaaatttggtagaatcgtaaaacccttacccaacgacatgtatgtactatttggcaaagttttacattttggttcttgcctggttttgtttgccgtggccaacatttgacaaggccaagcagacagctacaatgaacaaaaaggtcattctcacaacaaatcgaagacagatggtatataaaaaagcaatgattaaaaactaatttattttaccaaaaatttatctaacaataaattaaataaataaatttattcaattaaaacaggaaaaattcgtgagttttttgtataatccaaaagcaatgaaataattttttaaggtcacgttagtaaattaggcggctttttaagaacacaaaatttaaattggccccgcaggaaatggagtaaaaaaaaacttttttttagaaatgttaaattagccatagaccaaaaaagtataattattttattttacattggcaacaaaatgcacagccggagcattattagaataatcactcgccacacattaataaatggggggaaaaggtcaaatggaaggagggcgaggtgaataattgaaga

SEQ ID NO: 29617 - DNA, 1245 bp, Heterodera glycines
tcaaccacgagccaattcacgaatggctcaagcgggtttcagcgatcacttgcttgtccacttgtgtgtccatgaatcggtgttgacagaacacaacggtcccgacgtggcccacatatttgacatcctgcagttgccctcttccatttgccgttttgaatgcagtcggggcatgcaacccggggcagcaatgaagtttggctgatgttccttcttttcaggttgttgggggtccaacgcttggtgttgcatagtctccaagtcaaaggccacaatgctgtaagggtcttgttccttcggctcaattggttggatgaaacagccccgctcgggattgtggtaagtgttgcacaattggcaatacgtctcgtggcattggtgaccctaaaagaattatttttttaaaaaatttttaaattattttacttttcttccattacggttgttgtcacgaacattccaaataactccgcactctttgcattgttttgactctgcacaaaaattggatctcaagctttacaagaatttggatgtcttgatggtcgctggtatggcttctcacattctaggcagtagtgttgtccaaataagccatactccttctgcacaccatcaaaatgggcgttgtttaggtagagtgagattcgtgtgtcgtaatagttgttgatgtatttgtacagcggcttgtactgaccagttgatccaaaaataaacacagaaaaacgatgtcgttgctggctgttgttccaatgatccaccactcggggcacaacaatttcagcatcatacgcattaagtccaggccgtgcgccaatttgttgcataagttgcaaagcatccctttgaagacagccctgttgaccgtgttggctgtgcacgtagcggcggaacttccaacttgccctgccacggcttttagccaccattgttgcttgtaaggcataaaataacaatagctgcgctcatcaggattgtttatcttaaaaaacccatcaaaactgttgctttaacatggaccggaccttaatcaaactccgatcattaatacgatggtgaacaggtgctagagctcgtcgtgcgcctcccttcagcgttcttttggtcggcagtccaggtcgattaactgttgtcacaactacggtaaacggttcaccccacagtgtgacattctgttgcttcttgctctgtgccactttgatgggaggatttaagatggtgttaactagtgttgtctgtgatttg

SEQ ID NO: 29618 - DNA, 987 bp, Heterodera glycines
gggttacgagatagaaaattgtcctaaaaagagatagccttcttttgctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcgggggtacgagatagaaaattgtcctaaaaagagatagccatttttctgagaattattcacaaattccgcaactcttgcggtaatggaaaaattttg

SEQ ID NO: 29619 - DNA, 992 bp, Heterodera glycines
  misc_feature (883)..(883): n is a, c, g, or t
  misc_feature (903)..(903): n is a, c, g, or t
  misc_feature (920)..(920): n is a, c, g, or t
  misc_feature (944)..(944): n is a, c, g, or t
ttgtaggagatagaattaaaaacaaaattatttctatatttttattcactataaaaggtttccatagcaaaaataaattcttaatgatttttaaaaataatatcgtgcatcataatggcacaataaatactgcagattaaatgcggcgcctgatgaacatttgatctggttcatattattattaactctatttctcgttacaaagtaatttttaaaaacgaaggaccaggtaaattcaaattttttactcttttctaaaattcacgacaaagccttaaatcattttagaaaattaattgatatggctgaatctgttgtcgaagatagaattaaaaacaaaattatttctatatttttattcactataaaaggtttccatagcaaaaataaattcttaatgatttttaaaaatcataccgtgtatcagaatgacacaataaatactgcagattaaatgaggtgcctgatgaacatttgttctggttcatattattattaactctatttctcgttacaaagtaatttttaaaaacgaaggaccaggtaatcaaattttttactcttttctaaaattcacgacaaagccttaaatcattttagaaaattaattgatatggctgaatctgttgtcgaagatagaattaaaaacaaaattatttctatatttttattcactataaaagtttccatagcaaaaataaattcttaatgatttttaaaaataatatcgtgcatcataatggcacaataaatactgcagattaaatgcggcgcctgatgaacatttgatctggttcatattattattaactctatttctcgttacaaagtaatttttataaacgaaggaccaggtaaattcaaattttttactcatttctanaattcacgacaaagccttanatcattttagaaaatanatgatatggctataccctgtgtangagatagaattaaaacaaaatatttctatattttattcactataaaag

SEQ ID NO: 29620 - DNA, 996 bp, Heterodera glycines
aacctttcaacatttaaatcaaaatcctaataaaaatttcgttgaattttttcgcctcttatttgtgcaaattttgaaaaagtaattttttattaaaaataaaaaattcagaagcaaattcaagaattttttttatttttaaatgcattttttaccacatgaattatgtttaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccaatgcagcagtttaccatttttacaactatttttctctcactcatcgtctgctcgtctctcctttattataagctattttcctaagccaacaacgcccttttctccctcttttctgttagtcatttctcattggtgttgacgatctaacattcagtgtacaaatttgttaaacctctcaacatttttaaatcaaaatcctaataaaaatttcgttgaatttcttcgcctcttatttgtgcaaaattttcgaaaaagtaattttctatttaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgc

SEQ ID NO: 29621 - DNA, 1244 bp, Heterodera glycines
  misc_feature (203)..(203): n is a, c, g, or t
cgttttagaaatagcgtagaaaacagcttcgatatcaagaaaccaagtcaagtccagaaaggaatattttaaaacgatttcgttttgttttggcattatgatacgaaataactttcggaaattatggaaacaaaattggagaaattcgaataatttttgactgcaaatttttttccttttttgaattgggttcaaaaaaattntaagagaatttttgattattattttgaagtcttgaatttatttgacaaatccaagacttaaaactgggagaagcaaggggctgtggctgggggcctaaaatttgggccacattggagaattaattctgatttctgaaaaagtcccagaaataactattttttctttccatacattcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattattttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgtttttgtttggcattatgataccgaataactttcggaaatatggaaacaaaattggagaaattcgataaatttttgactgcaaattttttttccttttt

SEQ ID NO: 29622 - DNA, 1713 bp, Heterodera glycines
taaaaaagagatagccatttttctggcatggagaataaatgtaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccacgctgggaacatttgtatggtacaaaatttctcgcaaaaaagagagccatttttgtggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctaggcccatgctgggaacttgcgtatggttcaaaacttgttggagacaagagagccattcttctggcattgggaatggagggaaaaaggtcgtgtagaacagcatcaccggcgccccccgaaagccttagcccatgctgggaaaaatttctgccccaaaggagatatccccctctagcacaggggggatcacggaagggggggggattaaaacagggggtgcgccactagacaaagagggagaggtccctcggccacacgaagaaggggcatagaggggagagggggggggggggggaggcctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtaaattgcgcaccgccctccctatcatgctcgagagcatttgtatgtgtataaaatttatcaaaaaaaagagatagccatttttctgggatagagtataaatttaaaaaattccctcaaaaaataaaaaggcttattgcgcaccgcccctccccatcatgctcgagagcatttggattgtgataaaatttatcaaaaaaa

SEQ ID NO: 29623 - DNA, 1133 bp, Heterodera glycines
  misc_feature (1079)..(1079): n is a, c, g, or t
tccgtcgccccttcggcttaattcctccaaataaaaatgtgcttctcatcagaatttgaagacacacgcactaagagcagatttatgttcgagcaaccttgtcattgccctaccaaccaactcgaggccatcaaattcagcaaggtgtggaaaatttcaaaattcttttaaatccacgcaatttgtaaaaccctttcaactctacatttgttaaggtgataggcgcggaagacaacagtctgtgctgtgtttgtgcaggtccagtaaatacaccatataagaaattgtttttacataccatttttgttacagaggaatacggtcacaggtcgttggaagtgctgtacaaatgttcgacgtgttacaaagaaacgcacagaacttatgagtgcttcagtacgtcaaatttttaccacatcccctcaattacataaattgtccgggtttcagttgacgtcgattattacagcagccgtcgttacgactgctcggaccgtgattacgatactcgcatccgctctcgctaccgtactcgaacgtacagtgcgtggggacagtacacggcaaatgtcgcaaaaatggcactgctggggcggatgaccatgaacaattttgaggcggtggagcgcaaattcgatgtgatgagcattgttcaggacaattattacaagacaaccgatgattggaccgacactttgataaggcgtcttgaataaataggcatgccaaatggcaacactttattgtataactgtattatatatatgcgtatttctcgtataactgtattacctacgctctagaaataatctctaaataaatgttatacggtcttttttttgtcaaaagagtacatttcattccccatggctttcccccctctcaatccggaaaaaatcgtcactatttctaaatttttgtcactattttggcatttcctcaatattttagttaataatttcgagatttttcgtaattgaaagtctcgaatttctagagatatgagtgaaccaaatagcaataaaagttccatttgtttgtgagtttattctccgtatgaaatggacgcgacgcatacnatacaatgtgaaaacagagcaacaaacaactatttaccatatgtcatcatcatc

SEQ ID NO: 29624 - DNA, 981 bp, Heterodera glycines
ctcttctttgacttggccggtgcactgaagatcattcgactcagcacgtcgatgcagaccaataaatatttataaccgtcgttatgctttttcaactggtcaaatatgcacaaatcgcactgccaatcggtatggaagccacttggtatcgtctttagtctcgggaatcttttcctgatgggcttgtgaatcgtgtatgttttctgcttttctaggattttattaacgtcatcggtcgtaattttcgggtcaatctttttggcctcatttaaaattttttgaattccagcaaaacttgccggagattttaaattaaaataaattttcgataaaattttctctacagtcttgcccatattagtggtttgaagggtttcttctctcgcactatgccgggtgtttttatagattttattgcctttttccttccacgtccccacatgacctttgatttatcaaccatgtcttttactgttggatccttcagtaaccgatctttgagaaattttgcaccgcgcggcgtttcatctttcttccctgcgagatacaacaaaacatctctataattactgttttcaatcggcaaattcatgttcgactgtacctttccggccgccgtaattttaaataaatctttgttttccttcacgtacctaaaaagaccgtttaaaagggtcgggtgtataatagttttgatcggaacgggtgttttgagtgtggatgttgtttggggctccggagttaactcctcaagtgtatcattatctgattcaggatcaggagtttgctctttaagtcttttcctaggaataattattttccgtggttcttcggtctcctgtggtttggattggttattgaggcccagatatggtgcaacatttggacctggtacatgattctcaatcactaccttctgtggtctattttcaagtatcccctttaccgtacgcctttcttttataaagccaatcatgtctc

SEQ ID NO: 29625 - DNA, 1199 bp, Heterodera glycines
aagtgataaaaataccaaataaaatttatataatagagcaaaaaattgcggatttttgtagtattttacttttacagaatgacttttcagaagcgagttctgaatttttttctgaaaaatctaaaatttccagaatttctggaataacttttttcatattgatgttagaaaacctaaataaatcccataaaattctcctgatttttctctatttttaaagctttatttgctcaaaattggtcaacccttaggctagatatgaattttccaatattagcccaaatttccaagggccaaaaaattgccaaaaaataaagaatttttaaaaaattccaaaaattttgaaacgaaaaataaacatcatattcgtgctcagcacctcaaaatagcccagaaaaatatttttcacaccctttttcgaccccaaaaaaatttttgaaaatttctaggggggctagctcgaaaaattttgaaaatttcaaaaaataaaatacaccattcgatagcatttcaaaagctctacaattttgctctaaggcaatttttcgctaaaaccaacccctgacgagttatgggcccgggactcaaatgtcccgctcaggccaaaaattttttcaatttccgggaaaaaatcgaaatttttccgaaaaaattaccagtcgatagagctcgaaaaactatgttttggaagtggtctccgtttctctgggaaaaatcgttaaaaaatcctaaaattcaaaaacccgaaaaccgttttttaggcctagctcgaaaaattttgaaaattttcgaaattttaaaatctggaaaaatcgggcttttaaagctctacaataagtctgctggccaccctgcgctcaggtcaaagcctaatgagttattcaacggggactgaactggacaaagttggtactgaatttttgtagaagcacacaggccaggaggttagagatagaggcctggaattttttttaacttttagccaacacttcaacttagggccctcacagcgggaattttttgatccgagttttagaaaaaaagttacgggccccaaactgcgagaaaaagtgagaaatcgcttctcgggactcagtcgtccgcgcagaatttttctctatatttttcccggatgcgccgtgaaaagttgtaagacccttccaccactttcagggcgctcccggccttcggccgggaga

SEQ ID NO: 29626 - DNA, 1337 bp, Heterodera glycines
ggtcagttttgcatatttattactaatcttccatttttattccgtttcccctttttttggtcaaataggactgatgatgtcatcacttttttttcaaaaaaataaaatttttcctaaatgtgatttgtttcccccctttttcccctccctttttcaactttcttctgtccctttccgatggtccttcttcgcgtcgtccctatttgttttcgttgcttcaaaacccttctcccattccctgccctttgccttcgcaatttccgcccggccaaattcaccgtgaagaaaatatggccattcgctacagacttttcaaccgattggaccccggcggttcgcatttggtcagtgcccctgaaaatgccccctttaaatcgcattttgtgcctttccatcttttcagagaatgccttcccatgtgattcccgccatatttttctccattttgccctttgacgacttcaaagacgtggagggcaagcagagcagtttagtcacaatgtaaaaacaatggcacaattaaaatttaattgttttaccaatatttgtgcccctttttcagattttccatttggaacacaatgatgggcacaaggtaagcaattgcattcgcttgtcctccgccgtccgttttgtaatttccgtttcttcgcttttcgtctcctcaccattccctgggccattcaccagtccggctttctcctgggcctctttctgatgcttctgatggccgccctcgccttttacaccgcttttcgcgtggtcgaaagtccgaattcgttgggtgaccgccgcttttccttcctttcaccccaatttctctcttttttagccctcgacagaacgggcgccgacttttcggacgtttgccgtttcttttgggggagacgtggcgaatatttctccgtttttttctccattttggtcctcgtcggcggcgtcattctttacttcgtgttgatgtccaactttctgttttacaccggaaacattgtcaacggttgtcccatttcacttccaattcatttgactaattgaagaggcattgcagccgaactcgtcgatcattccgattatggtcaacggcactctcagctgcgacggtcagtcagctcaccgccccccccccccccagccgcaccatccctcgcattgtttcaccccgacaaaattaaaaaaagcgagaattttcgttttcaaatttcttagagagaggcttttttctagtatttttagaaaatggcattttttattttagttttctttgagctaacccccccccccatatcataaaaagcagttagtaaaataaaactgtttagttttctgtctcgaaa

SEQ ID NO: 29627 - DNA, 1191 bp, Heterodera glycines
  misc_feature (120)..(120): n is a, c, g, or t
  misc_feature (151)..(151): n is a, c, g, or t
  misc_feature (167)..(167): n is a, c, g, or t
tttttacaccacatattgccaatctattttctgcagatgaaagccatccatcgcctgcggttctcggcacagcaaagcactaatacgtgtttgactcactcaaaaaaataattccatacncaaaagtttttacaaccacataatgccaatntaatttcttgcagatntaaagccatccattgcctgccggttctcggcacagcaaagcactaatacggtgtttgactcacttcaaaaaataattccttacacaaaagttttttacaaccacttattgccaatctaatttcttgcagattgaaagccatccattgcctgccggttctcggcacagcaaagcactaatagggtgtttgactcacttcaaaaaataattcattacccaaaagttttttacaaccacttattgccaatataatttcttgcagattgaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagattgaaagccatccattgcctgccggttctcggcacagcaaagcactaatacggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatacggggtttgactcacttcaaaaaataattcattacccaaaagtttttaacacccccttttgccaatctaatttcctggcaatttaaaaccaaccattgcctgccggttctcggcacaacaaaacactaataaggagtttgactcatttcaaaaaataattccttacccaaaagttttttacaac

SEQ ID NO: 29628 - DNA, 1258 bp, Heterodera glycines
gccagacaaagcagagtgggggataacacgaattttttatcttggtatttcctctattttgagcctgctctacatttatgtatgagccaatatgcctattgcaactgaaatttattcatctttcccgacaaattgttgagataattattctagacgatttttttatatctcagtgcttaaccattgccttttgtaatgataaatggtagatattgggagtgataaaaagtttgtttgtgactatttacaataaaaatttatgcagcatttctaaaaaggatgtaaaaataatttcttgcgtaatattttttacattatgttgttgaagaatttgagtctgcatctgatgcaattggaaaatttttcagcttttttttcccagaaaaaggatggggcaaataaaaaactaaacatctctcatcaccattttaaattcccttacattttgggtttactttactatgctggcccataaaaaaatggagtttttttggtgacaaatttttgtgaattttctttcggcgcgtcataagcggattgtttgggggcaaatgaaaacaaattttgtgttattcgaatgcgctagccgagctctacattttcaaatgtatcaacaaagggtctatctccactctctggcgagttatggccagccaaagcagagtgggggataaacacgaattttttaatcttggtatttcctctattttgagcctgctctacatttatgtattgagccaatatgcctattgcaactgaaatttattcatctttcccgacaaattgttgagataattattctagacgatttttttatatctcagtgcttaaccattgccttttgtaatgataaatggtagatattgggagtgataaaaagtttgtttgtgactatttacaataaaaatttatgcagcatttctaaaaaggatgtaaaaataatttcttgcgtaatattttttacattatgttgttgaagaatttgagtctgcatctgatgcaattggaaaatttttcagcttttttttcccagaaaaaggatggggcaaataaaaaactaaacatctctcatcaccaatttaaattcccttacattttgggtttactttactatgctgggcccataaaaaaaatggagttttttccggtgccaaatttttgtgaattttctttcggcgcgtcataagcggattgttggggggcaaatgaaaacaaattttggtgttttccaaatgcgttagccgagctcttaattttc

SEQ ID NO: 29629 - DNA, 997 bp, Heterodera glycines
  misc_feature (25)..(25): n is a, c, g, or t
  misc_feature (51)..(51): n is a, c, g, or t
aaaatgaaattatttctgctaatgncgtataattaatttttgataatattntagtcgtccgacggtgcctttgagttggacaacgctttgctcggccagccgaccatcagctgtcacccggacaccatcgaaatgcgtttccgcacccaacgaccgttcaccggcaaaatttacgtgcagggacactacgccaaccccgactgccgtgtcgatttctccgaggcgggcggcgcggaccacgacggacggggcggcatccgactgcaccacgggtcatgcgacatggacagaaaacgaatggtgggcccggagggcggcaccggcatggaattctccacggttttggtcatctctttccatccggtgagcggagagggaggagattcttaacgagcgaattacaatttgttaattgcgtaatcattggcagttatttgtcaccaaaactgaccgtgcctttcacatcaactgcctttacaaggaggccgatcggaatgtcggcgtggacataaacgttgggtgagagaagggatgggtcgactctgttctctgctgagggaaaaggggcataatttgaggggaatgggggaggggtaatttggcagtttttatttgggggggggggtaattaggcggaccattctcccaatcattgccatttcgtccatttttcttgtccatttgccccaccccactgttccaattgtccgtttgaccattgttttgtttttcgtctccatggagcatgacgaacgatggtgtgcccatggacatgaatctgttgccatgggctttttccattctttggcttggctttggctggtcattatgccgtcccaatggtctttccgccttttgccctccgccgtttcctccctctttcccttctcttcggccatttctcccctttccctttccccaaaagtgacgtcaccccggccaacatccaaaatgacatgccaatccctcaatgtaaatacacaattcgcaaagacga

SEQ ID NO: 29630 - DNA, 940 bp, Heterodera glycines
gccattgacgacggacttttggcattggcactttgtgctcagtcgcgaaaagtcattttgcagctcaaattcatctgcaatttttgcaaatcaatttttaattttattaactttttactgctttttaatattaaatttttattaagattaaaaatcgttttataatccataagataaatgatcattagttaatttgctcgtttaaatgcttaattggcggattgtttgccttggccagcagtgggaagcatgccgtgtgtgccacaatgtgacagccgctgcagcggcgcttctctcccatcttctggcagtccttctcgcccaaataacattcggtgtccacggcggacgaagaagcggatgaagcggaggagggcagccaaatgtgctcagagggactcaactaaactgggccgaaatggcagggcgctaattggccaattagggaaagggccaaaacaattaattattgtgtaaacaattaacaaaaaatatatttgttaattaatgtagaataaaagcgaaggagcataataattcccaattgttaatgattaaggaataattaacaaaattggcgaaaaactttgcttatttaattgattataactgtatttttgattaaaaaaaagttgttatatttctttttaatcaaattgcattatttaaattaaacatccaaaatccgtcccacctgttcatccagccaatatctgctcgtcctgtgcttgctgacccgcttctgctcctgctcctgaatggcggcggctcgcttcaccacgggcgatttggctaatgctcttctgaacacaaaaaaagaaaaatcatttttttatttgattttaataaaattaaatttgttcgatgagaattgagaaacaaaatgggataaagaagtgaagagaaaagaaaagaaaatagaagaaaaaggataaaagaa

SEQ ID NO: 29631 - DNA, 1325 bp, Heterodera glycines
agataaacattttttggtcaaagaaattttttttgtttgcgtttcaaatatcgtaagattgtttgatagggccagacaagagaaggcaactgttggtatcaattttgcggtaaaaaaatgagaaaaaagagataaccatttttggtcaagaattttttttgtttgcgtttcaaatatcgtaagattgtttgatagggccagacaagagaaggcaactgttggtaccaattttgcggtaaaaaaatgagaaaaaagagatagacattttttggtcaagaattttttttgtttgcgtttcaaatatagtaagattgtttgatagggccagacaagagaaggcaactgttggtaccaagtttgcggtaaaaaaatgagaaaatagccattttttggtcaagaattttttttgtttgagtttcaaatatcgtaagattgtttgatagggccagacaaaagaaggcaactgttggtaccaagtttgcggtaaaaaaatgagaaaaaagatgtttgatagggccagacaagagaaggcaactgtttgtaccaagtttgcggtaaaaaaatgagaaaaaagagataaccatttttggtcaagaattttttttgtttgcgtttcaaatatcgtaagattgtttgatagggccagacaagagaaggcaactgttggtaccaattttgcggtaaaaaaatgagaaaaaagagataaccatttttggtcaagaattttttttgtttgcgtttcaaatatcgtaagattgtttgatagggccagacaagagaaggcaactgttggtaccaattttgcggtaaaaaaatgagaaaaaagagatagacattttttggtcaagaatttttttgtttgcgtttcaaatatcgtaagattgtttgatagggccaacaagagaaggcaactgttggtaccaagtttgcggtaaaaaaatgagaaaaaagagataaccatttttggtcaagaattttttttgtttgcgtttcaaatatcgtaagattgtttgatagggccagacaagagaaggcaactgttggtaccaattttgcggtaaaaaaatgagaaaaaagagatagacattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagggggcaactgtttgcacctaagtttgcggtaaaaaaatgag

SEQ ID NO: 29632 - DNA, 1581 bp, Heterodera glycines
aaaaagcaattaaaaaattttcattcttgaataattttcctgcaccgaaggtactcactcggcctcttcgcggcctcgtggtgggccttcgccccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcgttctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggcgcgcttctgatcagtttctgaaaaaaaagttaagcctaaggtgttgtcctgtttaaaaaggaattaaaaatttctttaaatgatatcatctccctttttgatagaaaaagcatcagaggacc

SEQ ID NO: 29633 - DNA, 1891 bp, Heterodera glycines
  misc_feature (1826)..(1827): n is a, c, g, or t
  misc_feature (1833)..(1833): n is a, c, g, or t
  misc_feature (1837)..(1840): n is a, c, g, or t
ttttggaaaatacaggatttacaggatttgcaggattaatcctgccggatccctgtcctgtaaaaaaatttgaaattcaattcctgcaacaggacccgcaaattggatttttatgcaggattcagcaggatcatgcattggattttttgaaaattcttaaaaatagaatgccaaatattcagaaaactttcttttttcaaaaatttttttattaataaaaatttttcgtgtaaaaacttatccttattcgaaaaaagtttatacaattgaattttttatgtgttttgttacctaaaaagcgttaataatttttttttactattttcgtgcctattttaggatttttctgcctttttaagtgcctatttcgcgattttttgtgcctaaaaatcccatccctatacattatggattatggcttttttgcaaagaaatttaaatacaaattattttactttaatttaagctattattatgagccacccaatttggcaaatcggtctttttaaacgcattaaagaagattcagtcgattgcttggagtgtaagcaaaaaaacgttattaattttcatcttcatcattttttggtttaaaaatatatttgaatacttttttatgccccccgccccccccccccgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttttctccatcttccttttttgatactaaagcatcagagtgctaaaaattaagttgtaaataaaaatttgggtgcactttagagcactttctgaaaaaaaatatttatgaaacaaaaaaatcgatttttcaagtgtccgtttgggtactcaaacatttatggggagcaaaaatccaacgcagaattaaagtacaggctatagggaagctattcccgagggattcggtctccccataaatctgggcgcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgattgcaagaaatnncttgtnaatnnnntttggtgcgtttcacctttattaggaaaaaatatttagaattaattttgct

SEQ ID NO: 29634 - DNA, 647 bp, Heterodera glycines
tacaggctatagtgaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatgagggagcaaaatccaacgcagaattaaagtacaggctatagggaagctattccgaaaggatccgtctcccataaatctgggcgcatcggctcggggggactgccccgaaacaaaaaaatcgattttttcagtgtccgtttgggtactccaacaatatggggagcaaaatccaaccagaataaag

SEQ ID NO: 29635 - DNA, 950 bp, Heterodera glycines
tttgattgtgaaaaatttaggaaaaccgcttatctcttttttctcctcaacactctagacaattccaaccccatttacggaataatagcgccaaccctaatttttccggaatttctttttgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgggaaaattttggaaaaacgcctatctctttttctgctcaaactctagaccattccaaccccatttacggaataatagcggcaaccctaatttttccggaatttctttctgggcgaggttgattgggaaaattttggaaaaacgcctatctctttttctgctcaacactctagacaattccaaccccattt

SEQ ID NO: 29636 - DNA, 1646 bp, Heterodera glycines
  misc_feature (1636)..(1636): n is a, c, g, or t
agacacaccaaacaagaaagctcacagcaataaataaatttctaataggaagcataaataaggagcaaaaagcaaatgcataagttgagaaagctataattatgttattttattggttgttgaaggccaatcaacagcttctacgaatcaacttattaacacaaaaataactcaagattttttccattcatcaaaaaatttcttgaaggctcattaatgtttttaaatttggatcaggcgatgcttctatatgttcgtttcttgtcactattgttaattttgataaataagtttttaaggtccgaagacttatctttgttccttgttcttgcagttttgagtgaagatcattaatagttttaatagtttttttcgatttgtattccttcacaagttccatcacaccatttttttgtataaaatcatcaaaccctgatttagagcctaatgggaactcgtagacaaatagtgcgataatcaaaatatgaataataatattcattattctaaaataataaataacgaaaatgagcttctcagaatcattcacgtttataactacccatgaattttctataaaaatatttttgttgcactatttatctatttgccaacattaaatattttaataaaaaatgagaaaacaaaagtgcatgccaactttaatattttaataaaaatgagaaaacaaaaaatgtccgttttattgagatttaaaaatattataaaataaacgaattaattatgtaagtagattattattatttaaaataattattttaattttaattttttaataattattttacttgctttaatttgatcagtgatcactttgcactttttcgtgcttcgactcagcacggttgctgctgtacagcactggcgtgtttcttcgctgacctttatggcaattgaaaggtgtgcaaaagcggcacacatttgcaggtgaatccctcctccaaatcctcgcagatggcattttccttgtcgcagtcgttgtctttttggttggcacattcgtcgaaacagcacatccggcctggtttttcctttggcccttcgtccacataaggaggcttacaaacgcaggtctgaaaacccccccaaaatagataggcttttaatattttttttacatatccatcgggcaaatcgatgcaattcgcgtgcggactgcaatcattgatagcggagaatttgcattcattgatcactgacaatagtttaaacagataaaaagaaaattaaaatggtttctgtttacattgtctgcatgaagtgccaggatttgccgggttctcatcgcggaacccaggacggcacacacactcatagccttccgtctgaagcattattctcgtttatagttttcattattctccttccccgccttgtcaatacaatccgcgaatcggctgcaattgttctccgcggggttcaaacattcgttcttcaacagtttgcactttcttcccggcttttccggcatcggcgattgatcgatggaataagtcggacatgtgcaattgtacccgtcggccaattcctcgcaaaatgcgatcacatcacagtcattcagcgaacggtccatacagtaattgaccttggcatgttttattggttttggcaaaangtgccgacct

SEQ ID NO: 29637 - DNA, 1607 bp, Heterodera glycines
  misc_feature (820)..(820): n is a, c, g, or t
tcgcgtagtctggccatgacgtgtaggagggtcgtcccccctgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacgacttttctgtgcttgcgcagttggtccatccggttgccgaaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtaaagcaccacggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgtgtgctgttctttcggggatggtgcgtggactagtggtgagagctgcttgtggagcgcttcagctgcgtgtatgctcgtcagggtatgcacttcggttggcgctgaacgaccagtntagaactggcacgacttcggggaatccgactgtctaataaaacagaggagacggatggtccttgtggacgttgaccgtgtctgatttctgcccagtgctctgaatgttaagccaaggaaacttgattaagcgcgggtaaacggcgggagtaactatgactctcttaaggtagccaaatgcctcgtcggctaactaccgacgcgcacgaatggatcaacgagattcccactgtccctatctactatctagcgaaaccacagccaagggaacgggcttggcaaatttagcggggaaagaagaccctgttgagcttgactctagtctgactttgtgaagaatcatgagaggtgtagcataagtgggagccgcaaggcgccagtgaaataccactactttcatcgattccttacttaatcggtaaaacgggagtgcgcccgaaagggtgtccattttggtgttaagtcgggccacccggtggcccggcgacccgcgccgatgacagtgtcaggcggggagtttgactggggcggtacatctgtcaaagcgtaacgcaggtgtcctaaggcaagctcagagaggacggaaacctctcgtagagcaaaaaggcaaatgcttacttgatcctgattttcagtacgaatacggaccgcgaaagcgtggcttatcgatccttttgaatgtgtaaagtttccagcaagaggtgtcagaaaagttaccacagggataactggcttgtggcggccaagcgacgatagcgacgtcgctttttgatccttcgatgtcggct

SEQ ID NO: 29638 - DNA, 1577 bp, Heterodera glycines
  misc_feature (989)..(989): n is a, c, g, or t
  misc_feature (1182)..(1182): n is a, c, g, or t
acgtggtaattaccatcattggctgttgttgttgtggatgaggatactgacgatgccgaagctgttgctgcgcttggtcagactttagggaaaaagccatagcatgaataatttttcacaataataaaattaaattttgaaattttaaccatttttaagattgtcccaaattttggtttcctgttgaatccttcgttgtttttttctctgatcgcttacctccttccttctctttactctctttccccttcccctgatcactctctcgccctttcttctccctgatccctttctcttttctttaactgatcacacttttcctctctctttctccccctctctccacctgctgctgcttctgttgtttcttcagctgttgttgttgtcgtaccttcttgcctagccaactcgctgctgtgctcgccggctttgccaaaatgcccgaattcgatgccttttttcgatttttgttcactttatgtgccaatggctctcaaattacctccgagtcccttctgtgctcagtttcgggcattttctgaaacacaaccaccggcctttgttcgctccgttcggttgggccgcggatggccaattggtcgcgttggtctttgatgaagctgaacaaatcgtctggtcatttgccaatgtttcaattgcgctaattatgacaaatgccgttttctctccgttttgccattcttcgcttgcctcgtgcgcagcaacagtcttctcgggatggataacatcagcacaacgtcgtcgatggccatctcgcgcaccaaaacattgttaaccaccagaatttggtcgcccggcctcagaatgtcgccgcacttttgcaactccgacttttcgccaaagcgcgacacgaaaacgccggtgaactgatcaatgcctttgggacaagaagaaatcaatgccactttcaatggacagaacgcaccattgccctcacgcaaatacagcccaagtgattggcctggctntttgatgatctccacaagttggacaacgcgaatttcacacgtaccgcccgaaccgtactttggcgttttgtactcctccctgaattcaaatggtcaaatcacacccctttctatgcccaggtttctccacctgttcagcactcgggccgagaagccttggacccctcgtagccgtcaagtgctcgtctgctgntcgacttcgcgcaattgccgataaacgccctcgggcaattcccccgcaaaggcactgctggacggaccgggcactaaaaaaatgagaaaaaagtggcaaatccgagggaaatgagtgaatggcaaatggaatttagattcaccatgttcacagagttggggctgtttcatttggcgatttgccatgtgaaaaattgaaaatgaacgtacgcctgggacaaagccaaaaatggggcacaattttgaatttattacaaaaaaacatttcgagaaaaaatcatggcacgactttaggttgagttttgctctgaaaagaaggtaaagtgggtaattagggtcaaatgagggaaatgaatttgaagagcggcgggtgagggaagatgagaaagtcccgcc

SEQ ID NO: 29639 - DNA, 963 bp, Heterodera glycines
ggattcggtctcccccataaatctgggcgcatcggttcggggggactgccccgaaaacaaaaaaaatcgattttttcaagtgttcgttgggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacag

SEQ ID NO: 29640 - DNA, 844 bp, Heterodera glycines
aggtaaagtgaggtctgcatggaagcatggaagtttgtggtgggggggggagggtggtaaatgttggacggacggcaagaacctgatccaataagcaacggaagtcctgctgattgaccgctgctgatcaaagcgacaaatgcgcgacattttaatcggataaaatcatcaatgggcacaaaatgatgaaggaataaaaaaaatgcgaaatatcactaaaataaaataaaatgaaaaataagtaaatattaaagtacggaatttggtgtgagttcacaatttttgtttattaccaaatttttaaagttcctataaattttaatcgtatatgacttgtccttcctaccatttgccgaaaagctaattttcaaaattttatcccttttccaccatttgtcaatcaatgttcttttttttcaatcggcgccttcataatatttatttaataagcattagcagcattcttagttttgcgaaagtgaatcaccaaaaacggcagagacatttcgttcattttgttaatggggacggggcattatttgtccccaaatgctttattatttgatttaatcttacttccatttaaatgggcaaaaagttattggacttccgtcaacgtcgccgtcgaaattccttctcaagtagttcaagcagaacaactaccaacttgacgctgatcagtcgcttaaggataagcaacactttggtagcgacaatccacaagcgatcggtgattactcgagattgcatcagatcacaactatttgacgagggatcaggtgacgcaaaagcaacaaaaccaaccgagctgctgacaatcatcatgccatcggccatgctaaga

SEQ ID NO: 29641 - DNA, 824 bp, Heterodera glycines
  misc_feature (734)..(734): n is a, c, g, or t
  misc_feature (803)..(803): n is a, c, g, or t
cccaaaaatgtcggaagtcggaactcggaagtcggaattccgtgccatccctggtatggatgaatgaaatgacgcggttaagaatggacaagcaaaaatctttcgcctttagagaactcataaacccaaaatacgactaataattctatttcccaaataaacaatatttataagaaaatttaaaaattcttaaaataacaataattatgttcattagtaaagctgtttggaagggatatgcgaacagaggtgaatggggcgcattgttattttatttattaatggataaataatttaaattaaaaattatatctcaacaatttaattaggttttgatgcgagaactcggttcaaaaaatctttttatattaaaaaaatattgcaattcgccagggcataatttcaatgtctttttacccaattaacagccccctcggcacttcttaaatggtaatcgctaatgatgataacggatcacaatttttcgtcgcattgaaaattgcttctcgtctctgctgttccacaaaatgttggtcgtccacccacacaactggcaacaccgtttcttaaatttaaatttttaataatttaatttttaaatttacgcaccaaaaagggcaaggaatgcgcacacggccaaaatgtagaggaaggtgaacaggaaaagctccatgccgcggagtgtgtgctcatgctcaggcttattgaacgggtcgcgatagaatgccacactntctgcaaattttgaattccatgcattttgatttatattgatagaaataaaaagtaaaaaattggaattntctaggcttatgaatcggatc

SEQ ID NO: 29642 - DNA, 915 bp, Heterodera glycines
tttttcttttctaatctctcctcacagcaaatttactcctaacagaacaccacattcaaaccatgttacatacgggacacacgcgtttcgggcaaaaatttcaaaaatggcaaaaaacgcggcgaaacttagccacttaaaaaaatgtaaatttgcgtaaaaaatcaaaaagctagagatcggagcggggccatatcccgcgcgggattttgcgggaattccagtccgaatcccgcacctttttttggaaaaagcgggatttcgagaatgcgagatttgcgggattactcgagggatttcgtcccgaaaaaattttgaatcccaatgccgcggggcagcgagacccgcaagtttgaacttttcaggctctatagcagaccatttttcaacctattttataaaattattaaaagtacgtaaattttttcataaaatcatttatgaaaaaattgaattaaaatttgttaccaaattagtcagaaaaacaaaaaatttgtcaggcgatgtccataggtccgctgggaaaattttgaaaatcaatcgtaatttttttttaatagatttttggacaaaaatggcaaatttcgagttttaagttcgtttttttcaaaaatgtgccgccagggcgtcgtcgggggaaaaggtaatttttttaaatgaaattgttaaggaattatgccgattttgagtgaaaaacgcaaaaaatgcggcacggacccctaaaaggctgtaaatgtcgcgcgtaccgcaccaaagtataaatcctgccgagaatattccatcatcgcataaaataatacaatgccattcagcatcaagcccagtggtctgtatgggcaccgacgcgtgttagtcgagacgacaaatgctgtgaagggtggtaattatcacgcccttctgtacgcaattgtgcga

SEQ ID NO: 29643 - DNA, 1497 bp, Heterodera glycines
  misc_feature (54)..(54): n is a, c, g, or t
  misc_feature (93)..(93): n is a, c, g, or t
  misc_feature (96)..(96): n is a, c, g, or t
  misc_feature (105)..(105): n is a, c, g, or t
  misc_feature (107)..(108): n is a, c, g, or t
  misc_feature (117)..(117): n is a, c, g, or t
  misc_feature (145)..(145): n is a, c, g, or t
  misc_feature (188)..(189): n is a, c, g, or t
  misc_feature (192)..(192): n is a, c, g, or t
  misc_feature (196)..(197): n is a, c, g, or t
  misc_feature (203)..(203): n is a, c, g, or t
  misc_feature (216)..(216): n is a, c, g, or t
  misc_feature (222)..(224): n is a, c, g, or t
  misc_feature (227)..(227): n is a, c, g, or t
  misc_feature (239)..(239): n is a, c, g, or t
  misc_feature (243)..(243): n is a, c, g, or t
  misc_feature (255)..(255): n is a, c, g, or t
  misc_feature (262)..(262): n is a, c, g, or t
  misc_feature (270)..(270): n is a, c, g, or t
  misc_feature (303)..(304): n is a, c, g, or t
  misc_feature (307)..(307): n is a, c, g, or t
  misc_feature (320)..(321): n is a, c, g, or t
  misc_feature (327)..(328): n is a, c, g, or t
  misc_feature (337)..(337): n is a, c, g, or t
  misc_feature (353)..(353): n is a, c, g, or t
  misc_feature (363)..(363): n is a, c, g, or t
  misc_feature (369)..(369): n is a, c, g, or t
  misc_feature (1379)..(1379): n is a, c, g, or t
ttctcaataatataccaaataattcaaatttaattgactaactagttcataagntaataatgggtatttgtggtagaccttttgaatgagttnggnatttttatntnngattaattnattaaaggtttttttggataaagttttnaaaaagtttatttgatgatgaaaattattggattttaataaanngangttnntaaggnggtaagttaattnattttnnnaanttgatttattgnaatnaaaaatatgagngaatttntttttatnatttagtttgttaaaatttgttaatgttttttnnaanaaaaaataatggnnatttgnnatgtattgnggaaatttggaaagtnaatttttatnattaanataagaatgaaaaagataaggggcgtcaaaattagcaaatttattttatttaaaattcatgcaaattttaatttaaaaaaacggaaatgaaggaatatagtgattaaaaaaatgaaaattgttattaaatgaaattggtctcaaataatgtaaaatcaacaataaaattttcaagatacaaattcgaataatttcattgaaatgaggcaaaggtggatgatgagccgaatttgaggatccaaaaggttccccaaatttcaaatcaccaaaggttgagtgaccgaggctaatatggatatttcaaaggaaacttctattttatagaaatcgcaaatagaaaatgaattttggtatttttagggtattattttaaagaatttcgttaaggcgtgcgcaatattttttgattgttctacttttatatataattgcgaaaatttggtcaaataatgttttgagactcaaatagtcaaagcaaaaaattttaaaaaacaaaaaaaacagcgaaaaaacggtcggttaagacatttatttatttttaatacagtaatctttgaacttttgcacaatttttaaattatatttaaaaaaatttacttttgcagaagaatactcctaatataaaggtatttatgttaaaaatttcaacggtttctgttcggtctgtttgaattataaaattattaattttccattgccgtgagttttgggcctttttctgtcgcccttataaaaaatcaccgatttttggatgagtttaagctgatcacatctttttagctccaaaaagatgccgaaatgttcagttccaacagctacaacagttttgtccatttgttcaagcttgacgaaggtttcatagatctttttgacatttcgatacagtacccaatagcggcaaacgtcttggtctcgaaactgattggtgttcttcgactgaaccaaattaataaacaattttaatgaaacaaaatgtagaaatttttagctctgtgcaatgcgtttcgtanaaagggaaaacccgagtttttttcataaaaattttcatttaaatttttgtatattttaattaaaattccttttggcccaactcaccatgacatatttatcatgtctttcccatcatcg

SEQ ID NO: 29644 - DNA, 1456 bp, Heterodera glycines
atacagaatgaaataagcaaaaacttgtcaaataaataaaaaatatttttcaaaattttttgagagttttagcacaacaaaaaatgagaatacatatttctaaataattaccataggatcccatgacataacggttatacaaatatttttaaaatttagagcttagaaacggcccatgaaaatttaaaacataattaattttaaagagggaataattaataattaatttaaaaatataaaaaattaaaaaatacagatttataaatgttacttataattctttttgtaaataaaattgaaacctttaattttttagtggacaaagtataattaaatattaaaaactaaaattaaataaattattctaacgataatcttaccgtttataatgtgaggtaagcgtcaaaaaacaattttcacccaaaccaccgcctaatgatgtaaaaatgacgccaattaatgactgtgtgaaagagttggaaaatgccacaatgataaagctgagtgcttgcattatgcacacaagaaaatgacggaagctaataaataaataaaataataactttaattaattaataacccaaatggcactcgatcaaaaacaaatgggcacattagtttaatgaccaatgcagggatgataatggccaataaaatggcacctgttgatatgctattacagcttggctttggtagaacatgctgaaaatatttaaaatttatgaaaatacaaataaaaataggtaaaattaaaatcaaataattaatttttaattacccgacataaattttcggaagacaaatttgttgttgcgttatttaaatttgcggattctttcgtcggtcctttgattatatcttttgcagcacttagcataaccacaaaagcaaaattgtttgctaatccaaaaatcctgaatttataatgaattaagctaggattttaggtgctaaaaatgctaaaacttaaaatgctggaataggtactaaaatagttgccaaaaaagtgcaaaataggtgctaaaaacgcccaaaatacgcaaaaagttgcgaaaataggtgttaaaattggaaaaacccagtgtctatatgcacaaattccaaaattgactcatttttttttatcaatttcacccgcactttgaaacttgtcaagaaataaataaataaattttggagacgaatgaatttttcagaataaaaacctaaaaattctatttctctaataatgaatttaatataaaaaacactttatttattttttataatattaatatgcttttgtttccaaaaacaggtcaaaatttatcgagaccaacaaagccaggtcaagaatgacctttcagtaggaaatatttttttttaatataaaatatcatataattaaattaaataatagttccgcctttctttttaattgttgatcatgttccaaaaaaacaatttattattttct

SEQ ID NO: 29645 - DNA, 1227 bp, Heterodera glycines
ttgcaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttgttttcggggcattccccccgaaccgatgcgcccagatttatggggagaccgaatccctcgggaatagcttccctatagcctgtactttaattctgcgttggatttttgctccccataaatgtttgagtaccccaaacggacacttgaaaaaatcgatttttttgtttcataaatatttttttcagaaagtgctctaaagtgcaccaaaattttatttacaacttaattttagcactctgatgctttagtatcaaaaaggaagatggagaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgagacccttcgattgctctagtcaatttttaaaaatttttgttgtcggggaggcccccccaaaccgcaggcccccaaatttaggggga

SEQ ID NO: 29646 - DNA, 1155 bp, Heterodera glycines
ttacctcaacagaatatgatgtaaatttcatgtggccgggaataaaattgatttccaacacagttgcaccgactaaaaaaatcatttaaaatgacataatatatataaatataattaagttaattagcggaaaattgatcattgatcagctaaggttcacaaggaagtgcgtcagtgaaactttttaaatcataatcataaatcccaggtttttgagttttaaaaattacatgaattaggttgggtatgtcctcctctgtcaacattaatgatttaaatttcagacggattattcatacactgatcggatttctgattagatcagttatcagatcaagctcattccttattgctgataatgatcacacctttttcatggattatgtctttaccaatttctgatccttttttggatatgtatgacaaattaaactaatgattttgctcatcagaattttggtccttgcatgaattctgattagcacgcttgaactgttgaaaacttcaagactcttggtcggaattataccgtactttcgtctgatttgtaccgtactttttaagtggctctctggcctgtcatgaagcaacgagacagtgaaattgtatttgtttatgtcggtcaatgaaattttgaagtttatttctgtatcaatttcaacgctgggaatggccatgaaaaatggcaatggaatcatcggtgattcctttaaaattaaaattattttaatttaatttaatttaacatacataattagtgtcaatggtgacaaatggcatccatggtggaggatcgttgaccaacagagcagcagcactaatcttaaaaaaaccgaatttataattaccaaataaattttcgcgattgtcgagactctcgagagccaacaaaacctgaaatgacgtcattcgttcaaattgctttttcatttcctttggctccgtccaattaatgggaaaaaattcttcgccctctttgagataattgctctgcacaaatttgccatttaattttatgccataactgtggccagtgaatgcaaaaatgaactcaagcaactgagtttgcgtcgtattttctaatgggttgataattggcacaattcttggcgaatagccctaaaatttttttatatgtaattttgaaaaattcaa

SEQ ID NO: 29647 - DNA, 2478 bp, Heterodera glycines
ttaattataaattagataatttttttaaatttcttccttttgttgaagccatacatttgtggtcataatctgctgtttttcatgctaaaaaattattgaaatttttaggttgttttaaaaaaatatatatttggggaaagcaaaaaaactttcaaagtaggcagggactgaaaattttgtcgggaaataggctaacatataaaaaaaactttggagaggtgaaaaagaggggaaattttgtgttccgaagattttgggtaaaaccgatgaaaaaacttttggtaaatttgcggaaaattaaaaaaaacaaatcccagaaaatccctggggataaaagcaatttgccatgacgctgtaccaacacgcacacataaaacaaaatattttggttgacaacagcgaaaaacattttgatgggctgacagacagatgagggataacaatgaaaaatgcccaaaaatccaattcgacttggaatttctgtctcatcagtcaatcaatcagtcgaccgacccctgggggcaggaatttatgagaggggaaagggcggcttcttgcccgtggcaaaaacatttggctctaaggaatttgatcagaaagaaaatgttggaatttgatgttgcaataatgaaatttaaaaaaatgccaaattgaagcagaaattggcactgaatttttcgatcaattgggaaagcagctaagcttttagtttttttcgatttcaacatttgaaattgaattccttgcccagtaggtccccctagtttccaagtttttgagagataatgcaattcaaaaacaagagaattggccaagattctcgaggccgattttttgaaatttgtcaagaaaaaatttgataaactccatttcaaaattataatgtaaaaaaaaaattgttagtcacttaactattctcatggaaaaattgagctgaaattttcaccaagcgtactttcttataaatattaaaaatcatagacaaaaaaaaaattggaaagtgtaaaagaaaaaaaattttcggattttttcacgaagattgctctaattttgttcaaaatggagtgttaatattttttgaacacttccgatcactctgaagaagaactgctggtcgtctgtcacggaggtataattggttttttcgttcagttttgaaaatatttagcattccggtggttttttgaaatgtaggggatttatttgaaaattttttccaataaaaaattcttacaacgtcgagcagttggctgagcttcagcttgaacttgaccaccagtgttgcgttgttctcgtctaccggcctgaccagcttgttgtagtcggccaacaactcctcaaacagttgggccgcgtcctgattgccgcgcgacggatgcacaaccatggccaagagcagaagtggcacaacggaagaccagcagcagaagcaatggagcagaggggcgacggaaaaaacagcgcacttggcaaacgatgccgatgatgaggagggggagggatgatgaagcacggatttagtggtggaagatgctaaaacggatgatgatgataaagatgatggtggtggataatcaaacagaggaaaatagggtttagaagatgaagcggaagatgtgtggcagctaattgacggcggtgattgggtcaataatgaaaaggatgatgatgataatggggattaatggggtggagggtgaagcaattagcggtttggatgatgataattgggatgataattgacggttgctgctaatgatgtcaatgttaaagttgtcgttgttgtttctgctgggccaacagcagccgatcatgcccaacggtcgtggtattgtagttgcagcaacggctgattacggtcgtcgtttggaaaaacaacagcgacaacaaagggaacaactctaatgatgaagatgatgacggtagcggcaagttttcgttgcgacaaataatgttagacgacgacggcataaagcggaaggcggcacagtgtgacaatcgaagaatggtagtggtgatggtggtactgtagcagcggcggcggctcggttctactgtagctgatgtacagtgggaaaactgtttgttgttgatgttgctggagcgcatgcgcggcgccaatgcgaagcgaatgcgttgatgatacggtaggagttcgtgcactacagtaatggcaccatgacgaattagttaattgtattaatttatatgtaagtgctgctgtactgaattaattatgggtgtgatacagggagatgaagcagaattcgaatttaaaatattacaaacatacaagggacctgtggcaagaaaagtcttgaaacattgtcaaaaaatgtttaaacccgagttttgtgccaaatatctcttaaaaaaagtttttaaagcacgaaccttaggcctaaatatctctaaaaatcttaaaaatcctaactttaggtccagtaccttcaataatttttaaaatacgtcctaatc

SEQ ID NO: 29648 - DNA, 1443 bp, Heterodera glycines
ccgttctccgtccattcggtgctttcacgcgcgggcttcaatttcgatggtcagccaatgttcgcgtccaatccgatcgaaaatgacgtgagtctgacaaatccatccgaatggcccactgtatggcataaaaagcgaatgatcgtgacgcaaaatgccaaatttctgaaaaatgtcccaaatttgggttttttccactctcacccgactttttccgctaatttaccacaaattcggcctcacaaagatcgatgacattcagtttgaaccacaaccagcgcacgcgtctttcgccgtaaaagtgcgctgttcgcagcatccgctcaatcaattcggccgcgtatgcgacggcgtccgcgaaaagtgccacggcacaatcggagggagaagtcatcgcaaaaggtgaccaacgaagggcaggcggaacgaaggacagtgccaatgtgagagtggacagacgggggcagacaaagcacaaaatggagagcaaacggagccaatggtcgacgacgagccaatggaggaagaacggctcaaggagagggaggtggacacggaggaacagctccaactcaacggcttcagaagggacgacggaaaaatatctgagaatgacggggggggggggggaagcattgaagtaatgggcaagcaatcaatggtaatgccactccacctgcattttgtgccggttctgtgggtttcgtccctctcttcaacggtaaattcgatgatttgcggatggaaccgaccgctttccgcgagttcgtagaccaaagccgtgctggcacgacacacctccttaaataaaattttttaaaaatctcattgtgttttcacttgccatgaccacacagagagacggcgaatattcagtgccatcgcgaacattcagtgccatcgatggcgtgcagaacagcagccattcgcgcagtgcgccgtcagcgccaattcggcaacgtgcccccgtgacgacggactgtcgttgttcaaattgtacagcgagcgaagacattcaaagaaagtgaaaaggaaaagcacttaaagaaagaaggaaaaaatagcaaaaattataaatattcgaaaactaaaatgtaaatttttctgaaaaacggtttaaacttttttattgattgatttaatatcattttgataaggacactatgggtacgccccagtgtcagacaaaattgctcataacgccaaatagcgcatttggcgtaaatttttgcccgctatttcaaaatttacactgaaaaatgccttttttgtattttttattttgatctgctataactagggttgtaaattatatggactaaaaaacgcgaaatatggacattaaatatggactaaaaagcccgaaatatggactaaaaaggccaaaaatggccaaatatggaccaaaatatggataaaaaatgccaaaatatatattgtaaa

SEQ ID NO: 29649 - DNA, 1300 bp, Heterodera glycines
  misc_feature (1229)..(1229): n is a, c, g, or t
tccggattttaagcccgagtgttgaattttcttgtgattctcctataattttcagttaataagttgtcagttttattctttaattctataagtaaatcccgaaaacattgcaccaattgacttttctccggattttaagcccgagtgttgaattttcttgtgattcacctataattttcagttaataagttgtcagttttattctttaattctataggtaaatcccgaaaacattgcaccaattgacttttctacgataggtaaatcccgaaaacattgcaccaattgacttttctccggattttaagcccaagtgttgaattttcttgtgattcacctataattttcagttaataagttgtcagttttattctttaattctataggtaaatcccgaaaacattgcgccaattgacttttctccggattttaagcccaaatgttgaattttcttgtgattcacctataattttcagttaataagttgtcagttttattctttaattctataggtaaatcccgaaaacattgcgccaattgacttttctccggattttaagcccaaatgttgaattttcttgtgattcacctataattttcagttaataagttgtcagttttattctttaattctataggtaaatcccgaaaacattgcgccaattgacttttctccggattttaagcccaaatgttgaattttcttgtgattcaccaataattttcagttaataagttgtcagttttattctttaattctataggtaaatcccgaaaacattgcgccaattgacttttctccggattttaagcccaaatgttgaattttcttgtgattcacctataattttcagttaataagttgtcagttttattctttaattctataggtaaatcccgaaaacattgcgccaattgacttttctccggattttaagcctgaatgttgaattttcttgtgattcaccaataattttcagttaataagttgtcagttttattctttaattctataggtaaatcccgaaaacattgcgccaattgacttttctccggattttaagcccaaatgttgaattttcttgtgattcacctataattttcagttaataaatttgtcagttttattttcttaattctataggtaaatcccgaaaacattgcgccaattgacttttctccggattttaagcctaaatggtgaattttcttgtgattcactataattntcagttaataagttgtcagttttattctttattctataggtaaatcccgaaaacatgccccaattgacttt

SEQ ID NO: 29650 - DNA, 1657 bp, Heterodera glycines
  misc_feature (1474)..(1474): n is a, c, g, or t
  misc_feature (1624)..(1624): n is a, c, g, or t
tatatagctaaaccataatttccctatttcagaagatccgtcgtccctttcggcttaattcctccaaataaaaatgtgcttctcatccgaaattgaaaacacacgcaaaaattgcaaatttgtcttcgagcaaccttgtcaatgtcctcccaaccaactcgaggccatcaaattcagcaaggtgtggaaaatttcaaaaaaacccaaagtttttttctaagcaaatccctttcccctctccgtttgttaaggtgacaaccgggcgaaaaggcggtggacaggcttgctgcttgattatgtgtggcatttttggccttgtaagttttcagtttttgccgaaatttgtatcaaatttcactgcccccccctccatattttcggcgttggtcgtgggattgtcggtgatgctctacgtctgcatatcccgtaattatggtccagatgagatgccatatatactgtttgtgtccaccatcattgttgcgtgttgcgttattgtatgctgtgctgctgcaggtccagtaaatacgccgaataatatttattgtttttcatggtccgttattgatcagtcactgatcaagaaatatgatgttacttccatccattctgagactaaaacccgccaaatccgaatcatttgaattcgaatgtgtataaagagtcgaatttctcgaaacaaattgggtgggctttttggtatggataattctttgtaaataaggcaccattttctgtcgttgtaattgtttatttatgtattttacccaagtcccatttttgttacagtcggaggcggtcacagttcgttggaagtactgtaccgatgttcaccgtgtggcaaagatacgcacagaatttatgagtgcttcagtacgtcaatttttaccacatcccctcaattacaataaattttgtcctgatttaagttgaggtcgattacttcggcgagagaagccgtcgctacgactattgggacaattcttaccgcactcgccaccgtactacctaccgtactcgaacgtacagtgcgtggggacagtacacggacaaagtcgaaaaatgtgaactgcaacagggacggatgaccatgaagaacttcgatacggtggagcgcaaattcgatgtgatgagcattgttcaggacaattattacaagacaaccgatgattggaccaacacttttataaggcaccttgaataggcatgccaaatggcaacactttattgtataactgtattatatatatgcgtatttctcgtataactgtattatatttgtatatgtgaataatactgtgttgtctgaatgaatgttatacggtcttttttgtccaaaatgagtacgtttcattccccaatgtctttcacccttccaatccgaaaagatagcaatcggagacgcaaaaccgctcaactaacaaaaatgagaagaaaaattgcagccaaacctacatagttttgtaccaaatancaatttgatagttttttccttcgttttttggcaatggataactgagtccccctttgaaaagagacacttcagtatccgattttttacatgaaaatggcaaatacgcccctaatttgcatttttctcatcatacaaaaacggcttacctanatacacgtaaacaaactgaaagccatgccaatt

SEQ ID NO: 29651 - DNA, 973 bp, Heterodera glycines
actgagtataggcctcaatttttattttttcagcgtttttggtcattttcttgtccaattgagcgccggcgctttgtctattctaaaaatttatttccggaatttccaacgaaaaatgccaacccccttccctgcccgtgtttttagtcctcctacacatgccaattgtctaatgtgctgaaccggtacgtgtgctgtggcacacccgctgccgtggtgttgtgcgcagacgggcgcgagacgtaccaacaggagccgggtcagtcacccgcgtcaagagtcagaaattcttgaatttttggaaataaattaccctaactacacttcagcctccctttaaaagggcacaatgcttagcttatcaaatttttatcaaaattttatcacggcaaggacattcttggaattaaggacgttttgtcaaggacagaataaagaccagcaaagactttcaaggacgtccttggcacccaaggccgacgaactctagttcaaaaaaaatccttctctcccctcaggcagagtcgtacaatgcaacccgatcacatggccaagtgaatgcccggccggctacgagtgcggtaaaatcttgctaattgccaaaaattttataggagctatttctttggaattttgcacattttaaaatgctgatctccggcttatttaaaaattgatccgccccattccagtacaaaacttcttggactataacttttgatagagacatcgcaaaccctaaaaacctataaccattcggttcctctcgacgagaggaaccgattgatatgcgatatgataagttatctctttgtgttaaaatcattgacaaaatagtttgataaaatcatcgataaaagcataaatttttgcttcgacgccagattttggtcaggcctaaaattaccctcgaaaattgatttcctttgtcgggatcatgggttttttattggggggggggcataacgaaaaa

SEQ ID NO: 29652 - DNA, 1000 bp, Heterodera glycines
  misc_feature (907)..(907): n is a, c, g, or t
aaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggatatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaatttggaaaatggctatctctttttctgctncacagtaatagggattccaaccgcattctcagaataattacgccgatactaattgttctggaatttgtttctcggcgcgtttgtttgggaaaa

SEQ ID NO: 29653 - DNA, 1175 bp, Heterodera glycines
ttggctttagcctcggcatcctttggagcctttttttctgcatcttcttgggtttagtctcggcatccgttttagccttcttttctgcgtctttcttggctttagcctcggtatccttctgagctttctcttctgcgtctttttgggctttagtctcggcatcctttttagccttctcttctgcgtctttcttggctttagtctcggcatccgttttagccttctcttctgcgtctttcttggctttagtctcggcatcctttttagccttctcttctgcgtctttcttggctttaacctcggcctcctttttagccttctcttctgcgtctttcttggctttagcctcggcatccttctgagccttctcttctgcgtctttcttggctttagtctcggcatccgttttagccttctcttctgcgtctttcttggctttagcctcggcatccttctgagccttcttctcctcagcctcttttctcttcttttctgctggagatggtggtacttccactggtttctcttcctgcttcagcctttcctttgtctcttccgccttcttcgcttccggcactacggctacgccttcggcaggtgcctcaggcttttcttcgggcttagccttttgcttcttcatttcttcctcctttttctttgcttctgcgtctttcttggctttaacctcggcatccgttttagccttctcttctgcgtctttcttggctttaacctcggcatccgttttagccttctcttctgcgtctttcttggctttagcctcggcatccgttttagccttctcttctgcgtctttcttggctttagtctcggcatcctttttagccttctcttctgcatctttcttggctttagcctcggcctcctttttagccttctcttctgcgtctttcttggctttagcctcggcatccgttttagccttctcttctgcgtctttcttggctttagtctcggcatccgttttagccttctcttctgcgtctttcttggctttagcctcggcatccttctgagccttctcttctgcgtctttcttggctttaacctcggcatccgttttagccttctcttctgcgtctttcttggctttaacctcggcctcctttttagccttctcatctgcgtctttcttgactttagtctcggcatcc

SEQ ID NO: 29654 - DNA, 1674 bp, Heterodera glycines
cctgaactcggatcaaaaaattcccgctgtgagggcactccgcagaagtgtcctctataatacagtattttttattttttgatcagaccaaatcccggacctgtacagacacggagactcagttaatttttttttcccacttcagtaccaggcgaataactcattagggtttgacctgagcgcaggtggccagcagacttattgtagagctcaatgagctcgatttttccagattttaaaatttcgaaaattttcaaaatttttcgagttaggcctaaaaaacggttttcgggttttttaattttatgattttttaacgaattttcacagaaaaacggagaccacttccaaaacatagtttttcgagctctatcgactggtatttttttcggaaaaatttcgattttttcccggaaatagaaaaaaattttggcctgagcgggacatttgagtcccggctccataactcgttaggggttggttttatcgaaaaaacgccttagggcaaaattgtagagctttttaagctctatctaatggtatactatatgaagggaaattttcaaaaattttcgagctaggccccctagaaattttcaaaaattttttttgggttgaaaaagagggtgaaaaatatttttctggggtattttgatgtgctgagcacgaatctgatgtttgttttacgtttcagaatttttggaattttttaaaaattttttattttttggcaattttttggccctcgggattttggcctaatatttaaaaattcataacaaatcgaagggttgatcaattttacaggattaaagccttaaaaatagagaaaaatcaggagaattttatggactttatttggaatttctatctaaaaaaggaaaaaagttattccagaatttctggaaaaattcgaattttcagaaaaaaatttataactcgcttctgaaaagatattcaggaaaagtaaaatgctacaaaaatccgcaatttttagctctattttataaattttatttcacatttttatcacttttttgaaaaatgttataaaaataaaagtgattttgggattccagaccaaagggggtggacaggatttttgagtgaaaattttttttcaataaaaatcttccaaaaacatgtctttatgggttatttgggcggctgatcacgaatacgtaatcagattttacttttgacatcgataagacctcagaatccctgtgtgattggggattctgaggcatcattttgagggggggggggggggggaaaaatacacttgtcctttattgttcaaaataggcaaataatattttacattttgggctttacattaaagttccactatgatgtctttaattttgtacatcaaacaaaataaatgatcataagaagaaaatcttaatataattgggtgatttaaattgattacttcgaatgaatgaagtaatgagttgtttttattcacatttgctacgacaaatttttaaaaatatatcatttcaatgtttcggcgatgaatatttaatgatactatgacacaatccaactttggcaattcagctttatctcaaatccctgcccaaatgcatttaattaatttttaaaattttattaaaaaaattcaatagaccttttaaagcatttttaaagcaaattaaaaagatt

SEQ ID NO: 29655 - DNA, 1396 bp, Heterodera glycines
  misc_feature (1383)..(1383): n is a, c, g, or t
accatgtatgtgacttttctaagcaatctaagatgatttaaaaaaaaaaatttttaatttgtggcgtacgaaccatataagtaccgaaccatggtccagggatgcaatttttcccgcttttggaagcatatatttattcatttttttagtcttttagagtgtcataaaaaatgcgaaaattgatgcgtttcttcaacattttttttccacgttatgagacatggcgtgccacacatacacattcttgactttgaaaggaccactccaacccaaaacaaacacaataacttacttttgacattaaatttgcgctgttttgacggcggcatttttctgcaattatctgtaaaaatttgtgtgtgctttaaatgtgaaaagtgtgtcaaagaaaataaaaatatataggtaataattcattttgaaatgggaactttatacgttttttgtggcatattttaataatatttattgaaaataattaagcgaaaagtttaaattgttagtaagcagcaattaggaggacaaaaaattacaacacaaaaattaaattatggcgaaagaaaaattgcgtaaaaatataataaaatgaaagtaaagcttcgtggaatggaaaataaaatcaaaaagtcacagaataacaaggaaaaaatatattatacaacatttcggaaaaagcctgacattagcctggggaaaaatttcgattattgcagccataatttttggaaaattaccaaggaaaacccaaaaattcggggaacaaaaaagttttcgggttgacccatcaaaattttttttccttggttaacgacatgttcagagcaatgccaataaaaaaagttttttgtctccgatcagccgtcagtatgcaactcggccaacggcataatgctgctgcggctgcactgcttggttgtgccgatggccggtaacaacggcggcggcggtggcggtgccgtcggagtaacagttcagccaattgttgctgccgtgcaacgatgtttggtaggaatttcggcgaacacttgccaatgtggcgccaacacttcgcttctcggcacgtctttctaaaaaatgcaaaaaaaaagcatgaaattttcaacaaatgattttttgaaaaattaaaaaaaaaatttttttgggaaatttgggtgagggaggccttgttaagattttgtgtaaaaacgaccgaattttgcgatttttagccgatttgatgctttttattaacaaattttcactaaaaaagtgtataatttcgaaaaaaaaattacgaaatagaaaaacgaaatcgtaaactattttaaagaaatgcaattcgaaatcataaaaatgttgactttttggcacagtgttccccgggtgctttctgtacatacattnttttagggggggg

SEQ ID NO: 29656 - DNA, 736 bp, Heterodera glycines
  misc_feature (712)..(712): n is a, c, g, or t
  misc_feature (727)..(727): n is a, c, g, or t
ctgtgccacacacgctagtttatatatacctaaagaaacaaggcaactcatttccaaaactaaaatctccttacggtttgccgggaggggttcgaaatttcgaccttgggggtaacttttgacggcgcattcaggaaaactatagattttccgatccgagggccaactgagcgccaggcgctgaaaagtcactttttaaaaaatttttttgctctttttgggattcaaaaattttttaaaggcctaaatgaaaaatcggcctcgataggattttaagttggacttttttggattttttttgtttcttgaccgaaccccaaggtcttgtcagtttttccgaaaaactggctaaaaattgcatacttttttgggccatttcagcgccggtggaataactccccggcttttgattggaggaggtcggtgtaagcggcttttttgtagagctcgacgagctctatccaaccatgtttttagatttcagaaattttcagaaattttcgagctaggccccctcgaaaattttccgtttttgaattttattattttttacagatttttccggggaaaacggagaccactttcaagcaaccgtttttcatgctctatcgattggtgtcattttcagaaaaaattttaaaaatttttttggaaatagaaaattttggttgctaggcctcaatttcagttctatggctatatcttctcaganggttgattttagcanaaaattcat

SEQ ID NO: 29657 - DNA, 1149 bp, Heterodera glycines
  misc_feature (1097)..(1097): n is a, c, g, or t
  misc_feature (1136)..(1137): n is a, c, g, or t
agggaatccgcggaagagatggtgtccgcgctgccccgcgaaatgcggtgacgaccagcggggagggggtcgcgccttttaacgcaaaataacacgaccccgcccattccatcggtggccgactggttaacgcctcggcacaaccaccatctcgggttcaatcccgcgcggcgaaactcccgcgcatttaacccccacggcccaaaatctcgcacaacccccttcccacacccccaaattccgaccccacaccatcccgcgcacctaccaccatcccgaacccacatctcccgacgcatccccccaccccattcccgtcagagacgcagacacaaccacctaataggcacggacccgcccgctcatcctctctgcgctcagcggagaaaatcaatcaatagttaaggtggtctccccatgtagtacgggtgtctgtattaacaatttaatttttttttatcattatttcactcattactgacggtggcagttttcggaacaatgaatgctttcgtaacgagaaagtttaattcaaacaaaactggataagaaattaaaattaaaatattcattaaatattgaaaaaaaattaaatataaagtgaaaatattcaattacgaatataacaacagtattttcattatggaatttgttaaaaaaatcaaaaaaagatgtgtgatataaattttaaagtactcattttccataatggaatctgaatagtaattaaaaaatattaaattaaaagcttctcccatttaatattaattaaaattataacaatcaataaaaatctgaaccattttgatttggtattggttgctaccttatttcaattgaaacaaaaatggcctgacaagagaaataaattatagctaaaattattcacaacttcaaagatgttaataaacaaaaaatcgcacagtgaaattttagtatttaaatgaatacaaaattaaatattccccaaaaacatcttcttgcctttgtgaatgaattgtaaaagttcactacaagtttcttaatgtatttaaatagactaaaatgactaataaaattaacataaagtaaaataaaaaaaaaggttattaatccanaaattttaaatattaaaaattgttttgatacaaatactnnatatgacctgca

SEQ ID NO: 29658 - DNA, 1616 bp, Heterodera glycines
  misc_feature (589)..(589): n is a, c, g, or t
  misc_feature (1487)..(1487): n is a, c, g, or t
  misc_feature (1591)..(1591): n is a, c, g, or t
aaataatgaattgtttcactttatcttgcttctttactgtaatgcgggtccggagaagcaatttccaccatttctcttattttgttggcgtattccgttacactttctgtgcccattttaatttttgcctacatttttcgcgcccacatcgggccatccaattttttggtcattgcggccaattcctccgttaaggaacgccaattattcttttatttgccgggatattttgataaatctccttggcttccccttctaagaataatggcaaaagacggatgcagtccggtggatgccagttcgatgctgtcgccagcatattaaattcacggagaaatttgtgaaaatccccgattccgtcaaatttcggaattttgccttctcttatctctttcttgcctacttagttccttatttttaaagggtctggaatattccgaagtcgattcaattttgtttcccttttgtgattttttaattcaccggaaaaatttaactcaatttacaggtgtaaccgtccaattattttaatttttccgtttgctcagctttgtgtgaatttggtcagaaaattccacctgcacaattngtcctgtgtgtccttgtcgcaattcctccggcgattgtgtccaccaattcacgtttgaacggtttattgagagaatttgacaaatttgaaatgtctaaattataaaatgttacggtagaacaaaattactgtattgcagataattaaaaaaaaataatttagaaattatttaatttttattattattttctaatatgtgattttcgacaagaggagcaatttgtcgaatttttcgccaattagttattccaccgttaaaatgagtgcctagggctttcgagggcccattaaaactttaatctttcatcattttttagtctgtcattaatgtgatatcggccgataattagctaattaattgtgcttaattgctttaatgctttttcatttctttcaattgttccaattttcttattttctcgtgatcacccgggaagatttttcttattctttgctcattattactcgctgatctcttcttttccctcgaaatttgcccaggcgaccccttgtgatcaccagtcggcgcctgacttataatcacaggtcatcgttcggcaccaaatcaacggttttattgcttttggcgaattccaaactattacgaaattagaaaatttgactaattgatttgtgtgaagtatgaaaaaaaaataccgtatttgcaatttaaacttgaattacttttatttggaaatgttagcatgtcggcaattaaaactcgaattaatttttatgtctttatttagaattattttaattttcaatttttcgcattttctctctctttgacttgtttttaacatctgccaatgtcgtcgcgtttctcatcatttacaaaagaatttaatgaatagaatttgcaaataattaagggaaaaaatcgtttgcattttanattaatttgaattcgtcgccgtatctccgttctttcatagagcattcattttgttgagctcgacaatttttgtgtacttttggatttatttaatttttgtccanattcccatttttttatttttaatta

SEQ ID NO: 29659 - DNA, 937 bp, Heterodera glycines
tatattattttagcaaattttcattttccattacccttctttaaattttacaaggataatggcgcatactgtactaatttacctctgagatttgcatccaatagttttgcttaaatttttacgaattttcgacttttaaacctattgttttttatgctttcctgtaactctaaataatttgatcatttttttcagttttatgccgacaatcattgcctttttgaacaaatgtttgccaaattcggtgaaaaaaattggcacaacgcaaatcaatttggatgaaaatggcataaaaattggttttgaagcaacggcaggagcggtcgcaaattcgctagaaacttcaacggcaacagcgattgacgaattttcaacggttgcaaatctgtcgcaaatgcttggcgaaacggacaatactgaatcggcgaacaaaaacaacagcaacaacgacattccgccaacgtctggcggccaagcggaagtggcatccatttcaaattcaaatttgacttcatccgctgatgatggacaaaatgccacgggaggagggccgctcaccaaattggaaaaacgagataagccagaaaatcggcgaattctggtggacaatgagcgtgatgagcccataaaagcggaggaagaagacgaaaaaaaggatcgagaagaaagtgccaaagcggagagggaccaacaaacattgaggaaaattgttcctgacagggtaaaagtaaatttctttttaatattttttgaaaaaggaatttttttacttccgctccggaccaccattttttcatatttttgaaaatttgatccaaaatggcaaaaattggtcatttttttggcgaaaatggcaacaaattccctgttttttgtctaggcgatgaaacttttaaaatttattggagaaaaaaattttggagtctaagcccaaaaa

SEQ ID NO: 29660 - DNA, 1495 bp, Heterodera glycines
  misc_feature (1462)..(1462): n is a, c, g, or t
cccatcgtaaacaacctggaaatggtttaaaaaatatctcatttaattgcttacaattagtacccctccccctccctggacatactgcttcatcgtataaagtggaattgccatgatggcttttgtttgagtgaaacatgcgaaaatggacaacgaatgggtgcggaaattgaattggcaaagtggaatttggcattccttcacaaaacactcctcgagggggctaaaggggcaaaaaagaaagaattggctttggaaatgcattaattaccgtggcaattaattctttgttttcgccatttgcagcgtccaatgtgacaatgtcagcagaaaaataatcgtaaacgcgagaattattgccgtcgactaaaaacaaaacaaattaaaaatgaaattttatgtatttcaccgtcgtaagtcaacactcggattgtgtacagcgacggattgtgccaatggcggctgtacggttgctgaggcgtcatatcggccgcgtattcgagttcaatctgacgagagaaaaacgcgataattctgttaaaaccacataaaatacacgattagagaatttggcggccttaaattccaattcggtctatgcatttccaaattttaaattccatcggtttgctttcttttgcgtgtccctctcataattaattacctgcaaacgcagtgccccgtccccggtgaagttgcgcttgcaccccgtgtagccaattgtttcgattccgttcgttagcaatttgtcgctgtgcaaagtgccgttccatccgccgcctatgcgttcgagcagtgccaacagttggccaatgccttcgccgtttaggcccgtgccattggtcatttgtggggacagaccgagcacattgacagtgacatttggtagcacagaactgccaaaaacatttttaagggaatttaaatttcaaaagcatgccaaaggctgtgcacattcgtcccccaaaacctttcatttgcttttccaatggccacgcattctttgtgatgactcattcgttgctctttgcttttgttgtcccatttgtactgatctgagaattaaattattataaaagatacaatccggtttgtatcccatttttgggttaaatttttctttattattgtcagaattaccttttgactaatggaaacgcttaaaaattttagtcttgctgatttattcaaagttttgaccctccctgacagcgatttcgaaaagtttggccacatagataacttttttccacatctatttcatttgacccaaaaatgggatacaaatcggactacgttagtaccttataagaatggcaaaaacattcttaaaaggaccttcgtaataaattgttctgttgaacacttgcacttccttctctctgccccattttttgactaccaaaacatcttccaaatgtttttcaacaatttttgccgtggcatttccatgtaaaaaatncggtgaatcgaagggtcgtctaaaatggatgat

SEQ ID NO: 29661 - DNA, 1126 bp, Heterodera glycines
catgcccattcgccaagccctcgctttccgactgctcacgggtgccacgcatgcccattcgccaagccctcgggttccaactgttcacgggtgccacgcatgcccattcgccaagcctcgggttccaactgttcacgggtgccacgcatgcccattcgccaagccctcgggttccaactgttcacgggtgcacgcatgcccattccaactgctcacgggtgccacgcatgcccattccaactgctcacgggtgccacgcatgcccattccaactgctcacgggtgccatgcatgcccatacgccaagccctcgttttccaactgctcacgggtgccacgcatgcccattccaactgctcacgggtgccacgcatgcccattcgccaagccctcgggttccaactgctcacgggcgccacgcatgcccattcgccaagccctcgggttccaactgagcacgggtgccacgcatgcccattccaactgagcacgggtgccacgcatgcccattccaactgctcgctttcctgctcacgggtgccacgcatgcccataagccaagccctcgggttccaactgctcacgggtgccacgcatgcccattccaactgctcgtacgggtgccacgcatgcccataagccaagccctcgggttccaactgctcacgggtgccacacatgccttcgccaagccctgggttccaactgttcacgggtgcacgcatgcccattccaactgctcacgggtgccacgcatgcccattccaactgctcacgggtgccacgcatgcccattcgccaagccctcgggttccaactgttcacgggtgccacgcatgccattcgccaagcaactgttcacgggtgccacgcatgcccattcgccaagccctcgggttccaactgctcacgggcgccacgcatgcccattccccaagccctcgggttccaactgagcacgggtgccacgcatgcccattccaactgaacacgggtgccacgcatgcccattccaactgctcacgggtgccacgcatgcccataaaaaaaagcacctccggttcccactgctcacgggtgccacgcatgcccattccaaatggatcacgggtgccaacgcatgccc

SEQ ID NO: 29662 - DNA, 1175 bp, Heterodera glycines
cgatccaaatgactccgggccccaggaggacaagtgcgcaacaccgccaatgatgcagtagttcatcaacgaagtatagaactttgcgaagaacattttggaacgaaatcgagcaaaaattgaaaggaaaaaatatggccaaaagagattgcaatatcatttttaaaatttaagactttattttgtatcatatagaaccgattggataaatagcaaatatgtttggacgaagaacgatttgttttggccgaaactaaaaaatggtaaaatataattggtgcagtgggaacaaagaagtgtagcaaaaatgacagtgccaaaatcgaatttttgtcgctgattgtagatggataagtgactccaccgataataaaatcaaaaaatgaacaagaatggcgccacaattaatttgtccctgcatatagattgtataagtgattcgattgagattttcaagaaaaccgaaaaatatgttaagaaaaaattatacgccgtttttcgataaatatcgactgaataaatcattactgccttttttatctgactaatatttcgttttacactaactcgatcagaacattccctcatggtgatttcgccatccggaatatttttatttattaaaaaaaggattaaacaaaaactcaacaatatgcaaaagatcgcaaatcactacgatttacacatacccgctgaaactcaaatttttacgaaatgacctttcattcgtcactcagaaagtctcggagatagggcgttgatgggaaatctaatttaataacgcatacattgtaccaccaaattttatcagatcgttatcattcgaactccaactaaattggccgttaaagttttggccattaatccaatcattttttaatttgcgtgccctttctctctctcctctctcatttatatcagtcggtcgtcgtcagttggcttttttggcgggactttaaattgtcggaaattctccacttcttttctcacctaatgggggcttcttcgtcataaaatgaatgaacggatgaattggattgcatggaccgcacgctcacacgcactttcacacataatatacgacatacaaatacagcatacattcgtcggcaaaagcttataacaattttgtctgactgtctgtctgctcgttctcttcgtctacaaaactctct

SEQ ID NO: 29663 - DNA, 1063 bp, Heterodera glycines
cgttaaaaaggcaaaattttggcccaccctgagggggggcacataaaattgcctttctttgtcggcattattttattatatcccccttttaaattcttttgtttttgaattggaaaatgcccttccaatcggtgtccaatttcctcgattgaccttcttctgtcagcccattcggcaactttacccaccacaactatcagcagcatttctccgtctctcccctttgatttcgttgccgtccatccgccgtcggctttttctccgctaaatttggcaaaaaatggcaattttttgttctctatggcatttgctccgtttcaattttggtggcgtccctccatttccgcgtccgaccttccctcaactccatcatcaagttcaagcagcacagcaagcatcgtcagaagaagaaagtcagcggcaactgttcctcctcctccaccttctcctcttccttcgttttcgtcagttgtcgcgccgtcgtccgcccattcgtcggccgtgcttaaattcggtcatgaaacacttttgccgaaacatcagaataaattagacttgaattgcttcaagtttttgccgcctaaactaaaaatttgacctttaattaaccatactaatttgatgtgtgactatgtatgtcaaactttgaatggattatttttcgaagcgaaagtctttgaaaaaaagaaaacaaaaaatgaggtatttatgtaaacaaaaaaacacaggagatagtgttgagaaaaagataaacaaaaagagaaaaagaaagagaactaaaggaaaaaagaaagggagggaagttggggtgaaaggaaggaagcgagagaatttaatgaaaagagagagagaaagagggagaagagagagaaagagggagagagtagagaaagagagaatggtagagcgaagagatgtttagtaaattatgacatagagacaaaagaaagagacaggaagagaaaaggagacaaagaggagagaaacgagacttggatgaaaaacgtatttattgattaaactactatcaaattttatttaaaattatttgaaaaaaccccga

SEQ ID NO: 29664 - DNA, 1150 bp, Heterodera glycines
aaaatggaaaaagaagcaaaaatctaattttctgaaagaaaaaacttattttttttcattcaaaatgattaattttttgtaattataattgcttaataagttatttacatcgatttcaatttatttcattgaaaaaagtacagattttttaaaatatttcgcccctattttaccattattttgttgcttagaatttataataaatttattttgaaagtcttttggctttaaattttaacgatttgtatttattaaataaatttttatcaaaaaaacttatcttcacagaccaatataattgatgaatacgtatttttacggattaaaggtttcaagtggggagcaacaccctcgtcatggaataacttttcataaaaagtcaaaaaaagataaattccaaaaagatctttgaaactctttgttcactaattgttagactgaaatttatgtctttaaaaaagtttcagctctaaatgctccggttaagaggaaaaattgcgaccaggccttttggggtattgttaaagaattaaaaatattgaaaattataaaaataaaaaaattcttttcatttaaatttgtatattttttatgtaatgtatttatttatttatttttttttgctcattgctgctgaagcatatgacccacggtttggccctaagttgagcggtagtcttccagatggcgacgcatttgatgccgaaacatttgacaaattgtattccaatgccggcatcgcaaagttgtatggttgttgcctcccagatgacgactcaattgatgctgaaacatttagtgcaatgccgaagtgaaaaagtataggtgtgtagcaggggtgggacaactctcgcctctcgtctctcgcctctcgccaactctcgccatttttggtactctcgcctctcgtctctcgcctctcgttttttgggacgagaggcgagagttgaaaatacacccctaaagattgaacttttgagcagccagaaaaattttcaaatttacgcgaaaaaaaaatcttaaatctctttctttccttccttaatgttttctctatttttggatagctccaaaatttaaaaaacaagttttggtcattttttgaataaaatctgttaacaaatccgaagacaattttcaaaattttttc

SEQ ID NO: 29665 - DNA, 1057 bp, Heterodera glycines
taaggaagcggggggtggggggtgttcgatgctttcatcaactctttacgaactcaattgtcggggcgggggaagtcggtttccggcgccgattctgaacagacggcgcggaagaggaaatggcggcgaagagaaacgaaaccatcgattgcttccgggggtgacttccgccacttttcttcctccgtgcgcccgacctggcaaatgcgtggcaaatcattcgtgcttattccgaatgtgtaaatgcttctcaacccgaccggcttctgccgttgttcggtgctttggtgccccccgcttcggcttctcctccgttcgtttcccttttgtttcgccccctttccattgtgctgcaccctttcagcgcggggtaatcgttcacagccacacaattggcaccagcagaagaagccgatgccatcaccaacgggctgcctgctcgggcaaattgcgacggaatatttgcactaccgccgctgcgacgtcgccctccaccggcgattgccatttggccgctgtcggctatttgtggacgctgctgcttggcggaaaagcccgagaccgaagcacgccgagaggccgcccctccgctgggataaagcacacgttcaaaagtctccaggacgagattcattggggaaaagcaatcccttcggaaaagtgggaaagggagggacaaaatcggacagaaaacaagcggaaaagggacagagagaagacaacaaaggccggaaaagcagcaggtgggcggagcaattggaattgtgccgggggagagagagcacttttgggaatgaatgaatgaattatttaaataggtaaaagggaaaaggggaggagacaatggaaaacaatggaggaaagaaaagaaaggtaaacgaagtgaaaaggtaacaagggtaaaaaaaaaagggaaggacccaaaaaagggcgaaaagtgacggcaaaaaataaagaaaagcgaatattaaaaggtcagtggtgaaggggggggggaagtgataacaaacaaatttatgaaacactcccccggcgctttttcactttctttcctccg

SEQ ID NO: 29666 - DNA, 760 bp, Heterodera glycines
  misc_feature (111)..(111): n is a, c, g, or t
  misc_feature (115)..(115): n is a, c, g, or t
  misc_feature (123)..(123): n is a, c, g, or t
  misc_feature (173)..(173): n is a, c, g, or t
  misc_feature (179)..(179): n is a, c, g, or t
  misc_feature (210)..(210): n is a, c, g, or t
  misc_feature (215)..(215): n is a, c, g, or t
  misc_feature (223)..(223): n is a, c, g, or t
  misc_feature (271)..(271): n is a, c, g, or t
  misc_feature (442)..(442): n is a, c, g, or t
  misc_feature (455)..(455): n is a, c, g, or t
  misc_feature (465)..(465): n is a, c, g, or t
cgcagaattaaattataggctatagggaagctattccccttgaattcgcgactccccataaaacagggcgcagcggcccccttggaccgccccgaaaacaaaaaaaacganaagngcaagggnccgaacggggaacacaaacagaaaaggggagcaaaaagccaacgcagaangaaagnacagaccagagggaagcgagacccgaaggangcggncaccccanaaacccgggcgcagacggacggggggacagccccgaaaacaaaaaaancgaacaacacaagagaccgaaagggggacgcaaacaaagaaggggagcaaaaaaccaacgcagaagcaaagaacagacgaaagggaagaagagccggaaggaagcgggcgccccacaaagcagggcgcagcggcgcggggggacagccccgaaaacaaaaaaaacgacggnaacaagagaccgnggggggaacncaaacaaacacggggagcaaaaacacaacgcagaaagaaaggacagacgacagggaagcgaaacccgaaggaggcggccaccccacaaaacagggcgcagcggaacgggggaacggccccgaaaacaaaaaaagcgacaacgacaagggcgcgcaagggggacacaaacaccgagggggagcaaaaagccaacgcagaaaacaagcacagacgagagggaagcgaatcccgaaggagacggccaccccacaaaaccgggcgcaacggagcggggggacagccccgaaaacaaaaa

SEQ ID NO: 29667 - DNA, 1893 bp, Heterodera glycines
  misc_feature (98)..(98): n is a, c, g, or t
  misc_feature (216)..(216): n is a, c, g, or t
  misc_feature (240)..(240): n is a, c, g, or t
  misc_feature (243)..(243): n is a, c, g, or t
  misc_feature (273)..(273): n is a, c, g, or t
  misc_feature (286)..(286): n is a, c, g, or t
  misc_feature (311)..(311): n is a, c, g, or t
  misc_feature (322)..(322): n is a, c, g, or t
  misc_feature (328)..(328): n is a, c, g, or t
  misc_feature (359)..(359): n is a, c, g, or t
  misc_feature (365)..(365): n is a, c, g, or t
  misc_feature (414)..(415): n is a, c, g, or t
  misc_feature (428)..(428): n is a, c, g, or t
  misc_feature (435)..(435): n is a, c, g, or t
  misc_feature (452)..(452): n is a, c, g, or t
  misc_feature (458)..(458): n is a, c, g, or t
  misc_feature (463)..(463): n is a, c, g, or t
  misc_feature (481)..(481): n is a, c, g, or t
  misc_feature (483)..(483): n is a, c, g, or t
  misc_feature (487)..(488): n is a, c, g, or t
  misc_feature (490)..(490): n is a, c, g, or t
  misc_feature (504)..(504): n is a, c, g, or t
  misc_feature (515)..(516): n is a, c, g, or t
  misc_feature (518)..(518): n is a, c, g, or t
  misc_feature (522)..(522): n is a, c, g, or t
  misc_feature (535)..(536): n is a, c, g, or t
  misc_feature (542)..(542): n is a, c, g, or t
  misc_feature (547)..(548): n is a, c, g, or t
  misc_feature (555)..(555): n is a, c, g, or t
  misc_feature (563)..(564): n is a, c, g, or t
  misc_feature (567)..(568): n is a, c, g, or t
  misc_feature (599)..(599): n is a, c, g, or t
tgtgatattgttgaatattcggacgatgaaggttgaccgagatacagggacaaggaggaccccgccttggaaccaagacgagcaacacaagcaccagncgacggcgagcccaaaaaagaacaaaccggaacacaaccaaacgcaaaggacgacgagcacggcgaggacaaaacaacaggaacccacgagagaagcggagagccaaggcggggaaanccggaacacggacacggacagcangcnaggcgagcacgacagggaaggggagccgancacgacggggaanagacagggacagaagagcgaggagnacgggggcgangagaangaagaagagaggcgcggaggagcgaagcagnacgcgncgaagacgaaaaacaagcagacgggggagaccgaacagcgcacgaaaanncgggggaacacanccgacgnggacaacaggaaaacancgcacnacganacgaacagggagacgganangaannangggaaaggggaggnagacccggcanncnacgncaacaaaaaggannacgggnacganngaaaaangaagagcnncannaagaaaccaagaggcaggccaacgagggacncgaaagtgggtgacgagggagaagtacaaaatgtacaggccggtctgtcagaagggtatcatcgatgaggagcttaatgtgatgccatttggattttgttaattttgtattttatttttgttttttgttaaataaagttgaataaaaattaaagtgatattaggactagcgggggtggaacggtctaacgtgaaggcccactgctgttagccgtaatatttttataaaaaatccaaaagttcaaggggaaaatagcatctatgaccgttattctggtacatagttatacatgggagttgagggaattgtagtttgaccctgtgtcttgaatagaggtgctgctcgacagtaaccccgaggaaacctcggtaggcaaaaagcctattggaacctctaaatgcgatgtcatccggtgagataaactgattgtgcctaaggtgtctcgttataagggcgtgtcttctcaaaaatttctaattttgtttcttccgcagtcgtagaatttcagatagctcgtgaggttcgcattcgttaaaatcgcatagaatttcaatgagagaattcattttgagcaccagtaggcattttcatattcgttgcaaatccttatataccgttacctcaccgccgtatgatgaatttttaccttttctctttatttttaaaattctgagaactgaaatacagatgatgaccactaccaaatcgataattgacaaaaaatatacccaaatatttgaacttgaaactttaattttctcaaattctttgaacacgacaaaattaaagaattcactatttgtgtctgccacatatttgggaagtatttcgtttgagtcaaatcgatctttgtatattttcttctctttaattagataaatttgtccctcaattattagtaagtcggtaaatgatgatggcatagatccgatcggtttagtaataatttcggtgccattatgatgtgtccataaattctctattgtactaatgttaatctcgtctattcgatcgtctctgattacaaaaagtcgaccatcaatatgatcaaatctaaggtccccactgggaaaattcctaacaaccttttcttgactccctcttgttatcgaagtttcatttgtattttcgttttggaaaattaaataactatgatcggtgcaataaaaacacgctcggggctttaattgtcgaaaatcctgataaagcttaacatttgttggtccgcctcttttctattgaattagtttctatggattgatacactccaaccctgaaatacgattcctattta

SEQ ID NO: 29668 - DNA, 1573 bp, Heterodera glycines
ttgttgttgctgtgtgttttgctgttgttgttagtgccatgcttctgcttttgttgctgctggtattgactaacaatggcggcggacgcggtcaaatggcgccaaattcggttgaaatttgttccactatttaatataaaaataaataaaatgaaataatgatttttaataattaaaaaaaaaaattttacaaactttacacatgctccataaaaataataaaatccaaaaaaattcgttaaaaaattgtttttttttatatccgccctcgtatgaaatgaagaataaaaaaaattgccatcccatccccaaacatatcccatgaaatcgagcgccatgagtttacatataaatactctctccaaaggcatttaattttaattaaaaaaacaacaacaatcagctgatcaatcagtgatctgcatagagaaagaatacttacggcgatatgctgcccaactgctgttggtgcatgaacgatggccgcttgacggcgtcctcaagcagcaagtcttggcgttcagcggagcactggtgcatcaacgaatggatggaacgacgagcccacatggaccgaccagcatcagcagcagcgaacagcttgaggatggtgatcagtagggacgtgaattttagtgaagaaaaacttgcacaaattgccaagcggaattttctaactcagctcattgttttcagaagagtttgaaattttgcattaaaatactttggtataaggtctagcagcttgccaaattttagaattttttatgcactcagagatttttaataaaatccgctttttccagcctgaacgccaactttgtggtcaagttttgaaaacaggcagttttttgtaaaaaagttttaacaatattaaaaattctgaaatttaccatagtgctaggtctcatgccaacgtattttcatgcaaaatttcaagctattctgagaacgctgaaccgaattacaaaaatcaacatgagcaaaattcaaacttttattcactaaaattcacgtccctattcataagagaaggcaaattttgaatgagaatttaatcattttttcaactatattttttgaattttatataaaattaattatcaatgataataggttttaatttaaaaaaaatatatttgcgaaatttaacgagataactaagaaagaatcctaaaaaataattaattattctttttctttaaataaaactagtaaaaagttaaaataatttaattaaagtagatgttaaaatttaaaaaaaaattagttttatttattaattagtcgtgccgatttttttggagaacaatcactgggatggtctgaagaattacgtctgtttttttaatcgttggaggaaattctgcattgactgcgagtgcttttttgacaaggatatttaccatacatttgagtgccggcaaggtgttattactgcaacagagtgggcggatttccgtgccaaaaggagagtggagtgaagattgagtgcccgctgtgtcgacgttacttttataattgggaatgctacaactatcatatggggcacccagacttgcaaattgtggag

SEQ ID NO: 29669 - DNA, 2306 bp, Heterodera glycines
  misc_feature (14)..(14): n is a, c, g, or t
  misc_feature (35)..(35): n is a, c, g, or t
gcaggtcgaaaacnttgttaatcaattagtattantttagcaacaaatccacatgtgaatatttcatatttataaaataaaattattcaatttattcattaattatttaaaataagtgaagtgaccgagtggggcaatcttctaggctttataatttttacaaaattttatcacaaaaatttaccttattcttaaactttttaataaattataaagaaatataaaaaattatcaaactttttttttgaaattcacttttttatgttatttattcttaaataaattttaattacttttagttagtttatttatattatgtgttgaatattatctttctctaaatagttccaatctttttactgttgttccaattattgattaatatatgttgattcgatttttattttatatcatttttaacaagcaatttagaaagtgcaatgaaattaaaagatattgttattttgttattgcatatgcggtatccatgaatatttagaagagaatggaccgcaacggatacggtaccggatttttctggattagaatccggtccggtgatttttttgaaaatagggattagtgttttttataatattgatttcaaaaaaaatttcattaatatgaattgtaatttttaattaaaaatgatatatttttacattaatttgaataattctctgcttttttactaattaaacagtttaatttggaataacaatatttaagaatgatgatgtttttcttctgaattttgtacccattaatattaacttaatattaatgtataaattaaacttttttatttatatttataaatgataattgttaagattgaataattgttttcattaaattttgccataatagtaagaatgcttaaaaataaggaatttaataatataaatatatatttgtcttccaaaatacatagaaaatatttttttatacaaattaaattaattcatttcattatataatggaagaaattattgctagttgtgctttaaaaattaatttaattgagtattaggattaataaaaataagattatattaatacttgaacaccaatctagtgcagtatgagtgttgacgaatgtatgtgacattaaatcagactatttgttctctgaacattgcaaccattttttatataaaataaaccttaaagccatatttatataattgttctttttttaattaatttaagatggaaatacatttgcgattagaaatcaagaataattaaatatttaaaaaataaatcgttaataaaacccaaacaaaattgtatatatttaaatttttcattatttatcggttaatttaattgatttcctattcacattcgacttgtccttcatctatttaaatatattttaattttattaaataaagttcatatttctttttttcatttgttctttatgaatttttaattacttattttgtacaattttttccatgcaatattcccgttattgggttcatttcttgtgctgcctgcacccaataattttttatagataattaatttaaaataatttttatgtttttaaatatttgaattaataaataatttatttgctaaatattcaaaaattccagttttgttttttgtttttagtttctattgtataaaaagtttggtaaaattctaaaaattttattacatttttaattttcaaagaaactaatcagtcaaaaatccaatcctgaaaagattttggtgctaggtcgtttcttaaatccgctaaggggtaggaaaacaaaaaattttttgtccaggtaaatcttgactcagaatttctggtacataaatttttttcaattttgtaagaaattttaaaattatattctgatatcacctttccaagaactctagaaaaaattacgtgaaaattatttgagtaaaaatttttattcaaataattgtttttaaagcactacaaattgaattttaaaaaaataatattaaaaatattataatatagcttatttcgatcgcagttgaacgtcaataaattgaattttttcatcgtgaagtcgagaaaattcaagaaattaaatatctcaaatttaaaaaaataataaaaaaaattcaaagaacattttataactaaaaccataatttaatcaaagacaatttttaaaaaaatctattaattaataaaaacagaaatctaattaaaaacaaaagcataaatttaataactttcaaattcaatattcctaacattaatttattcagccgaacaaagaaagaagcaaataaaatatcctgataaagtaaatttagataaa

SEQ ID NO: 29670 - DNA, 821 bp, Heterodera glycines
  misc_feature (812)..(812): n is a, c, g, or t
aaaaaattttttttagtgttttaggagcattcccccagaatctgatgcgaacagatttatgaggagacggaatcattcgggaatagcttccctataacctgtactttaattgtgcgttggattttttgctccccatattgtttggagtacccaaaccgatcacttgaaaaaatcgatttttttgttttcggggcagtccccccgaaccgacgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctcccccaataattgtttgagtaccccnaaacggaca

SEQ ID NO: 29671 - DNA, 1689 bp, Heterodera glycines
  misc_feature (1620)..(1620): n is a, c, g, or t
  misc_feature (1629)..(1629): n is a, c, g, or t
  misc_feature (1642)..(1643): n is a, c, g, or t
cgtggcttgcaacgcacgaaaaacatgtttcgttggggtgttgctaagctacttttcgagttatcagcacctattttctaggtttttatttttagcacctaaaaaacctaaaaaaattttaaaaaacttattttcacctattttggtgttttgcccaaaatttgttaacaaaaatgcaataaaaaagaaaaatacacccctaagaaccgacccaaaattttttttcaaaaaatacatccctaagaatcgaccagaaaattttcaaaaatgcgcccctaagaaatgaaaaatttctcaaaaatttatctccaaaatttatttattttattttcttgtcgatagtttttgattttgaaaattatgtatatccttaatgacttgacaaaatatttttgcttttaaaagaaaattttcgattttagacccctaaattcggaactttttgtcacctattttcccatttttagcacctattttgcgggttttttagaacctaaaacctacctattttgccagtttttagcacctaaaaatatcatccctagttataaataaataaattacccatattttcggcaaatatttgaatttctcctgctgatggtcttggcgtactgtttttgttcagagaattcacttcaccgtcaaccaaaaacaaaggcactgctgctgatggggtgacggcattggcatttcggcaatacattctccttattgacacgaggaaaagcagcaaactgtgaaattatcagccaattaaaaaattccccttttttgaatataaaaaagttttaataattttggttttgagaaaaatccttgcgaataaaatatgtaagaaaaatttccaacaccctgcctgatccaaaggtaaaacaccaaatttacttgaattcgagcctctgtggggatctatttttcagttccttcaaaatggggcttttatttctgggaccgggctttatgggtttaaatcccgttacttatctcggcctgatgccaatccagatcccgactttttcaaaattctgggctctataaatcagaatgtacataaaatattcaattacctgaacaaattaagcgattgtcgttcaagcatttgaaaagccattttttaattgaaagattgatgaaatgaacactaatttttaatttctttttaattattattattactgtatgtaaatgtaaaatggggaaagtgtttcaatgggttttgcagcagattatgggaatataataatccaattgaagatgaagcaacaacaaacaaagatgaaacaagtggtcaaacaagtggcataacataaatgtgtgtgtacacataccttagttgatcaagttacgcctccggaaatgtaaaactggattatcagatatgggaattttttggagatctacatacctaattaggtaaaataaatacagtctattaatcaaaaaatttttttaaagcacttcacctatttcaactagcccaatcaagctgagttttttttaccaatcataccttccacataaacatttagaacacacaaaaaatctgatagtttagaagatacaaaaaattctagtatgaattttatagatttagttggtctgtaaaaaatgttttgngcattttanatttagaacatannattttttgttctcctctcatatttttgtatgtttcttaacatttat

SEQ ID NO: 29672 - DNA, 936 bp, Heterodera glycines
ggaaacactgggacaattccaacgacttcataagcactgactcatcagcagagactgtgagtgatgagctcgacgagttcaagccgccttccggcgaacggaaacggcccgtgccgaatggaatggaacgcccgcgacgactcgtcggcattcgacgatccgttgacacaactcaacagctccaattgaggaaaagcacaaggaagaaatcgctgttgccgaaaagcactgcaacaacacaaaatgagtttctgaacggaagaaagcattcgtcggtcattgaagaaaggacaacaggaaggccgacgagtaactgcaacacaaccaccacagcaaaacgaacggcgagaaggccagcgagagacgacagcaacagcagcattggctcatcatcttctgcattgtcatccctgtcgtccgcaattggactggcagaggcggcggatgacccaccaggggccagcagtggaagaagagtgcttttttcgcctgttcgtagagggcggagggcgggtcatccgcgtggtggcggagggcgtctttcatcactccaaacaacggcatctgccgacaaaatcaatgatgacaacgacgcaccggcgctgagattgagcaccaccggcagagcaacaacaattgggagccgcaggagagggggaggaggcatggcaagacggagcagaggcggacccatcactttggaaacagtggcgatgggaaacgatgtgccctctgaaactgagcaaatggaagggaagggagggcgagcagtacgacgccaacagcgaagcagaggaggaagaagaggagggggcgggagacagcgccgagttgggggacatgtcggaagaggcagcagcagaacgacgcaagaggggcacaatcagacgatgaaatagacaggagaatcatcggtgtcagaaaaagaggacaacg

SEQ ID NO: 29673 - DNA, 1861 bp, Heterodera glycines
agatgtgtaccaataaatagagaatgccagagaaaaacattatctttttttctctaattttttgtctccttttggcgtactatctaatatttttgttattaggaaaaacaacatttatttcgtgacgtttaacttttttcctgcacgttaaatacacaccaaattttgcatgtcgatagagaaaaaaattctgcatcgattcatctgttattttttgattctatctgttagtttatgaattatttagtcattaataacaaattatccaattatagctttcatggataatataaagcaaaatttgcgaactaaaaacgcacgacaacaacgttgggacaaggccaagcgagaggagagaaaagcgcagacgcagagggcgacagaagcacggctggccaagaaaagtgagttttttcatcaattttaactcaaaaaaatcattttttgaatttcagccgctccactgccgaatcccaatgccgaagtgccacagcaggacgaagcagggccgtcaacatctgctgcaccgacagaagaagcgatggagccgcctccaccaactccaggaccagtgccaacgccagaaatggacgaggaaattttggaattcgacgacccgccgccgtcgacacctgccacaccaattggcgatttggtgccgtttccgtcaacaccaactgcgccaatggacaccggagagacgaccccgccaccgctggccattgacgagcgatcagagcgcatcgaacagctggaaaagcaactgaaggaccgggatgacaccattcaatttctgcgcgagcaggtgcgcaatcgagaagcgctgatcagtgatctgcgtcggcagctggacgagcacattgtaccaccgatggcaccaccaacgaccagcaaaagtgagtgaaaatctcacattttaattttaaaaaaccttcatttttcatttaaatttcaaaaaacccatttcattgaattttagcgcctccaaacagaggaagaccgagaaaaggggtggatgaactccagcgcagcgccaggcgcgacatcgtcgacgcaattgtgggcgtcatcgatcgtgatcgctcgcgttccgcgagccgcgcatcgctggatcggatccatcgggatatccggcacaaattcgcgcactacacgccaaagaagggccaggagcggaaggagtggatggaagctgaggatgggctcctgctgcttgcccagcttgggacacagatggcttacagacggatgcaggcgactctgagcctcatcagcaggcgctttgacaccttcagcctcattgataaaaggtacagattatcaggaattcagtcatcgcgacatacttttttctgggtgatcatcatcaaatatcccccccccccccctcccgcccccctctctaaataaatgccccctttttgagatggattgaaatattttaagggatattagggatttgccagagtctcggttctcgactcaaaccaaattaacatgacttaccacattttttgtttaaattaaagggaattaataaataaattgaataaaataaaattttaaaaaatttgttaggaaaatcttaaaatttattcttaaattaattattttattctattttttaattgaataagattttttaaaagtcttagtcattgagaaatttcgagttttttggggggtctaagtttctcgattccctggaccataaatcaattttatgtagagaaaaagaaaaattcagaaaaaaggaatacagtagtcatacagtaaataataaattgttttctgtattcaaaacaaaaattttatgatcgaaaatttctaagtatctaaaaattttgttgacccggataaa

SEQ ID NO: 29674 - DNA, 967 bp, Heterodera glycines
accgtttctataaagctagagacatatgcgctaaccataaaaaagatgaatcattttttgaaaaatttatatagttcgactaaatttgcaaatcgatttatggtgtacaggatgtttgtcgaaacataactcgtcaggcctttaagatagacctgccattgctattcctgcaaatatggagtctagtcagcccaatcgattgctattcgaatggtttggggtcgttggcccaaacaaaagttgtgctgcttcttgcaaagaagactaagccaattgtaaacagcaagccatccaaatgcttcaatgtaaaaaaaaattacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcaaaataataatctatagaaattctcaaaaaagtagttcctcgcagattcggggaccgtttctataaagctagagacatatgcgctaaccataaaaaagatgaatcattttttgaaaaatttatatagttcgactaaatttgcaaatcgatttatggtgtacaggatgtttgtcgaaacataactcgtcaggcctttaagatagacctgccattgctattcctgcaaatatggagtctagtcagcccaatcgattgctattcgaatggtttggggtcgttggcccaaacaaaagttgtgctgcttcttgcaaagaagacttagccaactgtaaacagcaagccatccaaatgcttcaatgtaaaaaaaaattacatttggatgcaacctttatttttcctcgcctctcttttcgaaaaaaaaagctattagcaagcgtgtttggacaattctaaaacaaatcggggtaattaatttaatctgactttataagataaat

SEQ ID NO: 29675 - DNA, 1297 bp, Heterodera glycines
  misc_feature (1268)..(1268): n is a, c, g, or t
  misc_feature (1280)..(1280): n is a, c, g, or t
tttttttttaaattaaaacaaaaaaaattatgatttttttgcaataaaaatttcttagaaaagcgtttacacgtattatttttaaaaattcaattttttaatttatctttttccaaaaaatcgacttttaagagtatatttcaaattttttatcaaaaatcctaaatggtccaaaaatttatttagaaaattgagaagccagaaaaaaaatatatgtatttactttacatgaaaattaaaatccctattaattatgctatgggtatgtcctccacctgctgctgctgttgttgttgttgtgctcacaaatatttgctggttatagaccggctcaaattggttgttgttgctgcccttccgttgtcgcatttgtcttgcttgtgactggtctcgtgaggtgggcattgaagcagcaacctcttccattggtcgattttcattgtcatcataactttttgcccgttttccatctcggcctgggagcaatcggactgggcctaaattaaattgggtttccatatttggtggttttattttcagctctcccttccaccccccatcgaaaggaggggctcccggaaaatgctaaatgcgtcagtaatacagtattttcatataaaatactgtgtatcaagtaataatactaccgtttatcattttcaagaagtcctgattcactgttcaacttgcgaattttccactgacccattttctggtcacggaaaggagtggtcttttataccggactgattgtgaggggtggggagaaaatttaaaaggaagggctcagtgctttgggagatacggtatcgaaatgcctttccaaaaagtacttacgggttcgatcagagcctaattttgtagtgaggattaggaatccggattattttagaaaatttgctaaaattaagataaatttttatttacctgccagtctggcacggacttgctcaaaaaaggatcgctctcgcttttttggcgctgctttgcgatcgcgttctttagaatgaatgaaaaatgttttgttgcggtatttaatgttaatgaatttattaatcaatttctatgataaaataattattgaatttattagggatgtgcgagaaatgattttaccgagaatcgagaaccaagaccgagaccgggaatttttgtcattttggtctccatttttcaaataaatgataaaatgtgggtccggtggtgccgttaggcgccgccgaggaaaattttgagaattttaatgccatttgttactaaaattgctntaaatttcaaanaatttgctgaaattttt

SEQ ID NO: 29676 - DNA, 904 bp, Heterodera glycines
aaaaatctttttttttttttcggggcatcccccccgacccgatgcgcccagatttatggggaggccgaatctttcgggaatagcttccctataccctgtactataattgtgcgtgggatttttgctccccataattgttggagtcccccaagcgcacactagaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtcccccaagcggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccctgaccctgaaggccagatttatggggagaccgaatccttcgggaata

SEQ ID NO: 29677 - DNA, 1225 bp, Heterodera glycines
  misc_feature (20)..(20): n is a, c, g, or t
gtcgaacttggcgggtcctngaagaagttttgagcaatcctctcaatgcctttttcctgtacttaatgacttaccaattcgttttgtctcatttcgctgatgtcaatgttctgtgaaatgaaacggtcataccgtattgtcctattacagtatcatccaccctttcgaggtcatccaccaaattggcgtccatataaacacattgggcacagtacgaacggtccgaatcggtgacgaacaacggatggatctgttatgagtaattaataaacccatccatccacaatttaattcctaattgtaagttcagtttcgatgggtcgcctcattacctgcacagatagacagatgcgatacattgttcctgccgggttttccttggcgttttgtccgttttaaattcaaagtttcccttttctcaccagtctttccctggtcattccgcagtcgttgtgtgggaatgcgattctgttctgatttcggaccctaaactcttcccaattccaattccttctctccccccctcctctcacatgcatttggccgtttcgtgaaagtcttgcgcgtaaatatgcgaaggattggcactcgaagttcgtatctttaataattgcaattaatttaatttatttttcgctaattaaatttacatttaatttgattttaatttccttcccattttcccaccttgaccacaatattttcctgctcacagcttacaattggcgtgtcaattatttcatttgggtattttgagccgtcggcaccgtaacacagaacacagtagccgaggaacagtaccgtacaccggcacatgagcattaatggaactttagtgttgggtatgggaggcattcggccgatactttggctggcgattgatttggtaatgcttttgtggcgcaattaaatgccaaaacaaattatgggcggtaagaaaatgaggggaaagggagggacaaagggaggcggggagggaaagtgagcagcatcatcatcattatttaagaaaaagagtatttcttttcttggggaaaaaaaatccccggaaaaaaaaaaaaaaaaaaggggggccgggaccccccttttttgttcccccttttttttgtgaaaacgaaaaaaagaaaaaggggttttccaaaaaagggggggcgccccttccccccccccgcgaaaaaaaaaaccaccccccccccggggggggggggggggggggggggggggg

SEQ ID NO: 29678 - DNA, 1567 bp, Heterodera glycines
gggctcaaattttggagggttttagttccaactttgttggtttttgaggctcttttgtggggggtaggacccggttggggtttcaatttttgctttccccgaaggggggagcgggattgggggaggtgaaggagggtaataaacccgttattttttgcggtccgaatcatcatatgcttcgtccttttttaattttcttctgatggcaattctgtgctgagcagcagtgtccatctgctcaattttgatgttggtatggccccacaggcaaagtccccatagtatggggatggtgttgacagcgctaacccactctccaacatgtactcatcatctgtatcactttccggtaagggggcagcagctgcttccgcaagaggtcccgcacaaccggccgccgtcgttgtatatcgtgtcgccttttctcccactgctccaaacgaccatttctccgagaagccctagtcggtctgggaggacgttgcgggcgaggcggaggacttcctggtggggacggagcgcgacccggaggacttggttggcgccgaggacgtcttccaggtggtggtggtggtggtggtgggggaggccgaggtggtgtgtccacaacttcaccctcttcatcttcagcacctctcctcaacagcacgcttatccctttggtgagctcaactttggccggtctgtctgctagctctcgccgcatttttaaatatcgcctaagctgctggttgtagttgacattttttcgagagggatgtgctcgttcggcccgggcacggttcaaatcgtgtcgaacagcatccaagtttaaatcgcccgtgtccgtcgcagtggtgagaccccgataaatttcttgaggaacaagtagaaatttatttgccatgaataatgaatgattggtgcatgaaaattacaacaatgatgaggggggtatttatgcatttttgctcacaacattctttgccaattcaaccaaaacgggtgttaaaagagcagcgaacaatccgccaaatcctgcgcctttctggacaagcacgcgcctggcgccccgctcacttctcgctctgctcattcggcgtacagtgttcacatggggcattaatcgctttttctgtcgggttgtaagtcggaagcgcgaagcgacgagattcaaacaaatttcaacaagtgagagcagctgttcggtgcttgccattcgaatcagctttttacattttttggcggatttcgttctggccagtgcacagagccaatgcgcattttcttttatcagttgtccaacccttacttgttgttgttgttgttgttgcttatgccgctccatttttaggaatgaacacaactgtcccttcatcttcctcctgctcatccttaaatatatttgtgcgaagccgtaacgatgggtccgatgctgcatgcatgtcgatcaacagataaccatagggccgggcggtcgccttacggtaggcgtcaagaaaaaagtcaagctgacgcggaaagagctgcacgcccatgttgcggatgcacagcagtgaatttggggcacgcatcagtaccaagtact

SEQ ID NO: 29679 - DNA, 1233 bp, Heterodera glycines
  misc_feature (1167)..(1167): n is a, c, g, or t
tagatattcgataaacttatagcaagatttcctatttttaaattccgaaattccagccgtctctcctctgatggaataccaattgagtctctttatccatatacgagtggcaaaacaggtcagggactcaatttttgcccataatgctggactctgatttagtttcgtaaaatctggcaaaaccattctttggacaaaaaattgcaataaattgaataataaattcaatttttgcattctttattatgtattagccgaattattcactactctttaatttccaaaatttataaatcgaaaaaaataaaattcgtatctataaacatacaaaaatgcctaatttgagtgcctttttgcaaacttagtcaatttactttgggtgatcagtccataaaacaggtgtgcccggtgaatgcggagctgcaggcgtgacggcgctcgtccggacgaagcggcaggggctcttatacaaaccaatggtggggcagttcggctttgtttatgggttggaagcacagatggcttatttgacgactcaccgactgccaatagccgcgcgtatgttttttaagagacgcaaaaaccattaataccaaacctgaggggtattttctaatttttataaaattaaattttttaattttgataacttttatttattttttatttttggggtcgatcatttagcagtgactatttaaagataatactgggactttttttagttaaaaaaccttatcagcgcaaaatgtggtaatgttaaatttagggttgctcctcgacccctcggcgggggggggcaaaatgtcgggggccggggacctcgggggcgacatgtcggggcggggaggagctcaattgtcggggcggggaggagctcaattgtcggggcgtggaggagctcaattgtcgggggtcggggcggggaggagctcaattgtcgggggtcggggaccccgatcggggaatgaccaaattttattttaacccaaaaaaaattttctttttaaatgttcgtaaatgttcgttttttcactttaatcatctgatttcgttagcgccagtaagagtgagtccatgctggcgcctttaaacctgagcttccatttgttcttatttataagaatgttctgattcccagcgactaaaattattctaatttcttanatatacttatagtttaaaattttatggcataatgtcactatttttataaagaaattttaaggtctg

SEQ ID NO: 29680 - DNA, 1218 bp, Heterodera glycines
tgttgtgatcatatttgtatcccattgttcggttatgcgtatgtatttgtacaatggaatgtatgttcttatatgtactctgtatgtacagtatgtataatactcgtcagtaaaatactctccttgttctatgcagtttctgaactttattgcgagaaaatcataatttacatgtcccaaaaaaattatatgttcatgtccattggtttttatgcgtcccatggaattttagtttaagttatgatagtgagcggaccgccactaacggacaactgttaacagaccgaagtcgggtcggcgtcccgcttattactcagatcgctaacagctctgtccgttaacgttcccagttaccgatcaaaatcacttaagaccagctccattaagaacaatttattggggtttctgggtcgctgatcacgaaattttagacatctattttgtgtgggaagaacacgtaaatttttgaagagcatccaaacatttattacatataaaagcatccaaacattatacattaactaattgcaccatcaaaaaattagatgtttatgccgactcggcagaatccttcttcttcgattcctcaattttcttcttttgcactgcttcggtaacaagtggcacaagtttgccttcacgggccaggcatttcaacagcttgacaagaaatggcatgtaattgtgccggcgccgattaacctgatgaaaagggaaatgatcaatcaaaatcatatgtggggggggggaggagaatctaagtaaatttgtgatctgaaggtgccactggagaaaatggaaacggagttgtcttgattttattttttaacgaaaattgtataagttttgaaatttatcccaactccctctttttcattcagtgagtcaccctttgtcactcgttttgttttcctgtccacctcaattttgtagttcctcaacttttcctcctcgccactgatcatcatgtgcagttcattcagttcttttgtcacttcttccgagtccatcccggcctaaaaaattaattaatatggtcagttttttctattttgcgcctaaaaacacgagtgaattgtataaaaaatcaggaactgaaaaccctttttgccaatgccgcacgggaaatttaaatttttaatgaaattagaacatcgacataaattttcaaaaaggacccaaaggaccgaattcagctcggcaacccgctgctcatat

SEQ ID NO: 29681 - DNA, 1575 bp, Heterodera glycines
gttttaaagcttcatcagtttttgtttgcacttcttcactgtttccatcgtttttgtaactatttaaaatgcttattaattaattaattaattatttaattttaattatttccttactcttttcccgcttcgttttcctttttctgttttatttttttctttctgtttttcttttttgttgcttttcctttttcttcttccacccattgctcttcttttgcttcgttttctcttttacaaattcgtaaaatttcatccgttctttcatttccaaatgtttttatcaattgctcagttcccaatccttaattaattaattaattatatttttttaatccattatatttattaacctttcattaatttaattttcagcgcttcatttgaaataattaatgtttttaatgtttcaaaacgtaaatttataaatgaaaaagttccttttatccttccaaacttcataaatttctgcatcaattttaaaaattcctccagtttcattggcgtttcgttcagatcgctttcgaacatttggtcatacaattcaaaaaataaatatttttgcgtttcccaaaattcactaaatgtttcttcaaaatattgtttaattggcacttcattttcccctcccgcctctttttgctgctcattttgcactttttcttcttcctctctctctttttcctcctttaatataattgtctccacaattgtgacccaaaaaatgatgtctaactttagccattcggcacaccgtttttcggcatttccatcaaacaaagcgacctcataaaattcgaccaccggcgcatagaaaaatgcttaaattggacaaagattaattcccaatttactggcttttttaatgttaatgacctctttcaaagtatctttgagttctgaacattgccatgatttggtcggcgtttgccctctcttctgccgtcgtccctttggcactttcgtcgcttagcaatttccgaatccgcgccttcgcccctttgagctcgttaaatgagctcacatacacttcttccgccaaaatcctcttcaaatagtcaaaatggactggtcgcatgcgcactttctgctgcgcaaatgccttttgaatttcgttttccgtttcgcattcgcttggccaccattcatcaatcgttcgcatttttaaatttctggccaactttttgtctttcattcgcttaattaattgctcaacgtaattaattgttctaatgagccgacaaacgtccgtccgttgagaaataaaacaaaaatcgttttccctttttatgttcgcaaaaaaatcatttgatatttcaatgatcaattttatgagtttatttctgacatttgttgaagtatccaaaaggggagcttcgttcagcattttaatgtaattttgcaattcctttattaaaaatgggcccataattcgtccctcgtaaatttgcgcatcgaaagaatcacttttgaagttcaactgactcatcagaagcaaagcgtaaaccgagtcgagaagaagttctcaaaaatgcagcgattaaattaaaaagatttaaaatgaatgggaattaa

SEQ ID NO: 29682 - DNA, 1510 bp, Heterodera glycines
  misc_feature (1333)..(1333): n is a, c, g, or t
  misc_feature (1463)..(1463): n is a, c, g, or t
  misc_feature (1466)..(1466): n is a, c, g, or t
tgctttatgctttttattaagcaaatcaaaattaaaaatgttttaatattttgagcaagatcagcaaattcaacccacatcaattggcctataaatatttaaaaagatttgtttatttgccagttaaaatgcgcatgtacaaaaagaacaaagaaataaataaagagatgtcagcagaatcgagcaagcaaaaagtgatgaaatgtgtgtaaagccataggaaaaagaattacgaggaaattgaatttaaattttgaggaatttacacagtcatggatcggattgaggggttaagttataggccattccattctctgtttttacaatacggtcgcctcccactttcctgtctctgccccccccccctcctcttctgtcttatgtcgccccattcatctgacaattgactgcaccaggtgtcccccttctcggccccctcggctggaggtcggcgttgtctgccactgctgtttcggcaccggcacttccccactgcccagctgggccggaccatcgtacatttctgtccaataggccttggaagaaaaaaaaacaatttcaactttttcagttgtgaaattccacttttcagccccatagcataaatgccgttcgaaaaattttatggagaatttctaagctgaaaaaattgttttttaattttctcgtggagggaaacgacggggagggggggaaataatgcgcccccaatttaaatggctcgaccaccttgacaaaggtttgattgacctccaactatttattaatgtattccccctccccataaaaaagcctcacatggtccatgttgagcagtgcctgcatgatttggatctgattggtggcctccgtcatgtacgcggtcccctgttgctgctgtttgtcctgcatggtctgcagccgcgagttggtgcccaccacagtcgggccgagcactttggccaaattggacaacggcatctgtgtgattgaaataaaaagtgttactgtaataaaaggtattcagttgctttatttatgaaatgaagagaatttaaaataaatttgaataatttaatgagcgatttttgcaattttttcacctgattttcgttggaatgcatcgccaccctttgccaatgcgcacacaaaaaggccaactgaaaagccacgacacaaattataaatttaaaaatggacaggcttcgtattgttgggacatgtagtgaaaggtcggagacgaaaataaatgtataaaatttgaaaaatttgcaagaaaatccatgcaattgcagcataaataattttgttaaacattgaattttttcaagatagcagtaaggaaattgtttanaaacccctttaaaagcaatattcgacttaaataattgacattttccagcatcgttccgtctttccccttgtttcaccaaacatttttagatgaaacccatgatgaaaatggacgagttatttcggacaanaanttggtttcagtgaaggccataagcaaagaaaagtttcactgatt

SEQ ID NO: 29683 - DNA, 1331 bp, Heterodera glycines
  misc_feature (1306)..(1306): n is a, c, g, or t
ataaatatacacttatgggttggcatatgcataagagtgcaccttcataaatatatacataggagaggcacatgcgtaaaacgtgcatattcacaaaatctatacatatgaaatggcatatgctgcataaaaatgtatattcataaatatacacttatgggatggtatatgcataagagtgcatcttcataaatatatacagaggagaggcacatgcgtaaaacgtgcatattcacaaaatctatacatatgaaatggcatatgctgcataaaaatgcatattcataaatataaataatacaccagccccttttaacaaaattggacatcactttgtcgaattcttcatcaaaaataaattgtctttgcactgccaaacatcaacgagaggtacagagctattagacctatgcctgacaaatgatcaccgactatcacttgaagccgaaactagggatagcttgataaattctgaccatgaatcgatctatctcaacctatctatctctctaataaaaaatccctgtacaaacatttctttccgtaaatttgattcaaaaaatactagtttaataaacgcattcctaacacacaatttagaaaatgtcacccaaacagaatataacatagaaaataaatacagtcgatttgttaaagaatctctaaacgggctaaacctttttgccccaaagataaacttcgaaaagaaacctaaatcagtcaattatcctaccgctcttaaagcatcaattaaagaaaaggcagctctttggaagaaactcaaaaaagaacctgaaaaatatcttcccctatataaatccatagcactccacatcaaaattcaaactaggaaattccaggaaaaacaggaaaaaaaattcttagaccaaaaccccggaaatatatataaatatattggaaaagattttcagcgttgggaaataccacccatctctcacaaccaacaaatcataactgatgacaaaactaaagctgacatttttgcaaaccatttttctgaatccttccaaaatttatcagaataccccaaacctcctccaataatttctgttaatcaaccttcaatttctgacgttcatttcaatgttttagatgttctcgaaattttaacccaccttccaaacaaaaataatacatctcctgacgatttaagttttaattttctgaaacgttttcatctaattttaaccagaccctctacagatttattccaattgtctctaaaatccgggtaactaccaaaattttggaaaacctcaattattctaccccactattaaaacgnagataagaatctagcatcaaacttc

SEQ ID NO: 29684 - DNA, 1428 bp, Heterodera glycines
  misc_feature (214)..(214): n is a, c, g, or t
agggatcacacatcagctcgtaaagaagccttcactttcattgcgccttggggtttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccncagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaagaaggacagcaaaccccagtctggaggctagcagcccaacgtacagcaacaaacgggtgaatgcagaccagatacgccagctctgtccgtttccacctcatcggtttcacgtcctctttaactctctcttcaaagtgctttgcaactttcccacacggtacttgttcgctatcggactcttggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccctagaggagctgcgattcagcgctggactcttcccagttcactcgccgttagtacgggaatcctcgttagtttcttttcctccgcttactgatatgcttaagttcagcgggtgttcacgtctgagttcaggtcgaaaaatcaaagcaggaatgccagtaatccaggcactccgccacagcatgcgaagcattggtgcgcccgagttacggtccgtaaaacgcgaattagaaccacaagttcgcgcctgcacaccaaaaccccacagccgagccgagcaagtaacgtaagaacacgtacaagtacatgatcccacgaagcaacgcacaagcagtgcattttatgttgttggcacaaaaagtaaagggggaaaaagaagacaaatcatccgatcaagggctaagtctcaacagatcgcagtgtaaaagctgctctactgctaacaaccccctgaccagtagtcaagtcgtatacaagtgattttgcgccccgacgttccaccatggcacacgagtgctacggctttggcaatgtgcgagcaattaagcacgcacatcgggccagatgctggggcatttgtgctgcaccgcaagcggcgcataagtagtgcctcccgacaccggggagcaagaatattgctatcttgccctagcgggattctgac

SEQ ID NO: 29685 - DNA, 1733 bp, Heterodera glycines
  misc_feature (72)..(72): n is a, c, g, or t
  misc_feature (1631)..(1631): n is a, c, g, or t
ttatttcattatatttgtgtaacagagatttgtcctttgaaagctgtttgtgcacagagcataaacgccccncaacaaagaccaaaatttgagggaagaggaaggctatgggggtctgctttaaagggtaatttaacttggtaacggtttccgattaattcaatggattggttaaatgtttgtaatacttctgactcagtttgagggggctcgggggaatccttaattccaattccttccaatgtaaagaagtcaggggagataaaattgtcgttaagttcttgagaggaaaaattaatcattttcacattcgaatgacaggaaggaaaattgggttttccggccactagagggcccaataaagtttggacgaaatggtatccggagggtaagcgttggactacggtaggctccatttcatagtaatagtcagcacccaaaagaataatgggactttttgattggaattttggaagaaattcggagtacgttaaaagagttggtgaataggctaaatatggggttgggcgagttaaaggatgcattgcattagcggttacaacgattgaacgaccgtcaataagccttaggccgaaattagtggtgtaagcggggaccgatctacaatttgtgctgttaaaaactcccaaattaatggacgaaggtacaagggaaagatttagaaattgtgcctcgttcaggggccttatgctcgtctcgcggtttagagctaaaccacggttaacggcgttaaccgtggttaagaatccttaaccggtatgctcgtccttccctttttaaccgtggttaaggctaaaccacggttgagttaaccgtggtttactccctccttaaccacggatttcaagcttaagcttctccatttccaaatccagtttggcactttctttttcaagcactttaatctgtaaatcgcgtgcagttgctgttgatgatgctgctggaaatatttccacaatttcttttctttcggcagacatgtaatcagcagcagcagaagcagtagaaaattttcgttttttgctactgatcacgccgcccgattgatgacgaatcggtgtcaaatctgtaaatgatggcggaacagcagcagcagaataagtctccgatccggagcaaaagcttgagtcgataattgcaggagatgatttggggcgttcccctatgccaatttataaattagaaaaatgtcaattgattgagatttaacctagttcaatagggttttcgccaatgatgccaacaattcgcgtgtcctccgccataaattgatcaaaaagatcaaaaaaaggcttccgctcagtcggtctcccaccaccagttggtggcatttttgtttcagcaatgaagtttttgtattgcttcagcatgtttctgtagcgttgcttaatttgctcttgatcacgcactgatcgagcgtcctaaatttacccatagaatattgcttaagtttagctctttttttcttacaacggcattcactgcttgtgtgacttcatcccacgcatttttcttttcctttgttgttaaagttgccgaaaaacttccttcgattatggattttcgagcaaaataagccgagattaacgcgttgtcttcttggggactanagagaattccccttttgcgatcaatgctttcatccatttaattttgtatgcaaaaaacaaatgtgtatttgtcaaaatatgtgaccgttcaataatgactct

SEQ ID NO: 29686 - DNA, 659 bp, Heterodera glycines
accagggatgggccaaattgaaaaataaaaagcgaaatgcgaaaagccaaaatatgcgaaaagcgaaatgcgaaaagcgaaattttttctacaactttttaatagttaaaatcataaagcaaaaatcattttttaaaattttattccaaatttaaaaatcaataaaacgcttttttgaggcgcgctttttccaaaaaaactttttgggaagagggggcaggcgccgccgggaaaatttttgaaaatttgattaaaatttgttgacagattttcactaaaaaatgatcaaattttgtgatttttatcatttttctaatgagaaataagagttttggggcgccgctgagaacagtttttcatcaaattaccaaattttgcgattttgggccattttctaagaaaaaaaataggagttttgggggcgcggcggtgccgatagacgccgccagggaaaaaaataattggaaattttgatcatttataaacaggttttcactgaaaattagccaatttataggtaaaatttttaaaaattttttgggaatttaatccaattcttaggggtgtaaaagtcgcttttcgcgccaaaaagcgaaatgcgaaatgcgaaacgccaaaaaatgcgaaaggcgaaatgcgaaacctaggcacatccctgc

SEQ ID NO: 29687 - DNA, 1045 bp, Heterodera glycines
ttgagtagatagactagaaaaaatgaaaatttgaaatcatgttccccctcccttctcccaggggtattattttgtaaagtcttttttccccaataaactgtcaaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccggtttgagtagattagactagaaaaaattgaaaattttgaaatcatgtttcccactcccttctcccaggggtattattttgtagtctttttttccccaataaacttttcaaaccccatttttcgcaccgtgaatggtatttttattgaattctgaaccggtttgagtaaattaaactaaaaaaaattgaaaatttttgaatcatggttcccactcccttctcccaggggtattattttggaaagtctttttttc

SEQ ID NO: 29688 - DNA, 1126 bp, Heterodera glycines
  misc_feature (1046)..(1046): n is a, c, g, or t
  misc_feature (1107)..(1107): n is a, c, g, or t
tggcacaaataattgcccagcaaagtgcgcagccatgacacatttttggcattcgcatccttttccttcgccttctccgtcttcttttgctcctccagtctttccttctcctcctctttgtcctctttcttttcaaggctttcctcccataagacttctggtacggcaccacctttcttctcgacgaataactcattgaactcattttcatgcttttcacacaattcttccacgctttgccctttggcaatgcaaagtaaaattgagaggaggacgggcaacgtgagcagttttgttgataaaataatcattttatcagcgaattcggagaggaggagtgaagctgaagctcaattaaacaaagcacagcaagcagttgataatgaataattttcttgtttttgaagcggcttttataggcaaaaaataatcaatagtaactgaattacggcaaaggtaacaccaaagaaaaaaggtgaaaatattgtaggagcgagagaaatagacaaatataacattatggtatttttaaagtaaattgcctgcgttgtaagcaataaatatacacatggacagagaaggcataattcccccaaaggcaggggggaatttggagtgatatcaacgtaaagcaaaagatgggccctctgagtagggaggataaggcgaaaaagctcaacagctttgtcaaatcattgaagagcactttggagttgggccaatcctactgccaaaatgagggatccctactaatcgaaaaagcccaacaattttggctatccattggataagcataatgccaatcctactgccaaaatgagggatccctactaatcgaaaaagcccaacaattttggctatccattggataagcataatgccaatcctactgctcgcctccatcactttgccaacgtgccatgtgattaaatgcactttcccttatgccttaaatagaaacaaagaaatggcaaaagtaatgtgaattgattttttaaattcgctgcttgtaattgccattctgtttttgtaaaatgccattaganattaattgtgacatttgttataccctttttgtgcagaacctccacccgtctattcgtaccnttgggtgttttgatcattt

SEQ ID NO: 29689 - DNA, 1886 bp, Heterodera glycines
  misc_feature (246)..(246): n is a, c, g, or t
atttttgtgtccaccagcgattcgtcgtcgtcattgctgctagctgttgtggctgcatttgttggttggtggtccatgatttgacaccccaacagcaaactgtagtcattcagtccattggtgacaaagtactgtaaaagggactgagatagggtcggtagttcagctggtagaacactggtccggaaagcctgagacgccggttcaaatccggcccgccccatagtttttccctgaaaatcttcncagctcgttcatatattcagcaggacaaatgggctaatgtgaacattcctgctcgtttctattaattagggttttgcctcgactccccaatttttcccggttccaaaactctacgatccgctagtcccgaccaattcccagcattgccatcccagatgtctcggtgccaacacacgatcccgccatttttcgacttctattttcgatcgccgacattgctatatattcgacatccctgctgatccccgcagtgtttacccctccaaattcccaactttccccggtcacaaaactcaacgatccccgaaagttttggcactttaccagtcctgagctattccgaacattgccatgcccgatatacccgcctttttagccatccattttcgacaacctccataatttgatccccttcatccctaaaataatgcaccccctaaatctaaaatgtcctctaaaatttggattttttaagaatttctagtgcatacgcgcgcatctcgcttcactctgtcggccaattgtccatacgcttcagcagacaattgaataccctccgggaaaaaggcggcgacctcaactccaccacgggacaaaccgaaaaagtcgaattcccgataaatacacttttgccaacccttctctcctctacactgtttgcgggtgtactggacggcataggccagcgaaaaaacgcctttgatgtcaaacttcagcaaattgtcctcattgatcccctcaaatacgttgttcagcaccacaaattgtaactcgtgtagccgaattaccttaaatgaggagaaacattgctgaaatagagttggtcggaagcgggaatttttagggaaacccgggaaatgccgaaacagcagatgactcgggacctggaccaaaattcgattttgatcagattaataaacgggagtaactaatcgggagacttaatcccgacgaaaaaaatgaaaattttattaaaattcaaatattcgttttaattcgaaattttcattaaaaaagcatttaaatatttttaagtgaaaaattgatgctgataacaatttaaattgacttagattgtcagaaatttcttcaattttagtgcgaataaatttaatattaaaatttaattgaaaaagtttacaaattaaattcaattaaattgcaataacattcaaattaataaattttcctattctcacatttttttcaaaatattgtttaagcgataaaaaaattaggtactaataatagcttctaaacatttttcgaactttgacttggattgttaaaaaattatgaaattttaatggaataatttataattaatcaaaaaaacaaaaacaaataaattcaaacagcagaattttatatatttaaaaatattttatgatactctcctcacttttatcctctcatttccatagtcctccctcagcttggcgtacagcttcattttgaagcacatgaacatggtgttcatcatggatttgttgacactgtttctgttaatctccgtggactgctcgcccttcacggacgactgattgttgatcactccgtcgatcacataagccgcatatttgtccaacacgtcatccatttttgcaggctcatcatgcaccgggttcagattctttaaa

SEQ ID NO: 29690 - DNA, 1717 bp, Heterodera glycines
  misc_feature (1007)..(1007): n is a, c, g, or t
cagcgtgctttgcaggaattgagatgtgttgatggtcgttgatatgcttctcacattcaaggcagtagtgtgaccaaacaatccatattctttctgtacgccgtcaaaatgaccattgttcagatatagcacaatgggtgtgtcgtagtgattgttgttgttgatgtatttgtacagcggcttgtactgacccgtggagccaaaaataaatactgcaaaacgatgctgttgctgcgtgttgttccaatgatccaccacacgcggcacacaaatttctgcatcataagcattgagcccacgccgcacgccaatttgctccatcagctgtagagcatctcgctgcaaacgcccttgttgaccatatcgattgtgcgtatagtcgtaaagcttccaactggcccagccacgggtttttgccaccatcgttgcttgcaaagcataaaagaggcagtagttgcggtcatcaggattgtttatcttaaacctttctcatcagaattggttttttttttttttgaatgggcggacctttatcaaactccgatcattgacccgatggtgaacaggtgccagagcccgtcgtgcgccacctttaagtgatcttttggtagggagtccgcggcgatcaactgttgtaacaacaacggtgaatggctctccccaaagcgtaacgttctgttgtttcttgctttgggccactttgagaaattggttcaagatggtgttgaccgtgttatccgtgatttgccggatggggattggaatgtccccgccagtgagcaatgggctgctgatgagacagccgagatgtgttggccgaaccccgcgctcatgactgtccgccaccgctgcgtcaatactgtattggaggattccggcaagaagtccctcgggattggctgggacgtcttcaatgctgaaccgcgacttgactttggtgtattggaagcgtggtacatgttcgatggtgttgtccagctttcgtacgtagtctttggttgttttgnaagaagatgagggtgttccagcaccttcttggaccatttctcccaacaattggttgatgagaaagccgcgccgcggctttttattagggatagacagcaggtattcaatagaaaaattggagggacgtttgggaggctgattttgcatttttttttcaaaatcttaaaagggagggaaatggcgttgtgaatgattaggtgagccgaaaatgcgctattttatagcacgcgcatgggcatgggcacacattacgatataaattaacataaaatttgaaaattcgtaaccaactatgacccgaagagcagcgcactgccacccatgaagcacaagacgacagggcacctaaacggcacggaaaattagaaatgtttgacgcactacctcaagctctaaaaggcaattaaaattgctgccaggataaacggagctcagtaggttgagcaaccgccctggttaacagcacgtttcaaaacaattttttcacatttatttattaaagtatttttattactaattaattattacaaaccaaccatgacccgatgagcagcgcactgccacccatgaagcacaagacgacagggcacctaaacgacacgaaaaattagaaatgtttaacgcactacctcaagctctaaaaggcaattaaaaattgctgccaggataaacggagctctgtaagtcgaacaaccgccctggttaacag

SEQ ID NO: 29691 - DNA, 1340 bp, Heterodera glycines
  misc_feature (1307)..(1307): n is a, c, g, or t
atttttccagcaaaatgatagaaattcttcaaattttaatgaatgtaaaatttatttttttatttaaaacaattttcgttttcagcataaagttgcccacattcaacaaaacccaaactttttcatggccagaaggaaaaagcgtgcttctgtcttcggtggctgcttctttggattgcttttagcactgatcgctaccgtacctttttatagctaccgtttcaaaaaacgagatgtgtaccaataaatagagagtgccagagaaaaacattatctttttttctctaattttttgtcttcttttggcgtactatctaatatttttattattaggaaaaacaacatttatttcgccacatataactttttttctactcatacaatttacaccaaattttgcatatcgatagagaaaaaaattctgcatcgaacgtatcaaatatttttttaggttatacatcccattttttcaataaaattcattttatagcttttaatatattcttttttgttctatgggtaaaagaaatttaccacgcaagcttaattgcaaaaaggcgttgaaagagcgtgagaagaagcgggaggagagaaaagcaagaatggcaaaggcgacgaaagcccggctggccaagaaaagtgagttttttcaccaatttttaattcaaaaataatttttttaaatttcagccgctccaccgccgaaccccaatgccgaaacgccacagcaagacgaagtagggccgtcaacatctgctgcaccggccgaagaagcgatggagccgccgccaccaactccaggaccagtgccaacgccagaaatggacgaggaaattttggaatttggcgattcgctgccgtcgacatcagcgacgccaatcggcgatttggtgccgttcccgtcgacacccactgcaccaatggacactggagagatgacaccgccaccagtggccatcgacgagcgatcaccgcgcatcgaacagctggaaaaacaactgaaggaccgggatgacaccattcaatttctgcgcgagcaggtccgaaaccgagaagcgctgatcagtgatctgcgtcgtcagctggagcaatgtgcggcaccaccaacggcgacaccaaccaccagcaaaagtgagtgaaatttcgatgccttctcttttcccaattaattttctcaaaaattgatcattcattttttgtcaattttagcaacgccaaacagaggaagaccaaggaaggccatcgacgaactccaacgcagctcgcgaaagcaaaattcaaaacttttcaaaagtgttttatccganttttattgaaataaaatcataaattttaggcac

SEQ ID NO: 29692 - DNA, 1073 bp, Heterodera glycines
tgaatgacagcaccctatcgacggtgtccttcttcatcagtagttgttcaggatttgttgttgactttgagcactctggcattaatgtacttgccgcttttgtcgtaatcgctttcatccaggtccaatgttaggtcaccaccgtccaattcgttcaaattcaacatgagtcggcgaatctgaaaaatcatcaatgcaaaagcgtaaaagtgacaattttcgacacgaacatttgagcaattttaatgtgttcacacggaccggctcagttcggccccgcacggttcggccccagcccagtttttgatctaacgtttttctttgtcaactaaatgcaacattgttggtatcaagctcttcacatactctattagccttagaaaaagcaaaaaaattttaagatttgaaaaaatttatgaagaaaaacttcaaaatattgattttttaaaattgcatgttataaattttttgaaatttgtctaattgccaagcaatagcttagaaaaagcttctaaacacattaagctttcgaatgataccaagattgttatatttggttgaaaaagaaaaaagttgtatttataacatgaagattgcaaaagtaaaattaaattttttttttcttaataacttttttatatgctagaaaatcttagtttttttttgtgaggctatatagaatgtgaagagctttcgaatgatacaaggattgtcgcatttggatgacaaagaaaaaagttatagcctaaaacatgctgacaagggaacattccgaaatcacgttaaaaccacttttatcgtgtagagcatagtcgatttgctatagccaattttcaacttttttggtcctgaccccaaaactgatcagaaaaaagtgatcaaagtttcgaaaaatcggtaaaaatatcaaaatttttcaaaaatcataaaaaattcaaagataatgatagagtcattaaacattttttaaaatgatcagcaaacaattctctatcaaatagcattataaaagaaattaaaataactgaataaaaatatgttaggtggaaggatagttgaaaaaaattcaaaat

SEQ ID NO: 29693 - DNA, 1271 bp, Heterodera glycines
cttaatcaaagagtaaatttcactttggtgaaggcatggtttatgccggagcaggacaaaacgtcgtcggcacaaaaggtcgtataccaaaaagcgccgaaaattacaaaaaatttactaaccagaaatttttcaaagaaaatatttacaaaatttttttaatagaatttccacgaaaaaattttctaagatttttatggcgaattactgatttttcaaaaaaaaatctttttaattttctcgagacttttttcatagaattcttttaaaaaactttctttctaagttagtaaatttttcgggatttttcagcgctttttggcatgacgacgtttcggccgacgacgttttggagtgtgcaccgggtttgttatgccttgtcaggcgtaaaagttgagaatgatgaaatttatgattttgtaggttgtttcattaagaggattatcataattgcggatatttagaaggtgtgaggtatctcatccaaaagttgttccctttttaaaacagaatatccaatcaattttcgctgtttcggcttcaccttttccatttctggtcgctttatacgtaattccaccagttttcttttctgagtattctgtgtaaagttcatgccgcgccttttgctttgtctcgaacatttgtcgaatgtcggcaccaaaaaagggcaattcgcacagctcatcgaagaacttcttcacattctccgccgttataacagttggtccattggaatcgtccgcagttgcattgtcaatgagttccttctcttcttggtagagacggagagattccttgaattttaattagtttaattaaacagtcaatcagttcgataatttcatttaattgttttccgttcggactgactcgaagtcccttcagtttgtcctcctgaagcttctcatccgctgcccctttgcattccgcgaccactttttctgcatgctcaatggacatgttgatgtacgcctccatgctgtcgttgtacggcttcagcgcccatttcgataggaagacacaaaaatgtgccgcctgacaaatatcactcacgacaaatgaaatttgactggttaaaatgcctttttataaatgatccctcgctcttccaacatttgcttctgtacgttctccgaggctgacaaccccacacgttggtgaccaacgagcttttgttccaactcttcaatggtgaaagttttctggcgttgatcaaaaacatagtgtatgtgcacgctccaatcgcatccacaccgctaaaatagatt

SEQ ID NO: 29694 - DNA, 879 bp, Heterodera glycines
aattatcaaatttccagaaaatttcccttttcgtgaaaaaggtacataaaacgtgcaaaaaaaggatgaacattagaattaattattttttctttagaaattttggagatttttcattatgccattgactcgtctgcccccccccctacaattagtcaattcccagaagcccctcctctaattggacacctgcgcaagtgcgagtgccgtcagcggagtgtcctccgccggtttcaccaccaccgtacagccgactgccagcgcggccgccgctttgcgaataatcatcgccgccggaaaattccacggagtgatcagaagacagacgccgcacggctcacgcaaatggacgtgagaacggaacggtttcgacgcgggcaccacttggccatagcagcgccgcgcctcggccgcgtaccaatccaagtaggaggcggcgtattggatttcgccacgcgactcggccaacggcttaccctgtgaacagtgcgaagcgatatgagtacggcaaaacatgaaaataacaaaggccgagggctctcaatttataaaaataatgccagcgcattttggcaacaccaaaagagtccaaattccatcatttttcaaaattctatcactcccagacccacaactctgacatttgtggttgaaaatagcaactatattttttgtcgtcttttaacactggattgggttttatttgtcttctcactgaacctgttccctggtcagtagttcggccaattgcttttccctttcgccgagcaattcgcaccatttgcgcaaaatggcgccccgttctttggccgtatattcgaacgcccaacgcggaaacttttgtctggcggcagcaaccgcctgaacacaacagcaaat

SEQ ID NO: 29695 - DNA, 1845 bp, Heterodera glycines
ccatttcccattctgccattgccgtttcccattgccttctttcaaaatgccacccttttctcactcatttcccaattgtgccattgtcgtttcccatcccgctctttcaaaatgccacccctttctcacccatttccaattgtgccaccgccgtttcccattgtgccaaatatttcgcaaattccttcctcttcccttctttgcaccttttgttagcttcttccatccaaaaaattgcgcttaatgtgttaatttggcgctctttgctcaaaatgtgccaaatttcggccgttttcccatttttcgtcatactttttgcgaacttgtttcgttgtaattgcattaattgctctttttcgcccgtttcgttgattttttcttcaacattttctccatttcccaaattggccattaattgctttaaaaatgccctcattttgcctattttcttccaattttccttctgttggtcaattcccactttttcttcctccgctttttcccatttattcgccaaattttccacttttttcccaaattcaaattgaaattccttcccaatttctttcaacgcttcaattcgttgccaaatttcattagcgtaaacacttaactcgagaagtattttggaattggttggccattcgcccacagattttgaaacgaattccaaatatttttgtgaaataaattcgtccgattgcaactcttaaattacacatttataaatgctcattaaactccaatcgccccttctctaaccttttattccaatctctcttttttctctcatttcttcctttttctcctcactttttcctttcccttttgtcttttgctcttttcctcccttttctctttttgcctttctttttgttccttcttttgactcttttttcacttcattattccccctttccttcctttggttcttttccttttcttcttcctcctttctctcgttctcccctgtgtcataattctctcctatttctgtgtccattttaatattatttattttttcttccttttcctctcctttttctcttttttcttcctcctcttccttttcctcttcgtctcttctcttttcctctccatttcctttcttttcttctttttccttcttttcttccttttcctcttctttttccttcttttcttccttttcctcgctgtctttggctcttttccctccttttccctctcctctatttttcttcctgtttctctctttccttttctctttcttttccattccctcagcttcgcttttttgctttttttcattaaattgaaattccttctcattaaattccatttcgatcgatttgaatatttcttttaccgtttccattctcagaaagtaccataaacgcagtcgagcatcagttgattttttcagtcctaaattaggagtgtttttcccattgatccatccgatcgattgatcagtgcttcgcactgtctgcttcttttctccgttgtcttacccattctcagtgtctctctgaactgtttctgatcggtctgctgctgctttcccatcgtttccaattcgcttttgcccccgtcttccgtcggtgtttcggccatgcccagcatttgcctgaacttccgctcgtgtctgtccctaacccattctggcaccgttattctgatcattttccgctccgtgtcgaagcttttcgccgcgtcactttccgcctttctcttcgccttttgccacccgtctttcaacacgtttgcattcgctgcgtttcgctgtgccaccaaaaagttgcgcagtcgttcaaaaagcttctcatagatggggagcatcatcaccaaattctccactctcat

SEQ ID NO: 29696 - DNA, 2132 bp, Heterodera glycines
  misc_feature (114)..(114): n is a, c, g, or t
  misc_feature (890)..(890): n is a, c, g, or t
  misc_feature (925)..(925): n is a, c, g, or t
agcgctccacaagcagctctcaccactagtccacgcaccatccccgaaagaacagcacgcagccacgggcaaaagccgcctgtttcacgcaacagcccggctgacccgaccttnagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttaagcgatttccgacttccatgnccaccgtcctgctgtctatatcaaccaacaccttnttatgaggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcacaatcgctggagccccggtcaagggaaactgaacaagcggg

SEQ ID NO: 29697 - DNA, 1659 bp, Heterodera glycines
  misc_feature (1626)..(1627): n is a, c, g, or t
ttcgttcgagtcaaacagttgttctgcaaccaaagaccaaatattgtccactctgtgcccatcgctttactaaaaagtcttcagtctttaccgttcgacgcagcaaattgtgatgaagcgaaagggcgccgagtggaaaggtcctcgtggtctgaaaaaggcattgtcaattagcctttgccattcggtgtttgttttgccctttttctactgaccactaattgtcatcacccgtttgatcttcttcgcttgtatgttcatcattctctcctctttactctcccttttcgtcttcactttttcttgctgcccttcttcttccgtttcgatgtctttttcttcgtcgtccactggctttttgcgctttttcgtcggtgtttcggttcgattttttggggagggaggcgaagtggtgcgcacaaattcgggaggaagagtggactttttgggagttgaacagttaaaactttgaattggaattggcattttgtaccgatgtttgttctctgatgaaacgatcgcgcgcctcaaaggtcgggttctggtcgaggaacgaagtgactgaagaaaatgattagaacaaatatgggggtatgaagtgaagcgcgagagtttacgcgaatcgaggaaagagacggagtcggaagccttcagacgaccgctcacttcctcaccggtgcgcgggtcgacgatgaaaatagcggggaaggaggagaggctggaagagaaagaaacaccaaaaagtcattccatggattgttgccaaatttatttatccaattattattacccgtaataattacgaatccgagcgccgtcggccgagtcatggtacacctaaggggtgacaatggttgaagaggaacccaaaaagcagaagcattcgcaacctgccaaaagaggaagttggagcggaccacctcgcgcacagtctccacactccaaatgtcccggttgagcaccgcacacgcaaattcagacgcttcctgaacattgacgagcagccaaacgcccttctgacgcgccgcttggagggccttaaaaattccgcggtatttaactcaaattctaagtcctgtcccattttctcgcctggtcccaatcgccttggaacatcagttcgaccgggggtcgaaacagagtctgcaatgttttgcgatgatgcgaatgggttggcctcccgtcattttcgtcggcatcgttttggttgagtggaaccactgataagggcgccaacggcgcacgggccgatggccgaacggcgaactgttcgcccaggtcaatgcgattctgaaagtcatttggggccgaatttgattatgtaatcaaaacgagattttatgcgtttccaactaccaaaacattgcaaaacgtacatttgcaccgtttgctctgcgtgataagaatgaagccgccgcagatgacgaggagggctgttgatggtcttggcgatactgctcgaacaccgggttccaaaggcgttctcgattttcttagaaagaaatttgaactaaatcacgccatccatgataaaattgtaaatgtttttctatctaaattttgccaattaaaagcttttaggtgattacacgattaattgtaagaatggggagggccattttaccnncacagacttacgatatgtctcgcggaatgact

SEQ ID NO: 29698 - DNA, 1091 bp, Heterodera glycines
  misc_feature (23)..(23): n is a, c, g, or t
  misc_feature (29)..(29): n is a, c, g, or t
  misc_feature (1041)..(1041): n is a, c, g, or t
cattttccctttgatcggtacanaattgnccgaaaaagagatagccattttctgagccccgaagggaaaatttgagagggctaatttatatgtaatattcgaaagtgccaagctaattagcgattcaggcgcacattggggcctgaattaagccattttcccttgatcgggtacaaaattgggccgaaaaagagatagccattttctgaggccagaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcangcgcacattggggcctgaattaagccattttccctttgatcggtactaaa

SEQ ID NO: 29699 - DNA, 959 bp, Heterodera glycines
  misc_feature (395)..(395): n is a, c, g, or t
  misc_feature (409)..(409): n is a, c, g, or t
acaataattccgatgggtgttctcagcgaatttatttaagagaaaataaaatgaaatagtgaaaagtgattttaaaaattaataataatgaagcctcataaatcaaaatttgcttcattcactgttcactttttcttcatgggtgcaatgaagtcagtggctcggcaattggcccgcacgcattcctgacatagctcaaagttcacagaaaagcggtcgtcgtccaggcgcttcaccttctgctgatggtggtacaatcggttccaatcgtcttaagatattaaattaaaataatattttgtctattgctattgtacctgggcacagatatgtagtaagcaaatattttcttttcgctaattcccacaaatctcggtcctacaccgcgcgctttntggtggcggtgacnccttcttctcatgatctggctcagcttccaaatgagttggaatgggttcagttttattctcatactgatttggatcggcagcagcagcagcagccgagagagtagcagcggatctcttcattttgtataaaataattttggtctttttgttaaggatgattttgggtttgaagagagaaattaaaaaggattgcggtttttagtcaggtgaattatttaggtgagagtgggcggggctattaaggaactaaatgatggggcgtcgtccatcttttgatcgtatataaaagtgaaattagtcgttataactttcattcttgctgaaatggtgctcgtcagcgttttctgtgctcagctgcttaactgccctgtcaaatcgttgcgcgatcggctcaatcatcccgaggatcggagcattgtactgaaacatctcattgggcgaaaagtgcgtacaacatacaacgaccgtaatgggatgcggaaaacattttacgtcagtggaatttcggaccaaggggccgccttccttcccgcatacggtcatttgcgc

SEQ ID NO: 29700 - DNA, 1131 bp, Heterodera glycines
tttgtccattttggtgtatcatttgtcttttttcttccatttgtccatcatttccatttgtccccccttttgaccccaccttcgtcttctccgtgattggccatgccctcctcgtccgtgtggtcatcgacggcgtccgcttttcctccgccgttgtcaaagcgggcggcaaatgcgtggaggacaaagaccaatgcttcagcttcacttgaataatgccgatgttcatatctgtgagcatttgctaaacattattatgagcacttttttattttccttttaaaattcatttttttaatttaattatttttggcgcacttttttccggctgatcggccgaaatttgttgacgaaatacgcggagatttgttgatccatcgttgggagaggcatctgaagggatttgaataaaaaaaacagtaaaatatgtcaaataatcagagaattaaaaaataagatcaaatatccagagaacagatcagacaaaaaagcagatgagaccaatctcaaagtctgatcagatcagtcaaagactagatcagaccgatagaagacatgatcagagcaattggagagataatcaaataaaaaaagattaaactgacaatcagagagacatgatcagtcaaagaacagatcagagaaacacactgatcagagactaatgattttcccgaattcacttaatcagtcagtcacttgctttggctcattgtcagcaaaatgagcagcgacagaattgagctgcccgccgggttacggtattgtttgggtacagtatgagggcaggaaagagatacggtcgtcgctgttgttgtggttgtcctcaacggataatgacggcggcacattttgttgagaatgccggcgaatttgcatcgatttgcttttctgagataaaagccaatttatttttttatttttgggcgagagcggtaataaaatttgcaatgttttcaatttccaaaattagggaggaattttaagggcgaagcgcaaatgaataggaggaggagaaggaccacactcgcgcgcataataaacccagtgaatttgtgttgtgatcgattcgcttccttcatgcggcagaaaaggggcgaaaaacggggggaaagggcgaaaagggggggg

SEQ ID NO: 29701 - DNA, 1808 bp, Heterodera glycines
  misc_feature (170)..(170): n is a, c, g, or t
  misc_feature (188)..(188): n is a, c, g, or t
tacacaccgagtcaaaaaacgagacatgtgtcaataaagagagagtgcagagaaaaaaacatctctcattttggcgtactatttttttatctctgtcaatagagaaaaaccgattttacttcgctacgtttaattttttttctatacgttagatccactccaaaatttgncatatcgatagagaaaanaattacaaacaaaatgtaagggttttaaacgcaaaaaaagggttaactaaaaagttattcgagaaacaaaatttcgaaccctcatatcttttttctaatcaatccaattgcttagcagttgcttagaaaaagcttctccccatcaagggctttcgaatgataccaagatttaccaatttggttggcaaaaagcttcaaaaataattcccaaaattcgtcattttttaatattttggacaaaaataaataaaaatattcatgttgcacaacggactcgaaccaccatccattgtccttttactatcttacaaaaaccactgagccacacatgcatttactttttgaactagtggctcaaaattgactcggtgtgtctatcctcgtcgctctacaattgtgtatacctatgacaacaaatgcatagttcttccactttttataataaagaattttttgaaatttttattttatttgtcacgaaaattgaactgaaaaaaacgtttctaccaccgagcttagaggccaaaaaattgttaaaaattggccgtaattgtgaaaaatccacttccataacaagaaggctgaatacaatttttaaaatttcaagcataataaatttaaatgttaaatttattttttttaaatcgagaaaaaaactgaaaaaatgaccatataataaacgtaaaagaaatctgtgaatttgtccagaaaaaaaaaattctttttttttttgttttttcacaaattttttggtacccgagaaaaaccttcgagcaataaaaaataaatgaatatgcagtgaaatgctggagaaaaagtgtgagaatacaaccaaagcagtaacaaattatgtgataatttctgtataatattggccttgactcggtgtaacacagcataacaattggaaattttccgaatccgaaaaagcataattaaataaaaacaattcggatttggacaaatattagggcagtcaaacggtttgtcattggcaactcgttcaatgggcaattcaaaaacaatatttttcaagaaaaattttaatttttgaagaaatcttaaatttttttttgaaaaatatgaaaaaactgtgaacgagttgccatccctgttgacctatcaaactccccccttcgccgtccgtctattttttcaaattgattcacattttttttaaattttaaaaatacaaatgtgaaaaactggcatgagagaaaaggtggtaaggaaaaaggaaatggtagcaaacaaattggagaaaaaaaggaaatgtaacatagaacaacagcaacaataacaacaggcccgtaaccaaggggagtgtaaattttccgaaaattttgaccaattatgaaaaaaatttcgctttttccgccaaaatcctctcaaaattgatcattttggaccaaaatcagttagcaaattgccaaaaatgccatttttttttctccgacggcatttaatttttttgggctacggacccgacaaaacgaaaaaaaatggtgaacaaaataaggcgtacccaaagaaatttacaattgttttttgtgcaacaacatttggttttttcattttccaatgggaaataatgcaatggtttttttccatccctccggc

SEQ ID NO: 29702 - DNA, 1561 bp, Heterodera glycines
aaaaaataaatcatacatgaaaaaagggggaaaagaggaatttctgaaatgtttgccattttcttacaaattacacattcataatttttattgcggtttttttttcactgaacgcacaccttttggcaccgcccaccaccaaattcttagtttttttttctttaaaattaattcaaattctaaaatttttttgttggaaaaaccccttttcgtcgttgttatctgttggcaccatcggggcctcacccttccccagatgcattttattcataccagggttgttccgggtgcactgtccgtgcacaatttgttgggagagatttggccaaggagccttttgttttactcccaattaatccccgggtttactcctaagtttgccaagaaatggaaaagaagtttatttaagtaggatgggaaaggtatgaagaaattaaaggtgaaagtgtataagtggtaggattggataggaaaaggaagacaaaaagaaaagccaagagtcaatggggacagagtttaaataggcaaggacaagaagagaggatgccgacataattcttatcagacggggaattcaaagggagagagcaaaggcacacattaaaagggggaaaaattacataataaatttgctgggtcaagagtcgggagtgatcatcaaaggaaacggcaaattggtcaaaaattgcagattggggaacagtccaatccttccctctttttgaaatctgcggctgtttctcaacgcggagcatacggacggaagcggcgtccaaagtggtggttcggcggctgacaatcatggcatcggcaatgtcctggggcaggatgacggtggttgtggtgctggtggtgcgctcgatgtccttggcgcatgttgaaataatggcgcgcatgggcggctgccccagtagcggtcccacggccatgtcccccacgccctctgatgaatgcgcgcccctggccggtgcctcgcccccgctcacgggcggattgctcctgcggcagtgagatgcctttcggtcccgggtgggtttctccctgcccattctccccctcagtcgggctctcgggttctttcccggtttctctggcctcaacgctcaccgcttccaactccgggtcatcgagcgacatttgttccatttcttcccgcgctcggttttcatccagcacattagccatttggttgatggccgcggtaaagccttccattccccggttaacagtactcatagcctcgccaatgtattttgcaacggcggaaaggatttcctcctttgcgttgcccagctccatttggatctcggccatattggccggtgagactttaggcttattcgagcccttcgttttcgaggcttttgctcccgcttcgggatcggcattctccttaggtccgagaatggcatcaattggagaagacattgggatggaacagaaattacaaaaacaggaaattgggtggaggaacaaaatggaaattagatagaaaagacaatgcttacaaaatgaggatagggccaagaaaataaatgccaaaaatgtaaattacggaaag

SEQ ID NO: 29703 - DNA, 1728 bp, Heterodera glycines
tttccaacactgaaccgattttgccactgatttaacaacagaagcgaattttttgaaaaccaaaaaaaatatgcgagattttgtgcattttatgctgactggaaaaatgtttgttgtcaatttgaataaacaccttattcatcaaattttgtttgagtttaagttattgttatcatcatcagcaacagatgcttcttttaatagcttgatttaatgatttcaaagctatttgattttcatgtttaaggtgtctcgaaatcaaagagagtcggaatcttaagcctatcccaaaaattttgaaaaattttgaaaattttatttgaactttaagcttattttcaaaataatacctactaaaaattcaaatttttcaatttccttggatcaattttttcttttataggtgttcttttcaattttattagaaacctaaaattaaatataattttgtatttttgtaataaaaatatatgttaaaaaattgcctaataaaatcatttttttcaaattatgcaagagaaataaaaaaaaagtttatgcacagacacataataaaatgcataatcgtaaaataaaaagaactccaataggacaaactgaaaagatagcaaaaagaaaggacaaaggggaaaaggacaattcaaggacagaaaaaagaaaagcccaaggacagccgaagacagaagcaaatgataaaagataatgaaaatccaaagaaaatcccaagggttttgttaacagagaaaaagcgcaacgttaatgtccttaaaaataaggacagaactgcccagtgaaatgcaaaatgatcattggaacaatttttgaaattcataaaatgccttttttcttctgttaacattgccaaaaagcccgaaaaactatcagcagaaatcactcaatccatttttttggggggggggaatgaatgaattagtcaattcctttttttgaaggctcttcattcggcttctcctcctccgccatttctttgttgttgttgttgttgttggcattggcaattatgccctggctgccatttttggacaatttttcatgtttaaaaaatggatgtccttgccattgtacctcgaaaaatccttccttcatcgccatcgctttgtcattgaccagttcaatggctttctgcgcaaattcttccaactttttgtcaaattcggcacgaagaattttcaaatgatcaccaacagcagaagcagatgctgcttcttcttttcgctccatgtcaagattaaatttgtttgcacgcaaatatggtggttttgtaaacatatttttgatggcatttttcgttctcaatcgaaccttggacgttcaatgtttgctaaaattgtggttaaaaatggagagatcgcctgaattttcaaatttgccgctcgatcccgcttcgggattggaaatcaaaatttttattttattttttttctgcacgggatcccgcgggattaatccagcaaatcccgcatttccaatttgcgggaccccacacggcattgtgggattgtaaatttgcccatcgggtcacgttgcgggattggaattgttagctgtacgggatatagcaggattaacccagcaaatcacgcatttcccatttgtgaggttccgcgccgcattccggggattagtgaattttcgaaaaatttaaacttaaataaaaagaattcatcaaaaagcgcaaatatatatatcctaaattgcctgggaaaa

SEQ ID NO: 29704 - DNA, 1812 bp, Heterodera glycines
catgtttttaggatttttaaatacaaaaatttttcgaaaaaggggagggggcaaagcactaaaaaaatccataaatattggaaaaacaacgataagagggagaacaggaacagcagaagggcacgaagcgaaaaagggctggctggtgcaaagcaaaagcttgatcaatgaaagccaagcgaaagcaaaatgttaaatgggacaaaattccaaaaaagtattcgttcaaataatttccagaaataaagcgagccacataaacatattgaaaaattaaggcgttatttttgatggattttctaaacatttttcagcaggcctctctaaaaaaaaaagaaaatttttattatgaattactgcgaaaatttggctctgacaattgaattcgacagaattttcatcaacttattttatgtgaacggtggctggacgtttcgacaataccttttcgacaatgccgtttcgacaatgccgtttcgacaatgaccatttacgactatatcatatcgccaaaatttaaaatatcaaattaaatataataaaatgaatataaaaaataataaattaattaaaaaaaatattgatgaaatttaaagagaaaaatttaattaggtagttatattttttaaatttaatgaatgcattatctatcgcctattgtgtatgattattaatagttaggagttggatttttaggtttttacctatttctagattttttcaatttttaacacctattttcgcacctattttggccttttttggggtttttagcacctattttgcacttttttagcacctattttagtacctatttagggatttttagcacctaaaaatccgagccctattaatagtgaagaaagaagacaaaatgagacggacctataatataaatccaaaatgaaaccatttatttaacttaatgtagtgtcctctttttacccaggcggcaatcctgaagaatggttgtccctaattttcatttttttaaattttgtgctcaaaaccagtttttaggcgtttttgagggtgctgataacggatcttaactcgggtttgcccaattccgaactccagacccgaattcgaacaaaaaaaattgtttttttaatcaagaatagttttttcagggtaaaagcttctaattcattatcaactatttaggtgtaaaacaatgtttcaatttttaattaaaaaaaaataagcaatttgcgccgaaaattgacaaactaaagccattctcataatgctattttgaaaaaaacgaaaaaaaaacttttatattgatcccaaatccgcaccatataattttgcagaaatttgaattttatttaaaaaaatatatttaattttattgtcgaaatgtccgggagccagcgggggcccaaacgctctggtccctccgatatatacatatatataaaacaatcgcttcataattttttttgtccaaatcgccgccccaaaattccgcgagtcgcgcatcgcggaaaaaaggccgcgaaaaaatctaagtcgcaaatgtctggacacgatggtgctgggacgttagtcaaaaaccatcaaaatgggcgttagtcaaaaaaccatcaaatggaaaatttttgacagaaaattattcataaatttttcgatagccctaagtgttttctattatcctccaaaatttttaaaaaattctttaagtttaaaaaaagttatgagctgagaagctcaaaaacccaggtttttttgaacatttttagtcataactttcttgaaacttaatgaaacttaaagaaattttgtaggctaatagaaaacacttag

SEQ ID NO: 29705 - DNA, 1080 bp, Heterodera glycines
aacactccggcagtgatcgcaatgataagacagatcagtgtggacacgtgccaagctaattaattagtgggaggacaattattggaaaaattgcgaaaaatttaaattttttgaattaagtccataaaatttgttcgaatgaattaaaatgggaaagaagctatacaagcttaattaagaataaaaatatgaaataacaataaagttaattgtgttttcttgtaaaaaacaaaatttttttgaataaaataattttattttttatttgcataaattttgttttattatttttttaatttttccaaataattcggagaaaaatattaaaattaaagcatttaaagtcaattaatttaattaaagttagtatataagccctgaaaaaaattaatttttatttaaatgtaacagtttcaaaaattattcaaaaataatttaagcaaaataatttttttaaagtttaatgtaataataaatgttgattatattagcattaatattattatcatttttcacccaaaaatcggtgctgtgaataatccgtttggaataagctgctcattgcactgtaaccgcccgaattggaaaggtacgggtccatgccgccgccaccgcccccaccgccgtacggagacgggtcaatgttcactaattgacaaattaaaatttcaaaataaaaagccaattagtagtatccactcaagaaaaaaatgaatttgaatttcaaaagaaaggatggcattttgttatgaaaactacggcatttttcaggcttttgagggtccgtttgtgctgagttttgaaaaattttgtcactttttatgtgagtgagtttttgccaaatttttaaaattttgtaagtttttgagaattttttattaaattaccccatttgtattcgcattggtcacttgtcacgccccagttgaagtaagaagattgggcttaagaaaatttaaaatattaaatttgttttacattcaaagataatacataaatttaaaatttatctaatttttaaaaataatttattctcgtttatgttttaagaatttgttttttaaaactatatctttttaa

SEQ ID NO: 29706 - DNA, 1277 bp, Heterodera glycines
ccccccctccccctccccccgcccatagcccaaaaattttccgaaattgttttccaaaaattatgctatcaaaaaaataacccaattttgttaaattctatcaggactgaataaatttgttttctttacttatttaattttggattttctgtaaatataaatcctagccttagatattacatacaaaaaaataaatttagatattaagccagtaaaaaaaacattcacaaaatgcgcaatattaaattggcgatacggcaaaatcccagcccgacaaaatcccgctaacataaaaacaacaaaatctcgactcagccaaaatggatttcgtcttttttttttggttgagtcgggattttgttgttttttaggttactgggattttattgggttgggttgggatttgggtcgggattttgtcggcacacgatcactcctccatctcctccatgcggccaccacgaaatgaacagcggccacacttctccggctgcttgtcgaacaattcgacatggcagcggaagcagagcgctaattgccctttcttgccacccggcgccgccaatggtgctacaatttgtagtgccgccatcaggtcacagggcggcggcggaggtggcggcggaggcggcggcaacggcgggccatgatgaaccacaatggctgctctcagagggccctgaatttaataaatgtaaaataaataaaattaaatattaaaaattttacccgtccatttggcaaaagccaaaggctgatgcctttcttcctcttcaaaaagaagttgccggagtttatcgctgctctcgccaatccgagatccattttgagacgggccaaggcttttttgcgcagctgggtagccgatcggcgcttgatgcgtgcctctactgcgatcgctttggacaaacagatgtccgcttgtcggttggcacactgtgaacgacgtatcgcccgttcatatcgtgctgcggcagaatttgtcgatggcatcggggggggggggagattgatcaggcaggagattcaaattgttttgggcgatcaggcaggagattcaaattgcttttgggcgatcaggcaggagattcaaatttgttttgggcgatcaggcaggagattcaaattgctttttgggcgatcaggcaagaaactcagtggttacccatacgaaggcatgccttttatataggcgaggacgtcaattagccggggggggggacacacattttttaaagttggagcgggtgcaaaaagtttttttggcgcaatcgggg

SEQ ID NO: 29707 - DNA, 880 bp, Heterodera glycines
  misc_feature (863)..(864): n is a, c, g, or t
ccatatttgtttgagacccccaaacggacacttgaaaaaatctatttatttttgttttcggcacagtccccccgaaccgatgcgcccagatttatggggagaccgaatccttcgggaatagcttccctatagcctgtactataattgtgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataaatgtttgagtaccccaaacggacaacttgaaaaannatcgatttttttgttt

SEQ ID NO: 29708 - DNA, 1284 bp, Heterodera glycines
gaaaagcgatgcgcaacaccgaaacgcttgtgttgccaatagtggaaaatgaaccggaggagcaggaactgcttgtaaaagcaacgtcagaaaaaccatttatcttttccccggaattttggtttagcccgcgttggcaaaggctgttgacgatttcccaatgacttgtgccattttggtgcgccggcacggacttttcgtttggggaccgaattggcaaaaaaccaaagtgatgctggaatgtgttgaatatttgttggaaatatgctgggagatgagaagaaatggaatgtgatgttcaattgtttaaacggattacaatttgtttatttgattcacaaaaaaaatcaaaacattaggttttattttattaggtatttctcatttttctttcattttccatagttaataaaatttggtatccgacttgcctatgttggacaccgcgattcaattttgggctcccagtgcaaataagtttattatttatttagtaatcagaacgccaaaactttgcaaaacttaaaattttcttgggattttcccttgtaaaaatggaagagccgatctcgagttaaaaactagacagctaaaaaataaactgtgattcgatagagggtcaaaatatgggcctatgcaaatttcaaagaaaatcacaactgtagaaaaaaaaattcaactggcaaagttttttctttttctctcattttgacgcactatttccattagatttattttctttaattagttagctaaaattctcaatggatgatttgttaaatgacatcgatgaagatcagcagcaaagcgaaagtgggagcagttcgcttccaccgcagtctgttaacacgatggcttggctggaacaaaacaaacagaaccaagcgcgggcattctccgagaatttgttgaaagatttgagcgctgtttcagagacgggcaaatgtatgggggggggggagctttttttgtatttcaaaagaatgagttttttgtgattaaaaattgcattggagttttttgtccttttttcttcaagctctaaaacagcaaaaatattctttttttggcaagggtgaccttcgttattgactgacaatgaggcgcattttatttatttttccctattttagctgctgaatttaacgtcaaagatgaaatggaaggcgaagcaggagacgaagaggagaatcagttcattcagaattgtcagcggattcgttcttaccaagtggcttccgagaagaattgcaaccacgaggtgcgtcccatatataaaatagt

SEQ ID NO: 29709 - DNA, 1514 bp, Heterodera glycines
  misc_feature (1389)..(1389): n is a, c, g, or t
  misc_feature (1499)..(1499): n is a, c, g, or t
gaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgttctggaatttgtttctcggcgcgtttgtttgggaaaaatttggaaaattggctatctctttttctgctcaacagtaataggaattccaaccgcattctcagaataattacgccgttctggaatttgtttctcggcgcgtttgtttgggaaaaatttggaaaattggctatctctttttctgctcaacagtaataggaattccaaccgcattctcagaataattacgccgttctggaatttgtttctcggcgcgtttgtttgggaaaaatttgaaaaattggctatctctttttctgctcaacagtaataggaattccaaccgcattctcagaataattacgccgttctggaatttgtttctcggcgcgtttgtttgggaaaaatttggaaaattggctatctctttttctgctcaacagtaataggaattccaaccgcattctcagaataattacgccgatactaattgttctggaatttgtttctctgtcgcgacaacgcgaaatcctaagataaaacccaaaataaaaaagggaaaaaataaaaaacaatagaaaataaaatggggaaaaataaaacataaataataaaaaatatttttacatttattttggaaaaataatattataaaaaactattcaaaatataattacataaaaatgggaaaaccttttgaaatgaataacggaaaattgtttgaaaagggaaagtgcatttcctcaggaatgaaaggaacgaaaattaattaatattaaatgattaatatgaaagggcgaattcggttaaggaattgcgttcgtaaacaaattattaataattaattaaatatattaaagaaactagcgggtgtgtgcatgcgagggtggcgcttgggaaagcgctgcgcgcttcttgagcttcgctacctaggcgcgttttagtctgttagggtctttgcgtcagccgacatgcacttggtttcctccaataattggagttgacacatcgcataatgcaatggaaaccggaagtgccctaacgttgcacgtcatggccctcctccctcccttaatccaggcgttggcacgttattgggttgagcgctaaatggcaattcacctgtaggccctaaagagggctgaccggtccatgtcccggatccaagcttctcaccattttcgcacccaacatagtgcagatgngaatgggattggcatctctccaaaaaccatgtgcccaactgctctggactaagccatttattgtaacttgagcatattagtagctacaatattcagcactttggctcgcncttgggcatcaattt

SEQ ID NO: 29710 - DNA, 1316 bp, Heterodera glycines
aagctttttctctattagcctgcaaaatttcagaaaaatttgtcaactttataaaaaagttgtatgaaaataagtaatatttctgccaaaacttatattaaatttgataattttgtttgaaattctgcaggctaatagagaaaaagcttggctatcgaatattacaaagaatgtaaaatttggttgcctttaagcaaagttataccatgttttgtcgaaaaattcgctaaaatggcggattttgtgaaatgacccagcacgttatttttgaaatcatttgttctgttcgtgaaaatttgaagcgcaatttaagcactttggaaaagtcattttcactttggaaaagtttgcagtgaaggtttttagaatatatttgaaagttttttaatttgttcatgggtattaatgaaaaaattttttgattatagttaatctgagaaaataaaatttacggaattaccaaaaaatggaatcatttctattgatcggcccttttcaaatccagagtgaacttgacaaaaaagaccatctgctgtccatcaacgcgctgttccaacaagctgatcaaaaatgggcattggagaatcaaacggaaagctggcgatgctccagatacagggaaaattgcaaaattattatctaaactaaaaaggcaaaaaatccaaaatggtggtaaaacatagaaaaattgacacgaagtcgttttttattttagaatttgttaatacttattaacatctaggtaatttgcacctttgatttttcaaaatataatatatatagctcatctcgacttagaatctaatggcatcatttttatgccaaataatttataataaaaaagcattaacaataggccatgagaaaatgatggcgtttaagaagattggaacgaaaagataaaagatttcatttcatttgaaaatttgcaaaaattcggcgttgcaaatacggtaaaaatgacataaacgagaaaaaaaaattaatcattaaaatttaaaatgttctcgtcgcgttaaagggccgtaacactccggcacgggaagccttccacctttgttgtactgattactcttctcaaaaaacccagcggcaattgaggccaaaagaatttagaaaattatagtcgcgctggtgttcggccaacttaaatggaacccgcttcggctgtagtcaattggtgagtttgctaccgctgtgtttcatcctttgacttctagatttttcgtctacccaccagtgatgccgcgggttgagaaaaatttcgggttcgggtttcgagtcgggcactcaaaaaatttcgggttcgggtttcg

SEQ ID NO: 29711 - DNA, 1297 bp, Heterodera glycines
tgattagaagaggtacaatggtgattagaagaggtaaaatggtgattagaagaggtacaatggtgattagaagaggtacaacagtgatcagaagaggtacaacagtgatcagaagaggtacaactgtgattagaagaggtacaactgtgattagaagaggtacaacagtaattagaagaggtacaaaagtgattagaagaggtacaaaagtgattagaagaggtacaaaagtgattagaagaggtacaaaagtgatcagaagaggtacaacagtgattagaagaggtacaacagtgatcagaagaggtacaacagtgatcaaaagaggtacaacagtgatcaaaagaggtacaacagtgattagaagaggtgcaacagtgattagaagaggtacaaccactgtcgaaaatgtacaataattgttggagaggtacaaaaattgttggaattgtacaacaatggttaaaaagggtacaatcatggttttaaaattaaataattaaggaaatcgtttattaaaaagtaagattaaaaattgaatgtaattaataaatttttaaaaataaaataaatttccttttattaattaaaaagagagtttgaaaagtacagggattgaatatttatttaaattgaaattaagaaattaatattacaaattctaatttaaagtatccgggtcccggattttgaaaagctcaggtcccggtcccggtcccggtagggcaaccgggaaccgggaaaaacaagcactggtaagaatgggggtctgagtgaaaaattagtgaagaaaattggagttaaaggaaaaagagattcatatttgaactgatgaacatttcgccaaatttctttctttcatacatttttaacttttacatttcgcaattgcgaaatcggttgaaaaagtattaaaaaatttttgatttatgttctttttagtctgagtggtgccatggcagaaaaaattttgtttataaaaggaaatttgggtcgtttaactttggcaccatcggcagaacctgatgaagatgatgaagaattgctgacattggatgagttggaaataattgaaaattaaatccgatccaaatatatttttacaaaatattttcttgctttaaaatgtaagagttatttttggttttccttttgaaataaaaagaagcaaattataaatttaaatttgtatttacaaaattaaatttaattttgtattattttcagttgaaaaaaaattaaaatttgaattttttttaaaatttttgaatttttaaaaattccacggttggtcccg

SEQ ID NO: 29712 - DNA, 994 bp, Heterodera glycines
cggtttcgatatgttggaccggttaatttcggcattcaaactctgttcttgaggctcatcgtcaaatgtcgcgcgacggcggggattcgcatcctatggggggaaggtaagcatttcagtgagatttgtatggcccaatgaatgccaatgccatgctccaccccctcaccttctgctgaagccctcccgtgccgttctgtccctccctcctcccattttggtccatcaaagtcacgtccgaccgtgcgtcctcctcctcctcgttgtccgcctcttcctcctccgagtccgtgtaagtgccggtgttccgtgaagtgtactgaatgaactctccgttcttttcccgtccctccccttccatctttcccactttctttttgctgctgttctccttcgtttttccattgtttttgcttccattcgtcgtctgttcctttccctcccctccgcccgttccgtcgtaatgcgccagcgattgtccgtcccaattgacgcgcggcgttctttggctgtgttcattcgctgctgttttcgaaatgttcttcgtccaatccgaattcgactcgttcacatcgttcggaagttcaaattttgttttggaagaagaaaagcaacttaaatgattgaatgactttttttgaatatttattttgactgcactttctatccgaaggcatttgagggggcgaaggcgtccgtccgactccgtcgttgggcaaagtcgacggcttttcggaggaattcgcattatttggcgggagaggttttgcagtgttttgggaagtgctctgctcataaaacacactttggtcgacggtgggcgcgaaaagagaattgacgggacgaaacttttcttccatagtctgaaaatcattccaattttaaaatgtaataaaaaataaataaaaattcaccaatttggccctgtgattccctccgttgtgatgggactgactgttgttggcacggaatttcttaattgcttcttgctgag

SEQ ID NO: 29713 - DNA, 433 bp, Heterodera glycines
tttggtgcatattttatgcgcatattttacgattttatgtgcatataattttacaccctagtcattatttttcaagaaatttaatgctccgcaaattttttttttgatcccgaatttactgaaatttataattttgcattttcctccccaaaattatcaaaattgataataggagactaaaaaaataaaatttgatcgaataaattggaaaaataactgattagaaaaatttttgatactaaaatcttattttgggcttggtgttttattttgaaaaattttcgatggaagccctggtttaaaaatacgtgaaaaggtgtggggtttaaccgaaatttttgcgaacccacctcaacatcgaatttgacggtgctaggtcaggttgtttcgtaaaatccgccaccttgagcgtgtcgtaaaatccgccatttta

SEQ ID NO: 29714 - DNA, 926 bp, Heterodera glycines
tggaatcctccattagatttttcaggtataaagaaaggcctgataagttttttctggaaaaaggtctaaagaagttagttttcctggataaaggcctgccccaccccatttccgaaacctttcaactgtgaacactctctctgcgcgttgacttggttgtccccgttgcgtacacagtggtggtcaaactgtgcccatgtcatgttcgttatctcttcagcggcgtcataggaagacgggttttggtagagaaacgaaatgaccatcagagaagcgaagaaataggcgaagagaagggcccacacttttttggagccattttggaacactgacaacaacaaaaaaaatgtgaatttttttaataaaaatatgtaattttgacatttgttggatcagagccccccgggggcttttatttttcaacccttctcccctcaaaatgagagttttattttaggggggagagggggctcaaattcagtaaatgcggtttttgttggactgcgtattacgtttgaaattgaactgtttggcgatgattgaatagcattttcggaccaggaaaggcatgacgaacacgagcacagtggcggacactttcagcgcggttatctaaatgcacatgaaatcataataagaaaaagggatttcaaaaaattctgggcctggatccggaaaagctacatggaatggatatctggatccatatccgggcacgttttccaacaagtacccgggtttgaaatccaaacgggtgcactttatttcccccgggtgcgctacgtttcccccccgagaaaattttttaaaaaaaatttctcgggggggaaacgatgcggggggggaaccgagctgggggggaactgatacgggggggaaacggcgggggggaaaacggggggggggaaaacgcagggggggggggg

SEQ ID NO: 29715 - DNA, 1706 bp, Heterodera glycines
attaaaaacccttcaatttgctctcgtaaatgaatttgcgaatagatccttccttttttctgctttattgagtatttctgcagcctctgcatgataaaaattcatttactgtcgtaataaatagaaaaactaaaaacattttttagatactaaaattgtttagttggttggacataaagcgagttacggctgattaaaataaacaatacaaaaaaggcatttaccagtgtaaattttaaattagtgcgcaaaattacacaaattatactatttggcgtttcgtaattggcgtaaacttctgcgcgctaattcaaaaaaacactgataaatgcctttttttagttgttgggacgaattggcgaagtccatttgcccaaggggacatccgtagcggaaatgcgctgattgatgggaaaattaaaaatgcttggatttctacgtttgaatttcaatgcttttcccttttctttgctcattgatctccattattttcttttgtgcttgtctcgctcccttcacattaattgagtgggtaaactgtgaattgccaattaattaattggtccagacggaaatattcttcatttacttataatttacaaattgcttatgttttcaacaaaattcggaaatgtataaatttctcatttctaagccgcaattgctcagaaaaatagttggcggcgagaaatatgttgcaatgcttgattttgtttaataaaatgcgatttagagttttggatgcgtgtttaaaaaatgtccttttttaccctaaaatttgacgtgccgatccgtccgatgtgtgtctattatgaggaaattgatgaccaccgatgttagatgctgtaattgtcacatgttattgtctgttttctattgtatgtatttgttttttgtcagtgtgagtccatttcagaaaaattcctttggatcggattaataatttttttgtgtcttggatttataggtgctaggaaattggtaaaaatttacaaaaagttgtaatcaaaaaagctcgaaaaatttagaccgaacaattttgaccctaacttttttgaaattcaataaaatttttcgaactttaacaaaataatagagaaatctttgggctatctaattatataaatacaattaaaattggttctttcagaaaaaagttttgaaggaatgaagagtataatattcttatgtgaatccttaaaatggaaggtcgcttaaatgcgtggaacttgcacataccttcaatcctcttccgacatgggagataaaaagaattgcaaaaaaggatgtcacagtgccgatggaattcgaattttatgactaaaggtacagtactttaagacacgatagtttagaataaataattttgaaaataatttttccccttccccatttttcacaggtggtttcaggcctttcacagctcaggcaaatgtccaccgatctgttcgggacatgctcaaccgccggtattttcacacggaacgatgatcattgacacctctgtgcgccctcatccatcaacatgatcgccggtcacacaatgtcaatgtctgcaaatcgccctggcccagaacgcgaatgacgccgaatccgccacaatatttgcagtcatacgccgaagccgcccaacaggccccgtcaggcacgaacagcaaccgaagaatcgatgtgaagtgccataaatgcggcaaaatcggaaactt

SEQ ID NO: 29716 - DNA, 1131 bp, Heterodera glycines
  misc_feature (135)..(135): n is a, c, g, or t
  misc_feature (1125)..(1125): n is a, c, g, or t
ggaacagtccatcaaaaattcacagtacgactccccgagactttggaattggcacaaattggtcagtagctctctcatcaattatttacccctactcattcaccgcactcggtataacgggtcaagagtttatanaagtatgggaaaacgacagcagtgtcccgactcaagtttatttaccggacatgaattttaaaaccgccgggggcctgggaaataaaattaacgaggcattcagccatcattacaaaatcaaaaaacaacgtggaaggagagaagccaaggctgaagataccaaagattcaaaaattgatgtcgcaaagagggccgcagcacgcgccgggagagacgtagaaagacattttaatcagatcaacaatatctcaaattccatccaaacccaactaaacacactacgagaaacaaatcctcacattttagaagagcctgatataaaaatttggtttgacaaaatggttgagatgggaaccgaaattcaaacatcccgaaatgaacttaagtcttttcaagaagaagtagataaagccaaaaacataacattggagcatgtggaaaagaatgacttgaaaaaagcaaagaaatcagccgacgtcgcaaagggaatcgccagacaggcaaagaccaaatatacatcaactctcgagggatataatgataaatcggaaaagggttttagcgggatagtgaataggcttaatgaggcgctcggtgagcatattaaacgtaaagatattgaaaatagacaagtatctgaagctgagaaaggaccacaaaaaagagagagattagccaatgaggatgttcaatttcaatatgacagtattgatcaaaaatttattgtctatctttccgctgctgtctcccatatagatttgtcaaaacacctcgcatatgttctagggtttaagaatacaaggctatttcacgcggaagaggcgacttatatgccggatttgacgggaggtgtaaggcagctatacatttatgcaccaaatttaatcgaaaacacaattatcggcaaccagatggccccactcttaagaatagttaacgtcgtcgatgacccaggatcgattagtgaagttatatatagcaccgagtatntttcat

SEQ ID NO: 29717 - DNA, 1040 bp, Heterodera glycines
cagagaatttttaaatttatcttatatccaagaaaaatgactatctcttattttgagaaattttatacgttacaaatgctctcgagcatgataggaagggcggtgcgcaatcgccattaatttctcagagaatttttaaatttatcttatatccaagaaaaatgactatctcttattttgagaaattttatacgttacaaaacgctcgagcgtgagagggagggcggtgcgcaatcgccatttaatttctcagagaatttttaaatttatcttatatccaagaaaatgactatctcttattttgagaaattttatacgttacaaatgctctcgagcttgataggaagggcggtgcgcaatcgccatttaatttctcggagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaggggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagctctcgagcatgataggaggggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttctcagagaatttttaaatttatcttatatccaagaaa

SEQ ID NO: 29718 - DNA, 1399 bp, Heterodera glycines
  misc_feature (108)..(108): n is a, c, g, or t
catcagaatcatctaatttttcccccagtgattgtgagtgatagaaaataaaagaattcagggataattcctgaggatttccaaggaccacgtgcatcattgctacancggtgccttaatggcattttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatggtttatttacaaaaatcgaaatacttcctgattactttccaagaaccatgagaataaatatcgcattagcgccaaaatcgaacaagaacgctaatcatcagaatcatcttaattttcccacagtgatttgtgagtgataagaaaatagaagaaattcagggattaattcctgaggaatttccaaggaccacgtgcatcattgctacaacggtgccttaatggctttttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatggtttacaaaaatcgaaatacttcctgagtactttccaagaaccatgagaataaatatcgcactagcgccaaaatcgaacaagaacgctaatcatcagaatcatcttaattttcccacagtgatttgtgagtgataagaaaatagaagaaattcagggattaattcctgaggaatttccaaggaccacgtgcatcattgctacaacggtgccttaatggctttttaatgtcaaaatgcccgacactagcgcatttctttagacaacgaaaattaattcctgaggaatttcccaaagccatgcgcagctttgttagaccgatgccgaaatggcaatataattggaaaaggacagacaagaatgcttttctttatatcagctgatggtttatttacaaaaatcgaaatacttcctgagtactttccaagaaccatgagaataaatatcgcaccagcgccaaaattgaacaagaacgctaatcatcagaatcatcttaattttccccagtgatttgtgagtgataagaaaatagaagaaattcaaggaataattcctgaagtattttccaagaccacgtgcatcattgctacaacggtgccttaatggctttttatggcaaaatgcccgaaactagcgcatttctttaaaacaagaaaattaatttcctgaggaatttcccaaagccctgcccaacttttgttaaaccgaatgccaaatggcaaaataa

SEQ ID NO: 29719 - DNA, 897 bp, Heterodera glycines
aattgatctcaaataaataaaattaaagccgaattttcgtatatacaaaaaaatatcattttgatttaaaacgaacgtgcgtagttttatgaaatcggctgaattggcaaacagcatggtttgggcaaccagctgcagaaaggcggacattgtcttggcgaagcgaattgggcaaatgttgttgttgttgtttttgtaagtgtttgaggcggtctatcaaaagatgaattaatagagttcattaattaattgaaacaaattgattaattttggtactacagattgtggcaattcgtttattgaaaattcatttttgcatttgcctatacaatgtgtatttagtgtgtaaaattttttgttactcggaatgcttctgatggtataaaactaaagatttgcaaagtatgctttttgggtcaaattgaattttggtccagctctgaattggcgcagccgtggaaaaactccggatttttaaaataattttattagaaattcgcaaattttcacaatttttcaaattcgcaaattttcacaatttttctattttcatacctggcaaaccccttctcccttcccttttttagagccccattactcactgcaaaacatgtccctcgttttagttattgaaatatcaaattaatggcgatggtacctcctttcgtaagtccccaaccaattattgtcgctggttcaatactcgctggctcttttttgccaaggcaaatccgcgaaacgtccgggccaaattcaagtggaacgttcaacttttaatattgcattaatttaaattattgaattatttttattttgaaaagtcttgcaaattaattttaatttcattaagtaattaaattataaataacagctgcgggtcgtttggcgctgtttttt

SEQ ID NO: 29720 - DNA, 1758 bp, Heterodera glycines
gattaaaagtatatatatatatattttttaattaacttgctcggaagtcaatttcaggagatgatatcgatgattacattttttactatattaatataattacctttttttataattacacatatttattggattgataaatattataaaatgttattttaggtgcaataatttttttcaaacattaatagaatttgtattatagtataaatattcataattcatatattaatcattaaattttcttgatttgatcgtttacataacttctttacttgggaacaatgtccacattatgaactgtattttcaatttaatcagtgaaatgataaaatttatgcttttgtcgccctttgtttattaaatatttttatttcttatagtttagtttattcaaataatgaatttttattttttaataaattaaattaaataaaaaattagcgaatataattttattatcttaattaactcgacgagaacggtgctaggtcgttccacaaaaaagctcaatgattgataaaataaaataataaatttaattattggattgccaaaatccacgtatgaaatcaataaccctcaacacgtattttaggctaccactgtaaatgtaaaatatgatgaattttttatatatctttaatacatattataatttattataatttaaaaaaatgaataagatttatatttttattttttcttatttctatgagtattcgaccgctattaattccggttttggagaatttataaaaaatcacgaagctatataacttgtcaaaagctatcaaaataaagaaattaaaacattaaaaaagcttcatgaacaaatgcaacaaaaagatattaagataagtttttgtacattaaaccgttacatgcataagctaattgttgtttcaggtctcgttcatttcgagatttggcattttcagtaatgttttcagcagaatttggtgtgcaaatcaagaaaattagaagaataatttttattggaagcatttttgagactcatgatggaaagaccatattgttacttatatatatatacccattttttgttttattcaacatttcattctcatcgaatgcaatttttgctcctaggatttcaagccattccattttattttactattttttcaattttagtatgaaatttcatgccattccttttgtttacctttttttttgaatttttagcccatagattaagccatttttgctcctagaatttcagccattccattttattttattattttttcaattttagtatgaaatttcatgccattccttttgtttaccctttttttgcattttttgccataaatgacaaaagatatttatgcaaaaaattaaaacaaaaatgacaaatttttatttgttctttttaaatttatcttgaaatataatggtataaaataaatttaattataattaattcagtgacacgttctatataattaaaattaattatttaattattcactgagattttttgtggatcgcccacactgagtttttttgcggatcgcccacactgagtttttttgtggatcgcccacactgagattttttgtggatcgcccacactgagtttttttgtggatcacccacactgagattttttgtggatcgcccacactgagtttttttgtggatcaccaacactgatattttttgtggatcgcccacactgagtttttttgtggatcgcccacactgagttttttgtggatcgcccacact

SEQ ID NO: 29721 - DNA, 1172 bp, Heterodera glycines
aaaagataaaaaggggattttagtttcactcacttttgctggggtcggtgtctccatcggtggtgccatcttttcctccaatgacgggcgcagatcagcgatcattgcgtctctgttgcggacctgcagtcgtagaaagctgatcgtttgtccctgctccttcagctatttgtccaactgctcggtttgtgtcgcggcgtcctcatatgccaagtccacgtcagttgccttgtccatcgttgtcaaatccatgtgtgttgcattgtcggtagttgtaaagtccatgtttgttgctttgtcggtagtttttggacggacacgcacatggtgcctgaccggagtcgctgacaatggacttgggcttgaacgcgggccttaatttaagttttgcttctaaaatattgtttttttttgacttacgaaggtccaaagttgacgttgatgacccactttcggcggcttgggtcgatgtcccctctccatctgctgttggcacggttacgtctgctttagccctgaaaaatgcagtgttttaaaataaaattaatttgtttaattttcgtcactttttggcgtcgaaccgcctttttgagcaagctcctgccgccattcctttcgctttcgtcttgcttctgcatagaagaccaaaatggctttggttgatttggcattattgaaatgaatattaaaatttctggaaaatgagttaaatgttcgtccctttcaaaaaaaatttctagcttttaaaatttcttcaaattttgcatatgcccatattttgacctcctctatcgaatcacagttaattttttagctgtctagtttttaactcgagatcggctcttatatttttacaagggaaaatccccaaaaaattttaagttttgcaaagttttggcgttctgattactaaataaataataaacctatttgcactgagagcccaaaattgggccgctgtgtataataaatggaattaatgaatattcattgtcctaaaatcaattttatggatattttttgacaaaacaaataaatggaataaaaattgcagcaattggatcgccaaattcatgagaagcagcaacgagcggaccaattgcgacaacaaattgcacgtgaaaataacccgacgattaagcagtcggacatgcgcataagagacggaccgg

SEQ ID NO: 29722 - DNA, 1486 bp, Heterodera glycines
aaattaaatatatagattgttattgcattctgcatattatttttcaaatttataattatttttgatttgaaaaattttttataagatatatttgagtttgtttaaataaatttttcttatttttcgaacaaatatgctttcattaagatgtggaatgatgatttagaaagtcacatttaataggatttaaaatttataagattgtacacatgttttctttaatggttactattctttgcagcaagatattcattaatatttcattatttacatttaataaatatagtgatgaatgaagttcaatttatgtgggttgttcaatttcgccattaatgttcttcctttaaatattatattttaataccttaactgctacactattgtgttttttttaatacaaatgcacacatgtgtgcgaaagtgttcttactccagcttctgccaaccaccgcctggcgcgatcggttccttgaattcgcagatgcgtggcaaaaatttcagtgtttttttgtactaaacgcttttttcccttttcgttttagtaaaacagaaattgtttgtttcattttatttttggtttttaaatattttttttttgttttcgtgaaataaatatttttcctttctttttgatttcaatttgggtttagttttataactaattttaaatgttgacacttcatggcgtcttgccatgactatttcgagagcccacattgcgaggcttgtgtaagtaagttctcatcggagctaatatttttaaatgaattttattcagtaattattttcaaaatagttcgacaatcattttgaattggcagtaattacattgccgtcgtgatttgtgacggtcggctttggcggaaaaaggctattatgttagtttctttttttttgtttataatttattgtatattttatgactactgtattttgttagttacctttttagaaaatatatattagtgtttaatcatattttacgataaaattaaatgttaatgtttctttcaagatttccaatccaaattgaaagtagtataaaataaaactaattaatttgtaaataatcaataatttttttttgattaatcttttgttgattgattcataatcttgggatttatgtatttacaaaattcaaaattcacatttaaataatgttttatatgtagaaaaatttattttacaatttctttagacaacatttcgatttgacgttctatttcagacatatgacgtttgttagcagaagaggtagttattttgtaatttttcaaaaaatttatagtttatgtaatgtttttaaagttttttcttttatctggaatatggatttaaattttaaaatgtttagtttaagtggcaaaaatgtaaatgatttagtaattttttaattaagttttttctgttaattattaaagtaaatttttatatatatttatttttttaccagttgaataaaatgtatttttatcgacctgca

SEQ ID NO: 29723 - DNA, 767 bp, Heterodera glycines
acaagctaatgtgataaaacagtttaattcttttcctttcagtatccctgcaaagtttggggcgcttctgataagtttctgaaaaaaaagttaagcctaaactttttggcctgtttaaaaaggaattaaaaatatttaaatatttattcatctccctttttgataatataagagtcagagtgccttattcaacttgtaaataaattttggtgcgtttcagagcagtttctgaaaaaaaatttatgaattaattttgcaaaaataaataaataatgaaccctcctccttaataattttcctgcgcccatggtactcactcggccgcttcgcggcctcgaggggtccttcggcccacccccgcggggccttcggtcctcctcggcgtgttctcggagaagaaggccggacagttcgaggcggcggcggagttaggtgagaccggccatggttgcagatgcggaaacaactgcaagtgctgcccctggaactgatgatgattggcttcttcctaggagaaggatgaagcatgctgctactactctgattgtcttgcgtgtgatgactgattgaacaacaataaggatgagccaagttgatgtgagtatcgctttggctccatctccagcatgcatgtgtgtgttttgctactataccttgtgatcatgtatgtgtgaatgtgtgtgtgatgatcgatacaaatgaaatcatgtatgcatctctgtatgtgctcatgtgtctttggaatgaacagaccagagcgatgaata

SEQ ID NO: 29724 - DNA, 1533 bp, Heterodera glycines
  misc_feature (1157)..(1158): n is a, c, g, or t
attattttgagttcattcccatgcactcattcattcaactgtatatcataaacatcatctcataacaatgaaaataacaaacaattcgttttgaaaaattcagcacatgagttatctctaaaacatgagagacaaagtagtttgcatctcataacaatacattttaaaaaactgactaatttcacttctgtgtaacactattgttttgtcaaaaaattgacacatattattgtgtcacacaaagtcacacaacacactattgtctaacataaagcacacaccacactaatgtggttgactgcacactaatatctggcataaaccacatacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttatttgcatgacacacattagtgtctcacacgaaagtcacagaacaaaccactaatgttttatcaaaagcatgacacacattagtgtctcacacgaaagtcacagaacaaaccaaagatatgcatttctatttcattaaaagttcaaataacattaagcataagcataattatttcacgtaaagaacacaaaaacaaaataaacaaacaaacaaacaacaaccactaaatcaaactcaaacaatatactgataaattttttcgtttacaaaaaacaaatttatataacaaataacttaataaactatgaacatagataaaaaagcaaataaataggtacaattttaagaatgtttattgcaaaacaaattgaaaaatcaaaaccattttcattttcaaatcatttaacgcaaaacaaatacaaaacgccacgccaattcaaaccatggcggataaccacactcatctttattatataagataggaaaattctcactgaagcgaaaacagaaataaaaaaactctcatttccctttcttttattaaaataaaaaatgggatgtaaataaggaagagatgcgagacaaattttcaattgttctctccctttcatttcttttctcttatttcttttacttttccacttaatctctctttttccnncactcccctccctcccacacaccacgcacgcgtccaacagactgctgctgcacagcagccacagcagcacgcgtctgttcactgtctgcccctcccatctgccgctgcccgcatagacagacagtcatacagtgcactatttcccaccatccctccctctaacctctacatcctaggaggagaaatcttttaccttctttttctgtgctatttcttttgccttcttcttcttcttcttaactatttattttcgtctcttttctttatattctcttctttttcaaaacaatttcttttcatctcttttcaaactcatttttaacgcaaaataataacaaaacgccacacaaattcaaaaatccgtacatacagaca

SEQ ID NO: 29725 - DNA, 842 bp, Heterodera glycines
  misc_feature (8)..(9): n is a, c, g, or t
tgcaggtnncggccacgtcttccatcaaccgccactcatctttcaattgcaatatagtacacaaacactttcaaatatctttcaaacaatttttttatagtttctaaagaaaataaaaagtcgtttttttcaacaaaaaaaatttttttctcagaaacctctaaatgaaaaactgaaaaacatttttttgaaaaaagttttccggagggagggaatcggcaggggctatgcactctttggcggcaacgaaatgatttcgaccggacaaaagtcacgcaattgcatgatttttaatttagcctgaccaacttggggcccatgaacagaggatggaggaaacggcactgagtttggctcggttgcgcgagaaagcgccgccgatgaaagcaaagggaagggtagtccacgagtacttctacaaagagcgattcttggaaacagaggcaaaaccaaccaattttttgatgactaattaatttttcagaagaatcgttacgccgtgtacgtctccattttgaggtgctttgaaaggattcctttaaagtgaatgaaaaatcactccgaatagagacaaattgacccgtgcttcgtccgtcctccgttgtggcggttcgttcgtttcacacgcagtgcaaaacacttttaacccctcagtcttcgaaggtgaatttcacattgcttggccatttcggccggaaatcattttattatttgaagaaatgagtcgcgggggtcgcccgtgcagtagcgttacaagcacaatggacacagcggaggaccaaaacgaagacggcacaaccgcaacgaccacaacggctgacattggcacggcaatctgaaaa

SEQ ID NO: 29726 - DNA, 1330 bp, Heterodera glycines
gggggggggggcgaagccccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttggtttcggggcagtccccccgaaccgatgcgcccatatttatggggagagcgaatccttcgggagtagcttccctatatgctgcactttaattctgcgatggattttggctccccataattgtttgagtaccccaaagggacacttgaaaaaatcgattgatttttgttttcggcgtcgtccccccgaaccgatgcacccagatttatggagagagcgaatacttctgcaatagcttccctatagtctgtactttaactctgcgtatggatattttggtccccataaatgtaagagtacccgcaacggacacttgataaaatatatctttttggtttcggcgcacacaccccgaaaccatgcgcatagagctatagagagacggaatacccctaagaaagatgtactcatattctgaacattaatacagcgctgctaatttggtccccctatttatgttgaacaggatgtttgacgaatataactcttcatgtctttaagatagaactgtcattgctattcctgcaaatatggagtctagtcagcccaatcgattgctattcgaa

SEQ ID NO: 29727 - DNA, 457 bp, Heterodera glycines
ggcgcgaagcgcccgtcctgaggccgcgaagcggccgaattaaaccttaaatataaaaaaggcgcgtaggaagccgcgcatgcactagcaacgaagtcctttgcgcgaagcgctcatgtcagcgcccgtccatacatataaaaagcatactgcctacacaccgagcaatcactgtgcaaagcatactgtctacaccgagcaattactgcgccgcgacacgctagtttatattaccatagagaaaagttgcatttcgtttcaaaaaacaaaatctcccggccgaaggccgggagcgccctgaaagtagtggaagggtcttacaactttttgaggcgcatctgggaaaaataagggttttccgctccggtggccaactgagtcccggcggctaatttctcacttttgcttgcgtttgatggcccataactttttttctaaaactcgaatcaaaaaatgc

SEQ ID NO: 29728 - DNA, 2440 bp, Heterodera glycines
  misc_feature (73)..(74): n is a, c, g, or t
  misc_feature (76)..(76): n is a, c, g, or t
  misc_feature (86)..(86): n is a, c, g, or t
  misc_feature (128)..(128): n is a, c, g, or t
  misc_feature (2365)..(2365): n is a, c, g, or t
  misc_feature (2378)..(2379): n is a, c, g, or t
aaaaagtgcaaaaaaactgatttttttccctagatttttttatcattttttgaaattagaaatatgttaaatnntnaataaaatgnatgcttaagtacccattcttaaaaaagtgttttttgatctgnaataaaattataaagtacattacgaatggactaaaatttaaaaaattaaataaattatagaaaaactggaaatgtttatatggaaatgtattctcttcaactcaagctaaattagggaccagtattatgcttagactttattttgtaaaatttataaacgccattaaaacgttaattatttaaataattcagagtaatctggtaattacttcgagatctaaaaaacatagaataatgtgtatttaagcataaattacttatttcaacctatttataatttaaaaaatttacaaaaaatcataggaaaaataagattttcgttttttgtactttttggaatcaacatagcaccgtttaaattaataacaaatataaatgcgcgctatgccatttatgacttgaaaaaacgacattaaatgatctaattttaacagaaaggattgcaattaaaagtaccaaaataaatattataattatcaactacacgaaaaaaatacgggtgcatcagcgaaaataatattacaattcttttgacaacgcaagatatttctcgtgggaaaacttatacaatttaaaaattcctaatgaataatacaaatattatagctaaataataaaatagctcattaaaaatgctattcttgaatgaaaaatataaattgatttttattcataaaaccaatgtgttaactgagaagaaaactcgtcggtaaaaaaataaaaatatacttaaacgtcaatttttcaaaaaagatgaaatataatataaaagaataaatgtcagaagaaaatcaataaaatatttaattccatgaaccgaataatgcttctgaatgtcaatttttttttgtagcatcgtctcatgaatgtatgaattaagtattaaattttaaataaattaacaatatttaaacagcacaaaaatattatattgtaaataataaaataataatgaagtggacattttatttataaaggagaaaaatagaatcgaaaaacacgtaaaaaaagtttatcatagataaaattttcagaattagtttatcgaaataaaacattttaaattgcaagaataaaaacccaaactcaaaaaaatattcaaatccattaatttgaattaaaagcaattaatattaagctaattgcgaaaaaattataacttaacacggataattagttgctaagaactagaaaaacacgaaaaaataaagcccaaaaagatgaatttatgtttgaaaaaataacatcaaccttaaaaaaatatgaataagagaatgattacagttttcaagaaaataaaaatattattcgtatacattttaagcacataatcatttaatatgatttaaaaagtcaatcattaaataagaatttacccaatttttttaagttgagcattatttttagaattaaaaaggtaaaaatcttataaaatcaaataattgtcataattggaaaaaactcttttgaataataaccagtgaaaattttgtatttggggaaaatacattctttcgatttaatttaatttttaataaatagttttagtgatcaagagaattgaaaaatgcgtattaaaagaattgataaaaatataatataataatatcaaataaaatttttgctataatataactttaaagaacagcatagtagaaccaatataatgaaattagtaaaattattaatattccacaataattatttctataaatatttattaaactctgtcataaactacaataaagttgcaaaatcaaattaaaatatcctattaataatacttaaaaggaataaattactgacttgataatcgaataaagaatttcaaaaaattattttaaattatcagatttaattaaaaaactaataaaattaaaagatataaatatatcttataagtatcaattaaatgaaaataattttcaaagattagaaaacaaaatcttatattaaatatgcttttcttggatttcttcttgaccgataataacttaaaaaacaaactataatcatatttttcaccaagggaatattgcaacaacacgaagataacaagaaaatacaaataaatggaaaactggtaataaattatttaaatgatttttaacaaaattataaaataaaatttaaaatgaacacccaaaataaaaagcaatctgacaataatgagggcaaaattaacgaatttaactagaaaataaagtttttatataaaaactagatacagaatttanaaagaaaagtttnnaatacaaggaattttaatactaaaaatattatacaaatttttatcttgcgaattcttatta

SEQ ID NO: 29729 - DNA, 944 bp, Heterodera glycines
ggaggaggggaggaacgagtttgttgtagtcgttgttgtgtccgccggctgctgctcgtcgcaatgtccaccccacagcaaaaagatgatggagtcaccaatcaacacccagaaaatcctcaacattatcgacaaccccccccccccttcccctccccccaaatgcccaatgtccggcccaacaaatgatccatccttcgcataaatgcggcgatatttgcaggataagcgatcggctgacaatgagttactaattgtggggaatatccaaaagtaaaatgaaaagtgaaaaaaggaaaaatcaaacagaaggaaaccatattttgagtttaatcgagaaaaaatgagatgaaaggatttgcgcgatgggtcactgcccccgcccctccaatcccttcgtttgatcagccgatcactttgctcgtttatcccccccccttccgcctgatcagccgatcccttttctggtcagtgctgtgatttctctgctgtcattccgttccattaccccccccccccgttggttttcctctcaaaatgcgattttgttcatggattgtggtggaaagccctttcatgcttctgtttggtgggagtatggcgctcgttagtgccgccaatgacccggatacacacgcaaatggtggggagggggggggggggggaatcgaatctatgaagtttgaggggattctgctgttttgttgaatcggagcacctgcgctttttttttgggggggggggttggtagtgacgagcggtggagaaggggcaacaaaaacggagcagcgcactgagaaacgctcaaacatttcgccacggcggagagaagcaattatgcacgccttgtcgtacccattttgtgttttatggcgaaggcaaaaggtttttaaaaattggacaacataaaaggcaggcgggccatccattttggcattcgccgt

SEQ ID NO: 29730 - DNA, 910 bp, Heterodera glycines
cacgaatatttcactctgtttattgcattgatctcagtcagtcaaattttgaaataaatcaatttttggtctcgagcattgtaatgaattttgggaggatcccgaaccttgccacaaatccttggtccccatggcatttgaattttagggggatcccaatcttggcactaaccctttatgatattcattcttgcttggcaatagtcgtcctctactgctgttggccgtgttttcacccaaaaataataggcgttgctaaatggttgcggctttcggcgccccgtcggcggagtctctcctccccccggagcgctcgccgttttcaattgactgaacacagcgaggagtacggggctacctccagcagcagaggagcgagccaaaaaaccattcaccaacaattttgggcacccgagggaggcggggggaatttcgaaattggtggacggagaaaaaaggatgggacgggggacacatgaggggcttggatggacaaaaatttaccggcataacacctccagcatagggtaagggcatggcatggaatggcattttgaatgttaggccaaagaggcaaagggtgtagccaattgtgggcctaatttttttttggggggggggcggggcaaattattattttttgatttacacccaatcaaattaaacattattggtttatcatttgatagctcattgccagtgctctattatcatgtttttgaagctaaaccgttataaatagtcggccaaaaaagtgatgtgcttggttagttttcatcaaaaccattgcgccgccgggcaaaggtacattaattaaaaaaacggggcgggggggggggcaatttagggccatggaaaatgaaaattttttcaaatgcaattaattgactccacaaaaataggcgctctt

SEQ ID NO: 29731 - DNA, 274 bp, Heterodera glycines
aatcttctaccgacacgacggctcagaaactctttctgattttgtggaacttcgggtgacaaattcatcagacaattggaaaaatcccagaaacaattgaccaaattcagcctttgcgcttcgcggaagagctcggcacaagttcggactctgtttcgattcccattaaaattgtgccgattaatgacgccccgtcacttcactacggcacaaaaggcccagtcatttttattgagcccgagtcaaggtaaagcatctgtggaaaaaagcataa

SEQ ID NO: 29732 - DNA, 1057 bp, Heterodera glycines
atgagacgccgctgctgatgagatgaggtgatattgagcaaaatgaaaggaaagggagagaaaaaataagggtgaggaagaacgaatgattcattcgttccatgcgaatgtttgttttggttggcattgatcgttccgctgactcaccccccccccccccccctctccacgatttttgatttcacccgtcacagcgagtaactcattttcaatttttagtgtatgaatattaattattgagaatgtactaatagtctctaaataataattttgaaaaacccccaaaaccgatgaaagaccaacacaaaaaagttagttcgagatttcaaactaattgtaagctttgagtaatagcttttataaaataaaatacatatatttcattttagttgtatctggataccaaaccaaaaaacataaataaaatttatttacctaactaattttattattttattctaacaaatttaaatataaagttaaaaaatattttttaagcaattttaaaattttcgggcaaaaaattcaatgaatattctcattttttttagtttgccgatgccaatctgcatttatgacggcaattctaataaaaatcgaattaccattttaaccgggccattttaattctattaatggtttgtggacacaatctgatggatcactgattagaaataaaccaatgctgacatggcagtgtgttgctggcgattaatctcctcaaaaagcccgtcaaaagcgcaacgcttatgccataattctccatcttctaaatagttagaaagccctcaacaacagtaacattataatccaaaacgatcacaattatatgcttgttaatttttctgcactttcaattgtatttcccaaattgaaatttattttaaggctctgaatagaaggaaaaacacttttcataaatatggaataccagcagcagtagaacggacatagggttgtgaagatttgcctgaggcgtcagctacccctaaattagagaaagtcaaatcaacatttttctcttagaaacattgttttaataatacggaggcgtttg

SEQ ID NO: 29733 - DNA, 758 bp, Heterodera glycines
  misc_feature (565)..(565): n is a, c, g, or t
aaaatgtattttaccacggaaatattctttaatattaagtcatatgcattcgctgtgaagaaaagctaaaaaatggaagaaaataattgaaaatccaaatgaatgcaaaaattacggcgctgagcagaaacaaattgaaaggtatcatagccattgaatcttcaaaatgaatgaaataaatttagggttctgtctctgagaataaatattaaaatttatgtggaaataatcaaaagtttgcgaaagaatttgtgggcaaaagagtgagtgattcggccgatcactcatcgcattcatcgaattgttgggccccaatttgttgggggaagaaacgatggatgcctcatcatcaatcacaagaaatgagtgataaatataaataaaaataataaaacgttaatacctccgccgacgatggaatcagtgaacaatgaaatgaattggggggggggggggaaatcggcgaatgaataaacggacggatgggggggggggagggacggtgaatcatttgaggtggcaagcaaacaaaaaaaagtgggggaagaagtgggaaataaggggnggggggggagcaacaaaatgtcaacatccccccagggggggaaggggtgtgatcggaagaggagggggaggggggaggacgatcaccgatcacacaccacgcgacggatggcaattgccgaagagagtgcgcgaggagcggaccaaaacggagatgtcaatttgttgacggactgatgataatgatgatgatg

SEQ ID NO: 29734 - DNA, 63 bp, Heterodera glycines
cctgcccggcgtgccgcgccagcaggcattcgcccggctgcagtggacgccgggcgaatggca

SEQ ID NO: 29735 - DNA, 1855 bp, Heterodera glycines
ggtaagcctagaggccaaagaatggagcggggggcgttagtgtcggatgggtctgcgaaatctgtgtttagggagccgtagagggaggggggagttcaaattttaatgaatgagtatttgggggagggggaaacagaaagctatgggatatgtaagattttggagggattggcaaatatcgaatgggcaagggagctaagagtaaaagtgtaaatgaccgcattgcaaaggggggggggattttaaattctatgaatgtgctgaagagggaggcgggggaagggtagacaaggatttgatggggcgggggttaagagtagagatcggcattttgcgaaaatgcggacccggaccaggactacggactaggcacccatacgggctacggacttatgactaaaaacccgtaaaacccttactccgtataagtccgtatcggtccaagaaaatacggactacggacccgtaaaaacccgtatacgggtccgacccgtagccgatctctagttaagagagataaacaaacaaagaagtgaatgggacgacggcttaaacaagcttagcgactaagaaagtgatgtgagagtggggttaaggggggggggattaaggaagccagcgcttcgaaggatgaacttgcttaaagaaggcttcttagagcactgctggtgaaaaaaaattgaatggggttcaaggccaaagggagtggggggctaatcgactgaacaatgggagagatttttcgtttttaacggacaattgccagaggattagggacacagcggcggatttagacggttatagggtcaacttggccctaatcatatttagaatacctaattttcgtggttgacgaatttaataataatgccgggattttcaaatggccgggaccgggtcccgggttctcgacattggcgacttcagtggtaggaggacgcagaaatataaaataaaatagaacagaatgaataggcttttcagataaaagccagagcggttcgagactaaagaatactagggcatgagagtaatctgccaggagttcaatggaattcactaatttgtaatatgaagaatggtgctggggtggggagagaagggatccttttctgtcctaaaaaatgcatttttttgagtgggttatgctaacaactaaactagccgagagtgttggggccaggggggggaggcgggagcgtgttatgtaagctgatccctaccgatcacccgcccagggcgctgggaggtgacactgaatgtaagccaagtcgagggctaacgggacaagcaaaaatgatctttagcattttttttctggctttccccctaccctccatcaatgcttcatccttcttctccttttactggtgacgtccaaaaaatgcttctcgactgaaaagcatacctatcagcagcaggggtgaaagcatcattgcttagattagtagtaattggttctgcttgctgcgcgagcgaatttttcaaaattttgtgtaccgtccccttttttggcacaaatgggaaatgccattttcgatccgtcgccgtgcccttgccgggaaagtgtaagtgccgactatggtcgattgaaaaaatgtgaaagagtttgacaaaacagattaattaacttaatggtctctattatatccaatagatggaatccaagtttattccctaattaaaacagctaattacctatcccacccccctaatatggaagcttatcatatgttttcaatttttttgaattttaaatatttttttgtcaaattttattttaattttagttgccggggggcttttacttttttctaatactatatacaattttaatggcgttttaacaaataaa

SEQ ID NO: 29736 - DNA, 670 bp, Heterodera glycines
agaattaaagtacaggctatagtgaagctattccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgt

SEQ ID NO: 29737 - DNA, 989 bp, Heterodera glycines
caaaagggaaattgtctcaacataaactttttccaaattaatccttccctgtttagacacatttctaaacgctcaaaatgactgatattcaggcatatgctggcccatttatagtgaatgacgtcgtttcctattttttaaaggtttttattaccgtttttatgcatatcatgtattaatttcttccttgtttttattttgccacgtttattttgttaattggtaatttttcaggatggcgtctggtactaccgaaacgcgttcattccgatcaatttggagtgcaagcagccaccgccggcggagattgtcaaagagtggatggacaagtacggttccgcagcgccaaaatcgacaaagcaggccaaacaaaaagtggccacaccattgaaaaagtcgtcacacaaaccgaagttgtccagtgccgacaaggacagcgaaatgctcaagaggaagaggaagcatgagcaggtttttcaaaaagggtggtgaaattggggtttcgggatcagaaaattgttggcttcgggatccaatttttgaccgggaacccgcccgaagaataggggtgagcatctcatacaaatctttttgaactcgtattgatctattgcaatttacccgtccataaaaatttgtggattgaataattccacttccttaaagtaacattgaaaactgctatataaatgagtggaaaggtggacacagagagatcggtcaatgtttttaactgcctttttagatgctttccaattcttcaacttcatcatcatccacatccaaaccgttgcctgtctctgcacaaaaagtggtgtcgtcctcggcactgccaacgccgggtgcgccgtcgccaaacattcccaagcaaaaacagccggcaagaccctcctccgctccaacaccaaaaacggcactgtcctcaaatgctatcaacgaaactccaacaaaggtgcaactgtcaaattaactttgcaaaaaactactct

SEQ ID NO: 29738 - DNA, 1332 bp, Heterodera glycines
  misc_feature (1316)..(1316): n is a, c, g, or t
aatcttttgaattctaagaaaataaacctgtaatttttagaacaattaattctctgaagtttttaactatgtttttaagtcccaccgtgaggcgagacagttcccaaaatttgtaccacattttactgtggagagtccaagtaccttatttggacaattaattgtcaacgaacacagtcgcctttggccagttgtggaacggaaaaatgggaatatcagatggggtgcgcgtcccttcctaaaaatttctcttttcgtctaaccatcccccctttttgtgcactatttcgttttaaaaattgggaacatttttttgtttgtttttttgaaactaaaatgtaaaaaattttaaaaaattatttctgattttaaataatgcttctgtttcgaatcttttgactctaagaaattaaactgtaaattttagaacaaataattctctgaagtttttaactatgtttttaagtcccaccgtgaggcgagacagttccaaaatttgtaccacattttactgtggaaagtccaagtaccttatttggacaattaattgtcaacgaacaaagtcgcctctggcctcttatggagcagaaaaggggaaatatcagatggggtgcgcgtcccttcctaaaaatttctcttttcgtctaaccatcccccctttttgtgcactatttcgttttaaaaattgggaacatttttttgtttgtttttttgaaactaaaatgtaaaaaattttaaaaaattatttctgattttaaataatgcttctgtttcgaatcttttgactctaagaaattaaactgtaatttttagaacaaataattctctgaagtttttaactatgtttttaagtcccaccgtgaggcgagacagttccaaaatttgtaccacattttactgtggaaagtccaagtaccttatttggacaattaattgtcaacgaacacagtcgcctttggcctcttatggagcagaaaaggggaaatatcagatggggtgcgcgtcccttcctaaaaatttctcttttcgtctaaccatcccccctttttgtgcactatttcgttttaaaaattgggaacatttttttgtttgtttttttgaaactaaaatgtaaaaaattttaaaaaattatttctgattttaaataatgcttctgtttcgaatcttttgactctaagaaattaaactgcaatttttagaacaaataattctctgaagttttgaacttggctgttcagtgtttctaagcccaccgtgaggcgcgacagttccaacatttgtaccacattttactgctggaaagtccaagtaccttnatttgtacaattaatt

SEQ ID NO: 29739 - DNA, 1096 bp, Heterodera glycines
ggcggaggcgaccaacaccggtgggacagcggcggatggagctcgtgccgcggagtagaagcaatggaagaacaccaacaatggataaatggatgatgacgaatcggatgagaagcgattttccagcagaaattaaccgtatttttgtctccatcataattatatgttgagagtggccctctttctccaattgtttgtgttgtacaatattcctttcctataagcccgtgagatgcttgccacacctccgttgtatgaattccccttatgtcagtcattctgatgttgtattgtcgatttaatcgctatgtgttgtctctcaattatgtttgctctaccataataaacgataaaggctcttctgtgacaaacagtggaaatgaattggcactttatatagggcttatatttttaggcttttctctttgctcgttttttactaaatagcaaaattcgttccattttcattcaaattttgcattgttttcggattaaattttacaatggcacttttcgcaaagcaaaaatttccgcctgttaacatggtgaaacccactaaaaaccccggaaactggttttgaacccaaaataaaaacattaaattagggacccccattctttacgattgtcgggaatttcatatagggagcgaggcgatcatgaaaataaaattggataggacgaaaaaattgggtactttccacacgaaaatttttaaaaatcaacaaaaaatacgcacaattaagaaattttagaaaaaatttatttaaataaaaaaataataattttattttggcatataataaaaatttaaaaattcgaaattgcatatataaattttgaaattttgaaaatgaaattttttgcaattgtctaaaatgctctttacaggcgctatattaaaagtgggcctttttgaaaattttttcaaaatgggggacccttttgttttgcaaaattttttttgtgatagtcataaaaatttattctctggggtttttggggtccccgatcacgaatccttcaattattttgatcaattccgatttcctaatctaaatttgaacaaaaaatcataatttgaaaaattcaaaat

SEQ ID NO: 29740 - DNA, 980 bp, Heterodera glycines
  misc_feature (49)..(49): n is a, c, g, or t
ccttcgggggaccgtgccgggtgccgcggggtaagccatcatgggtcgnttcatcacggcaccgaaccttttggctactttcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcagtgtccgtttggggtactcaaacaattatggggagcaaaaatccaacgcagaattaaagtacaggctataggggagctattccggaaagaatcggtcttccccataaatctgggcgcatcggttcgggggggactgcccccgaaaaaaaaaaaatcgattttttc

SEQ ID NO: 29741 - DNA, 1021 bp, Heterodera glycines
  misc_feature (905)..(905): n is a, c, g, or t
  misc_feature (963)..(963): n is a, c, g, or t
  misc_feature (984)..(984): n is a, c, g, or t
aaaaaattaatttaatataattttttatttattaactcaacaaaatattttaaattaattaaaagcattaaaataagcaaaaaataaatagaaaataatgtacaccgtccggattcgaacctgccccccccccccctcagaacatgtcccagaatccccaatcacacagggattctgaggtcttgacgatgacaaaagtaaaatctgatcacgtattcgtgatcagcgtcctaaattggccctaaagacatgttttttgaaggtttttaatgaaaaaattttttcactcaaaaatcctggtcacccccctttggtctggaatcccaaaatcacttttatttttataacatttttcaaaaaagtgataaaaatgtgaaataaaatttatataatagagcaaaaaattgcggatttttgtagtattttacttttagagtatgacttttcagaaccgagttatgaatttttttctgaaaattcgaatttttccagaaattctggaataactttttttcttttgaacattataaaaccaaataaatctcataaaattctcccgattttttgctatttttaaagctttaattcacttaaattgaccagtcctccattgagttatgaattttcaaattttaacccaaatttccaaggaccaaaaaaattaaaaatattttcgaatttttaaaaaattccaaaaattctgaaacgtaaaacaaacatcagattcgtgctcagcacctcaaaataccccagaaaaaaaattttcacccccattttggcccacaaaaaaatttccgaaaatttctagggggcctagctcgaaaaattttgaaattttccaaacatgtagtacatcattcgatagagcttaaaaagctctacaattttgctctaaggcaattttntggataagatcaactcctgacgagttatgggcccgggactcaaatgtcccgcttaggnccaaaattttttctatttccngaaaaaaatcgaaattttttcaaaatcccaccaatcg

SEQ ID NO: 29742 - DNA, 1075 bp, Heterodera glycines
gaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttagggtaatggaaaaaattttgaagaggctctgcggaacggattagcatcggggttacgagatagaaaattgtcctaaaaagagatagccatttttctgagaattaattcacaatttccgcagctcttgcggtaatggaaaaattttgaagagtctctgtggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaaggggctctccggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaagagatagccatttttctgagaattattcacaatttccgcagctc

SEQ ID NO: 29743 - DNA, 1337 bp, Heterodera glycines
  misc_feature (135)..(135): n is a, c, g, or t
caaattttgtggtattcgaatgcgctagccgagctctacattttcaaatgtatcaacaaagggtctatctccactctctggcgagttatgtccagccaaagcagagtgggccataaacacgaattttttaatctntggtatttcctctattttgagcctgctctacatttatgtattgtgccaatatgcctattgcaactgaaatttatgcaactttcccgacaaattgttgagataattattctagacgatttttttatatctcaaagcttaactattgcctttttgtatgataactggtagatattgggagtaaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagcttttcttgaaaagttttttcccagaatttatacagctttcccgacaaattgtttagataattattctagacgatttttttatatctcagtgcttaactattgcctttttgtatgataactggtagatattgggagtgaaaaaaagtttgtttgtgactatttacaataaaaatttatgcagcatttctaaaaaggatgtaaaaataatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcccttacattttgggtttactttattatgctggcccataaaaaaatggagtttttccggtgccaaatttttgtgaattttctttcggcccgtcataagcggattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaattgaaggagcatttctaaaaaggatctaaaaataattct

SEQ ID NO: 29744 - DNA, 1467 bp, Heterodera glycines
caaataaaacaaatggctggagaatttgaacaagtgctttttccattgacagcatcagttgaataaataatcaaaaaatgaatgattgacaaaagtttattatgccaatcaaaaaatgggggcggggggaaattcggcgctattatttttcaaaaatatttgttgctgaagaggaattgaactttttttcgccaagaatgatcaataggctttttttgatcaattttggcaatgtcggggaatttttaaaattggaaatggcacaaaattttattacccaatttttaaaaattatttctttatttaaatggaaaattaatctaaaaaatctgacagatgttttttttcaatcaattttttttaaatgttaattttttttaaactttccagacttttttttaaccgctcttattattaatataataattattattttttcccattaaaaatgcttttcccattactattaattaatgtttcaccttttttcttctttcgcttcttccattgcttaagcatttttctcccatcgctaattgctttttttatgaatcataaaaaacaattacaaaaatgggtttagaatcgaaacgaaaaaagagttttcaattttcatccaaaaaatgtcattcagccgaaaaaatgccattgtcaccggtgccggcgttggctgcattctgacgctcacattcaccaccgtactgtttgccacgctctattacaatgcggcaaatttggtctatttttgccggcattgataatccccgtgttgtgccgccccacagattttgccattttcggggttttggtaacggaaaaaaaattggcaaatttaccgattttttagacaaaaaacatagaaaattgaaaatgtgaaataatgaattttattggcattcatcggccaattgaatttttgatttaataacaatgacataaaaacagtaataatgtgaaattaccgtatcaataccgaaaattgtatttgtccaaattaccatattatttatccaattatatttttcttccactcccaaaaaataaaaaatacaagaaacttttcttaaaaagtatgtacaaaaacaaaattttaattcttttttaaattttacgaacagtttacaattttgaatttattcgttaaaacattttaattttttaatttcaaagtttttttttttacaatttttggatactcagaattttaaatttctattttttttattttatgaaaaattcacaatttttgaattattttcttttaaaaatttctgttttttcatttttgggggaccttcgctcttttcgcgcacgaaaaattcccaaatttccttgcccaggtgtccacgaggttgccaaaatgggcgcccccctaccacagcttattgggcgagtactcagcagcggcggtggcggcggacaacgaattgtgctccgaaattggccgtgacattttgctccaggcaa

SEQ ID NO: 29745 - DNA, 1052 bp, Heterodera glycines
ctttgtcaccaatccaacattgttggtatcatgcgacatctcttaatatgctctattaacctgcaaaatcacaaaaaatttcgtcaattttgaacaagtttatgaccaaaaaggttggaaaatctggttttttgaattcttctggccatattttttttgaaccttaatgaaagttttaaaaattttgctactaatagaggaaacttagggtttttgaatgataccaacattgttgaatttggttaacaaagaaaaaagttatagctgaagagaggggaaaggaggtagagacaagagagagaaaggagagatacagaaagagatgagaggatgggaaagagagtgaaagaaaaggacagaagaaaagagataaagaggcaaacaaagagagagaaaggaggaaaggtgagagagtgtgaatgaaaaaaagagagaacagagggagatgagatggagagaacgagagcgagagcgaaaaggaacaaaagagagagagaactaaatcgagagatgagagagagagaagagagaagagagagataaaaagagagcagccttataagtgagagagacgagaatgtgaaaaagagggagagagaggagagggaggggagagaggagaaagggagagagacaaataaagagctaaaggaagaaaagagtgagaagagagagagagagagaagcaaagagagaggagagacaaactgagagagaggagagagaaagagagaaaaaacgaaagatacaaaaataagtagagcgcaggaaagggagaggagaaagagagaaggtactaaaattgttccctagcaagagtctttttcgtgcaattttgaattttagcgcgtaaaaaataatgtaaatacgctatttggcgaaatgaaaaataaagcgagaaagatagcgatagagcagagtgaaaagagagaataagataatttcaaaaaaaaattttagttaaaaaattccaaaaaaactagttgtgtacctaactaatttttgaaaaatagattttaggggctggcagcacatatgaaaagtgatcaggg

SEQ ID NO: 29746 - DNA, 1121 bp, Heterodera glycines
  misc_feature (1101)..(1101): n is a, c, g, or t
atgcttattcatataattatttaactgtcccataatgtttctttaaaaattttagacattgcaattttgcgtacttttccaattttttgcaaaattaattcataattatttttttcagaaagtgctcttaaacgcacctaattttatttacaagctattttaggcactctgatgctttttctatcaaaaagggagatgaataaatttttaaaaatttttaattcctttttaaacaggccaaaaactttaggcttaactttttttttcagaaactgatcagaagcgcaccaaactttgcagggaaactccccggtaaaggactaacttacactgaaatgagcgccgagctagctgggtttaaaaattttttcaaaaatcaaagtctttcgtttttatttaattatttattattttttgcaaaattaattcataattattttttcagaaagtgctctgaaacgcaccaaattttatttacaagctattttaggcactctgatgctttttctatcaaaaagggagatgaataaattttaaaaaatttttaattcctctttaaacaggccaaaaagtttaggcttaactttttagtgaaaattaatttactcatttttcgagtagtgatcagaagtgcaccaggttttgcaggagcctaaaaaggtcaaggaaaggcgtctctgcgttgatttagcagtagtacctatgaatttaaatttcctatgaatttttaaaggttcacaatttatttattttttgcaaaattaattcataattattttttcagaaagtgctcttaaacgcaccaaattctatttacatgttaaataaggctctctgatgctttttctatcaaaaaggaagatgaataaaattttttaaaatttttaattcctctttaaacaggccaaaaagtttaggcttaactttttagtgaaaattaatttactcatttttcgagtagtgctcagaagcgcaccaggttttgcagggtaacagctgagaataatgcttattcatataattatttaactgtcccataatgtttctttaaaaattttagacattgcaattttgcgtacttttcccaattttttgcaaaanttaattcataattatttttt

SEQ ID NO: 29747 - DNA, 1209 bp, Heterodera glycines
  misc_feature (1133)..(1133): n is a, c, g, or t
  misc_feature (1138)..(1138): n is a, c, g, or t
  misc_feature (1180)..(1180): n is a, c, g, or t
  misc_feature (1189)..(1189): n is a, c, g, or t
tggaaaaagagcaaagtttgctaattgcagcaaaaaatgaatcgacggtaagcaatcattaaaaaaatgtagcaaattttcatttcactattttttcatgtttcagttgggtgtgcaacgacgtgtggatggacattttcccatcgtttgaccacgctcaacttggcctcaaaatggcattgctttcgccacgttttgatgcgctggtggacaaacattttgacggcaaaacgcaatttacgatttggaaagcaattaaaattcgcaaggacaaagatgaaatgccaaaactttttgttgaaggaaaatcggagggatttccattgccggaccgtccgctgcccaacaaaatcatctttaagaagcttcggattgagtaaatccattaattctatacagagaccaatatattttttggttaatgcatctcgtacaataaaaatttacaaaaataatgcctaagccattgtacaagttgtcatgacacctatgttttaatacaactgattatatattcttcaaatttctccccttttcaggtacattgatcacttcgtcatcgaatttctccgttccaatcagcagttttgggacaaaggcaccacattgtatatcactgtttgggaaaaaaacgaagataacaaaccgatttgggatgtttttgtcgctgaaatatggccactttttgcgacaaacatttgccaattgtgctttgccggtgccgaatttttggactatttgcgtcgactcatttcgccaacaattctatccgatctcaatcgattggattcaatcatttcttgtcatctgttccccgatgtgcttgctgatgatgatgattttgatggaccaaatacgacttctgccggccaagcgttggccaaatggttgcacaatccgagaaaagatggccaaccaaagtcattgcattgctgggaattgaaggcatccacaaactttgaatggctcaccaatttcaaggaggtcggtttgtcgaaacatttacatatacaaattttgatttttgtttaggtttttgtccgtgcccgcacttccgtcagttacactgtctacttaaattttttcgtctctacgccaattgaaccatttgaattggtgaacgaacagactanagaanagctgacattgaaggaagaaatccgtgatggctcttctcgtntgtggctgntgaagcgatgtccaattact

SEQ ID NO: 29748 - DNA, 1028 bp, Heterodera glycines
ttgctttctcagaagaatagatattctcagaaaatggctatctcttttttctacaccgttgtacatgtgggttttccccaaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaaggtcggtttgaaaattgctgtctcagaagaatagatattctcagaaaaatggctatctcttttttctacaccgttgtacatgtggggtttccccaaaaacgcattactatctgcggttgagccctacaaaaggtcggtttgaaaattgctgtctcagaagaatagatattctcagaaaaatggctatctctttttttctacaccgttgtacatgtgggttttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaaggtcggtttgaaaattgctgtctcagaagaatagatattctcagaaaatggctatctctttttttctacaccgttgtacatgtgggttttccccaaaaacgcattactatctgcggttgagccctacaaaaggtcggtttgaaaattgctgtctcagaagaatagatattctcagaaaaatggctatctctttttttctacaccgttgtacatgtgggttttccccaaaaacgcattactatctgcggttgagccctacaaaaggtcggtttgaaaattgctgtctcacagaccactttccctatccgggataggttctctccccaagtcccccccgggtccaaaaatttttaaggaaaaataatcttttgtatgaaaatttta

SEQ ID NO: 29749 - DNA, 1121 bp, Heterodera glycines
tttcgaaccccggaccagaattcgaacaaagtcgaaatttaagattttttgaattttacttctatatatgttcgaatctgcatagaatgactcatttttgctcttaaaattgcctgtgatttattttctgcttattttaatcaattttagattaaaaagtgtgaaatcaaaaatgtgaatttttgactttttgttcaattcgagtcctggttcgaaattggtcgaaatggatgtcatatttgtgcttagcgcatcaaataacccataaaactgtgtatttttggtttttattctttttttgagaccaataattttaacaattgcaaaacatggaacttgcccaagtgtaatggttgggatctgaaaaaactgctcattctttatcgaaaattgttagtttaccgtcgcacaccacatccgagctttccatgtcacggtcataggcgggagctccaggatcctcagggtcttaattaagtccacatagaattatttaaaattcatccatcctgtaataattgtaagtaaatccaagttgcacttattattcacatacatcgcattgtttgggaaacatttcggtacatccaaagttggcgacatccgtcagcaagaagatattgtgccaatcgcatcttaaaaagtgaattgttttgttatttatggattgcaatgcacatcgttgacgtcgcgatttgcatcaaatcgtgccctcattaagcacattcggaaccgacactcaagcctaaacgaaaaaactcggaagtattataaatttctaaaatctcacaatttcttcaaattcaaaacttacaagtcttgcgcatgccaggattgagtttcacgaatcgcgcgtttatacagacgcataaccttttgacgatgagacaaagccttggtaaaataaaaggccggtgcttccaatgaaggaattgtcattttttgctaaaaaaaattgataaaacctgaaaaaatccgagtcaaaataatcaaacacatcttcataagtcgaaaaactaaaaaaatgaaacctctgaattaaatttaagaaatttggcaaaatgtttgaatttaaagtttctgaagaaaaattgtctaaaccggaatggaatcgggatttt

SEQ ID NO: 29750 - DNA, 1103 bp, Heterodera glycines
ttaatttctctctctctctcgctctctccgtttctgtctctctatctccctctatcattcgctgctccgatcatttttgctgatccctcactcaccgagttctccacccgtttgcgctccgccgccgcctgtcgcttgcgccgctttgcgcccgccgcttccgagtcgacctcgtccgccccttccgcgtccgccgccgttcccttcgccgtccctccgccgccgcttttcatctttttggctgcttctttggctttcttctctttgatcagttcacttgcactgatatgtttcatttcgttgtgtcgcaatttgtccccaattatttcctccgtcacaaaatttgtcaatttgacgttccaatttgagtccaccaaacaattttggaggcacaaaaagccatggcagcgcaagtttgaggagtgaagaaagaaaaggcccttaaaagtggccaaaccgattaaaatggcatttaatgggataacatttgcccaatttaatgcgaattcaatcaatgcgtacactgtcattgtataaaatgctaaaattaattttgttagctgtccaatccctaatgtttggttgaggaattcaatctgatcagcagccaaatcgttctgatcacttgccttgacaacatctttggcgaatgacacttggaagttgcggctgatcttcagctcttcgttgaacagcatgtccttggtgattaacagataagcgatcgctgctcttttgactttgtctcacctcgagactcccgcgttggcagagaagccaaaggacgatgaattcgttttgctgattgaacgaaatgccgtaaaactgagagagagagagagaagggcaattataatggatgatgcttatcagttaattgaagcttttaaatgtttggaatattttgctttcatttgaaattctgccacttttgtctctcattttgtgccgctgttttccgatcagtttattgtcctcttccccaatttttgtctgatcacttttttccctttccgatcgttcgctgactttgttcagattttcgttctccatcagcttcatatcgttcagccgtgacaattcgtttttgtgaaggacaaact

SEQ ID NO: 29751 - DNA, 876 bp, Heterodera glycines
tcataaatgtttaacaattcagcataattaggtaaatcagcagcataattgttacgtctaaatattactctcaaaaaagttttttggacattctccaatttttctatatccttttttaaataaggattgaaaatgccaagaaacaaattcgaaaaataaaactcacgtctgataccaaaattggcacttttggacgccgttttctcctacagtgactaattttggcactgccaaaggaagcgaagtgccattggggggatcaaaactaaaacaggaatgattatgagacctttggaagtcttatttttatttttgcctcaataatctgcgattttttgctaaaattggcggatattcagctcgaattaacggcggttcgtctgtcagcgggtcacctccaaattcggcactcacattcacttcgcgaatttgccattctgggcattcaatgtctttgtcattagacgagtgtcccgcagctaaaatttataaaaatatttaaattaaaaaaataaatttaataataaatcacttactggcatcgtcagaagaggtaccaccttcgaagacaagctttgtcacacactgtttcaattcaccgtgaaaatcaacagctcgccaaacgatttccgtctcattgccttttggaaaaaaaaacaaattaaaagggaaataattttaaatttaaaaattattttttcaaaaaattattagaaaagcttaattcaaataagcagctaacaacacctctgaatttatatgcttttgccgaaatgttcatatttactgcactgatttgaatgtgcgggtcattgtcaactaccgtaggcctaaattcggtttttcgagtcaatttcaaaaaaaacaacttgacat

SEQ ID NO: 29752 - DNA, 1681 bp, Heterodera glycines
  misc_feature (1570)..(1571): n is a, c, g, or t
  misc_feature (1611)..(1611): n is a, c, g, or t
  misc_feature (1643)..(1643): n is a, c, g, or t
caaaatagtgatttctagtgacgaaaagtgacgtccaaatgaaaaaattttaacgcagaaatgcgttttttgagctcctttcttcaaaacaattgagcaaaaaaaagttttttcaataaaagttgctgccctaataatgatgatacattgtacaacattttccccccaagttgtctttctcccccatcacccatccctaccccattatcatttttaatttcatcttctctctcttttcggttgttttgctctgccgggggtatgcacaacaactgacagctttgctggagtctgtttcaattaggatcatacgtggcccacgaaaaaaaagactatccatcaacaaaaaatttttattttattaaaattaaaaacggaaaaaatttagaattgggccctccaaaaacgagttccaatcaatctataatgacctataatcaacataagaaacactcccgaggtgtggaaaaaaacgggtttttgaatcggtttaaatcacgaaaaatggaccacaaatcagccaaagaaaagattatataaaaattttcgaacaaatttgctcattggaaaacccttgacgagctaatcattacgatttacatacataataattaataacaagaagctttgccgtccctcctcacatttaaaaaaaatttttgttttcaaattctttaaaataagttccctggcttttcggagtcgctaatcatgaatgcggcatccaagtttgttttcatgatgatttaacaccaacttatgtttgttggtcgaaatttttcttatttcgaaattttttcggccctttttgattggattttttttacacattttcttgctaatttgaagggttgttttaaattattttgtttttgataaatggcaacgacatcacaaatggcattggaaccacccattatggtcacccaagacacgggcatgaaaggtgcaggccatttcacatgatttccagtacatacaagtctttgaaagtcttataatttccagttactgttttcatctgtattccgggtatgcggtaaggacattttaattttgtcaaagtatgtctaaaagtgccgatggctgcccccccccttttcggcaaaaaaaaaaaaattaatccttaaaactacttttaggatatgatatttccgggcgtttttcgtgattcttattacgaatatgtatatacatgcgttaattgcgaaaattctgaatctagaatctctgggaatataaatgaaaaatttgaattttctgaattttcgacttttgttgagttcaggttcggaattgtcttaaatgaatgccatatttgtggttagagacctcgaaaacatccgaagacatgtcctaaactatttttggaatataattttgccgaaaaaagtcgagggacaccatcggtatgtactactaaaatcaacaaaaacaattgttgtttaattttaatcattttgtgtccaggaagaagggcggccttattgttcttctgaagcggatatttcgagtcaaatcccgggaccctttcacgctcgtttctaatgtacagtaactaatgctaatnntaccgggggtgatgatgtaacctaaaaaccgactttttgngccaaaaacaaaacccatggcttcaaaattgngcccaaccgaaaccgatacaatgaatccaatatttcag

SEQ ID NO: 29753 - DNA, 937 bp, Heterodera glycines
gaatgccagagatttgagttccagtgattggaaagcctgagaattgagtcccagagattgaaatgctggtgggttgagtcccagtgtctggaatgccggagatttgagtcaccgagattgaaatgctggtgggttgagtcccagagattgaaatgctggtgggttgagtcccagagattggaatgccaatgaaagttggtgggttgagtcccagtgtttggaatgccggagatttgagtcccagagattgaaatgttggtgggttgagtcccagcgattggaaagcctgagaattgagtctcagagcttgaaatgctggtgggttgagtcccagtgtctggaatgccagagatttgagttccagtgattggaaagcctgagaattgagtcccagagattgaaatgctggtgggttgagtcccagtgtctggaatgccggagatttgagtcaccgagattgaaatgctggtgggttgagtcccagagattgaaatgctggtgggttgagtcccagagattggaatgccaatgaaagttggtgggttgagtcccagtgtttggaatgccggagatttgagtcccagagattgaaatgttggtgggttgagtcccagcgattggaaagcctgagaattgagtctcagagcttgaaatgctggtgggttgagtcccagagattggaatgacattgaaatgctggtgggttgagtcccagtgtctggaatgccggagatttgagtcccagagattgaaatgctggtgtgttgagtcccagagattgaaatgctggtgggttgagtctcagagattgaaatgctgctggtgggttgagtcccagagattgtaatgccattgatagttggtgggttgagtcccagtgtctggaatgccggagatttgagtcccatacattgaaatgctggtgtgttgagtccca

SEQ ID NO: 29754 - DNA, 1714 bp, Heterodera glycines
  misc_feature (60)..(61): n is a, c, g, or t
  misc_feature (106)..(106): n is a, c, g, or t
  misc_feature (113)..(115): n is a, c, g, or t
  misc_feature (120)..(120): n is a, c, g, or t
  misc_feature (123)..(123): n is a, c, g, or t
  misc_feature (131)..(131): n is a, c, g, or t
  misc_feature (135)..(140): n is a, c, g, or t
  misc_feature (143)..(143): n is a, c, g, or t
  misc_feature (146)..(147): n is a, c, g, or t
  misc_feature (162)..(163): n is a, c, g, or t
  misc_feature (179)..(179): n is a, c, g, or t
  misc_feature (184)..(185): n is a, c, g, or t
  misc_feature (188)..(188): n is a, c, g, or t
  misc_feature (193)..(193): n is a, c, g, or t
  misc_feature (205)..(205): n is a, c, g, or t
  misc_feature (207)..(207): n is a, c, g, or t
  misc_feature (214)..(214): n is a, c, g, or t
  misc_feature (224)..(224): n is a, c, g, or t
  misc_feature (250)..(250): n is a, c, g, or t
  misc_feature (263)..(263): n is a, c, g, or t
  misc_feature (271)..(271): n is a, c, g, or t
  misc_feature (278)..(278): n is a, c, g, or t
  misc_feature (284)..(284): n is a, c, g, or t
  misc_feature (311)..(311): n is a, c, g, or t
  misc_feature (320)..(321): n is a, c, g, or t
  misc_feature (332)..(332): n is a, c, g, or t
  misc_feature (356)..(356): n is a, c, g, or t
  misc_feature (359)..(359): n is a, c, g, or t
  misc_feature (377)..(377): n is a, c, g, or t
  misc_feature (385)..(386): n is a, c, g, or t
  misc_feature (395)..(395): n is a, c, g, or t
  misc_feature (423)..(425): n is a, c, g, or t
  misc_feature (463)..(464): n is a, c, g, or t
  misc_feature (1679)..(1679): n is a, c, g, or t
cccattcagtgaaaagaacaacccgatcggcatcccataaaagacgaacccaaacgaagnngaagaagaagaaaagacttaaaagacaccaccgaagaaaagggancaaagannncggancgnaccgaganccannnnnnagncanncgcactcatacgccnnaggagcaaaccgaagnccaannccnggggnccacccccaccncngaaaaanccgacccggncacccgcgcgccggagacccaaaaangacgggcaaaacngaaagcanccgaaancaaagnccaaaccaaacaaccgaaaaaagcaanggacggagnngaacaaaccgnaaaaaccaaccaaaacgcggaccnccnccaaacgacaaacgcgancaaaaagnncaacgcaanccgggagacaaccccggaccaaccgaannnccacagcaattttccccccgaaatttgacactgttttnntggagaaattgacaacgctcgaagacgagcgaacagaaatttgggcaaacgcagtcaaggagtgcaaaaagcaagaggaaagaaaaatccgatcggtcgaactccaaacaaataatatcttagaatcggtcgcgaaagcgattcgcgcggaagatttcaataggaaaatccttgacgaattgctcaaaacagtccaatcaacaacctacgcgactcgagccgcacgcgaaaagaccgtcatctgcgcacagaaactgcagaacaaccttctgcatcaaagacggttcctaactgcgcaagaacggacggccacattcatccgaaaaacatttggtttgccgacaggcacaaaagaagtggacaattcgggagcaaccacttccgcagacggacaacagtgataattttttgtgatctgtgatccattgttgacaaattgtgatttattttgtgataaatatttaaaacaaaccggtgattaaataataagtccaatcagaaaagggatacaaaattttaaaattgaatttttcgattgtcaaaaatttaaacatttaccaccaaactgtgtccgaaaaattgccaagaaaatcccgagcagattgaccattttcttgaaggtcaagttgaccaacccgaacttgaacaaaatttggaatttgccgaaccttggaaagtactcaggaagtatttcgatttttgtaaataaaccatcagctgatataaagaaaagcattgttgtctgtccttttccaattatattgccatttcggcatcggtctaacaaagctgcgcatggctttgggaaattcctcaagaattaattttcgttgtctaaagaaatgcactagtgtcgggcattttgacattaaaatgccattaaggcaccgttgtagcaatgatgcacgtggtccttggaaattcctctggaataaatccctgaatttcttctattttcttatcactcacaaatcactgggggaaaattaagatgatactgatgattagcgttcttgttcgattttggcgctagtgcgatatttattctcatggttcttggaaagtaatcaggaagtatttcgatttttgtaaataaaccatcagctgatataaagaaaagcattgttgtctgtccttttccaattatattgccatttcggcatcggtctaacaaagctgcgcatggctttgggaaatcctcaggaataattttcngtgtctaaagaatgcgctagtgtcgggcattttga

SEQ ID NO: 29755 - DNA, 1398 bp, Heterodera glycines
  misc_feature (43)..(43): n is a, c, g, or t
  misc_feature (50)..(50): n is a, c, g, or t
gcatgcagccccctaaaataaaagatattaatttttttaattntaaaatntatttttcttcacttcatcctcacgatcttctaaaatcagcacttcaattcgagcgccgttgtaaagccaaaaagtaaatgtgagtttgccggttgtgttttggcacttaattggatgactggccaagctgaaaatagatttgtttactttttaaatttaaaattaatttatttaattttaaattttgattaatttgataaaagattaaaatgttaaaaaaaaacaaacaaacagtgcaacttgttcgtcacgctttctgtctcccgtaagcaagagctgatcgcctaaattatgatttcaattgaattaaataaaaatttctagattaatattaattaatcccctacctacggcaaccttggacggtccaggcctgacttggacaacctgaaaacatttttagaagcatcatttttgagaagtgctagcccatttccgaaaatccaccacgttaatcgtttcgtaaaatccgacattttcgcaattttttcgacaaaatatggtctaattttgcttaaaggtatcaaaatttggcatccttgatttcgatagcctagctttttctttatttgtctgcaaaattgcaaataaattaacaaattattataagttatggcataaatagtatttacttccatttttcgatagccaaaaatgaaaatttggattgttgctttaaagcaaagagttgtgccgtgttttttccaaaaatagctaaaatggtgggttttacgaaacgatgaccagcatgatatttatgtaagtaaaatattttttttacaaatatgaaccggaaattcaacgttgtcctccttgcggaacaaatgaaaattgagtgtggcatggccaccgcttcgaacatttcgccatttacctaattttcaaacatttgttttgttaaaaatggtttacaaaaattttatttacacaattcgggcttagaaaaatcacagttcaaatcgcttggatgccgaacattccgcggtggctgtactaaaattaagcaatacaaatctatgcataagagggtaaaacgacgaatcggaataaaaaagaattggccaaaaacgaatccgaataaaaaataattggccaaaaactaatcggaataaaaaaagaattggccaaaaacgaatcgtccttgatcagcataagacctaggcggttcagggggacataaagattttttccgggaactatcataccagtagtttattatgcataaatttacacaacaaaaaaggatccaaagcacacaatcagaaagaaaaattgaaattttcatatcgataactagcagatcatgtaagataagaaaatattagctcaagcgaatttaattaaaga

SEQ ID NO: 29756 - DNA, 1555 bp, Heterodera glycines
aaaaaaagtcgaatcgaagacagaattacacaataagaacaagaaaaacaacagaagaaaagatcactacccaaatgaacactacccaaatgatcactacccaaatgatcactacccaaatgatcactacccaaatgatcactacaccaaatgatcgctacccaaatgatcactacccaaatgatcactgcccaaatgatcagtcgatcatcatcatatgaagacgattacgatcttcagcagttccacaagcaatataaaattgcacacccctgctgctatacaccattagtgatgttcgagacagaatttccagagacttgagaccaagcacgacataactcggcatagggaccaatttggaaaaaattgaaaacgcttttgttaagaacaagtaagtgtcctcctattcacataacaaaatttcgtcgccgaaactccacttatagctggtcacccaccctcatttataaatattacaaaacatatgtctatacttaaaacaatttatctttaaaagcaaccgataggaacaaatggaatatatgtaagaaaaaaaaaagaccaaatttagataatgacagcaaaagttagaccaaacaaaaaaagagaaaggaattcgaataagaaaacacaacacgaacaagaaaaatcccagtccaaaagatcactactgcccaaatgatcaatcgagatattggcaagcagcggccaacaaggtacatataataattggtgataccatcaaaataccgtaaataattccaaagacgataataaaaaatgtgatcagtgttgttctcttttaattgcataacggacaaatagaataaaaagccacatatcattatgtagggaattaatgcaataacagcggcacacatgcgacacaatacatctttaacaccacgctttgctcttatgttcagctggcgattgtttttttggtgcgaaaattggtgattttttgctgaaaaaaatttattaaatttattcgttattaaaatttattcgataagtaagtaagcttttaaaagccttttccatacataaatccatcaagaaaaggtgatttgattaaaaaaaattcttcaaatggcttctgtttttaagataaaatcgccaaaataagtataaaaatgtaaattcaaattacctttaattatggcagcagttttttcaattccaatgattaatttatccaaaaaattcttaaaattttctttgttttctttgccgagaattgaatctttggccatttttccaataattgcctttttctcgtcaatttggacttttttgaccaaatcgcgtacattttcatcatcagttgttaatgttccatttagcaaactttcacggaaatatttgcgtaatttttccaaattttcatcattaatttcctctttaattttcccatcacaaaacacggcaaaagaatgtttgttaagccattcaattccggatgatgcgtcaaagtttcctgactttatttcattcattaaatttgttgcccattcaccaattcttttgccatttgaaatttatctaaaaa

SEQ ID NO: 29757 - DNA, 1534 bp, Heterodera glycines
ttttgctagaattcgggttggtggttcgacataggtgataattaatgtcagatttggattatccgacccttaaaaaactccctaatatagtcttttcatgaaaaaaattttcaaaaattttgttttccgaaaaagggggggggggtaccatccgtactattaccagcaattcgattggttcatttttgtgatttaacttcggcttttatcaactttaaccttggattcagagaaaaatttcggtgtaaattaattcgaacatgaggaaataaccgatcttttattagtcctgaattgggccatagagaaatggttaaaaatgttagtttttggaatttatgaactgattttgtcaaaaagggtcaatttttgtggatttaaggggttttgaaagtcctattaaatcagggctaggcgaaagttaaaaaaatcccatttctaataatttatagaataacattttgatcgtatttttaggcacttaattgtataaataggtacctaaaataggtataaaagagattcttccaacaattaagaaaaaattcctccagatttcattgcctttttatcgatcgaaaatttatttttcggattgtattttatgcattttcttcgctaaaattcaaatttttcttcaaaaagtcaaaaaaatcacgaaaaaagtcgcaaaaactcaaaaaagtcataaaaatcccaaaaagtataaaaaagtcaaaaaaaaatacatgttagaggcttcagacaaagtttagaacactttaagtcattttaaggccatttagagtcagcaaaaaaaagtcatttgacttaaattcacagccctagttctgatatttgagaaatttatctttaaattacgtaatattttcaacaaaaaaaacaattgtttccattgtataaattaacgaacggcgggcttttgaagaaatcttttgttggctcaaattatggcatttattcttccgaaataattttggcgtctattttttgcaatttgtacgccatttttttttagtttcaaatccgggcccaaaaacagaaaagccccaatttaggctcaattttaaaatttttatgaaatttgagtgccgaaatttggaccaatttgttaacagtttttgttgttatccaccgctatgagagggaattaagtaaactcatgagaataaccgctaagccactggaacaatactcaaagccatttaaaagaatatatttaattaatccgggtctgggcccggtcgggcatccgggcccgtgtaaccctattataaatttaaaaatactaaaatatttaaaaaggaacgaaaaattgtaaaatctttcacctttaccccaaaaaagtgaaaggttaaagggctaaaaagatgaaaacggaactcagccttggtgagaaatcacgtttattgccattgttatggctaagaatggacggcgttcatccattttttaagcgtcaaatggccgtccatcccaactaattgtaagttttgcgccttttcgcaccatcagtcccgcagcaatgactcaa

SEQ ID NO: 29758 - DNA, 1511 bp, Heterodera glycines
gtttaatcaaatcaattttcatgtatgatttataacatctttttatagccgctattttaaaataatgatttttttaaatttttataatgattttttaacatatgtaaatttaaaaattaaattattattaacaatttctaattatataaaaaacacatataaatttatttttctaaattccttttaaacaaatttatttattatttttaattaataaatattaatcaaattgttttaaagtaaaacttctcttatagttcatgaatttaattttcgggtttaaataaaatcaattttatttcttttgatatgaccagaacgctaatttttcggtaattactagagcacggacgggaccgggatcctgccgggactctcggtcccggtcccgttttcttaacaaaccaacgggaccgggagtaccgttaaaaacgtgagtcccggtctcgggatcccgtcccggtcaattttccaagccctggtcccggtaatttcaaaattccgtgctcttttatttttaaaatatttaatagttatatttatcattaatttccattattttcttgtttaaaatataacaataattgaattataatgatcgcgctcaacaaatttgcatatatacattctttaatttatagaaaaaattcaagcatattttatagaatctaatgtataaattaattacataataacaaataaaagtatttattaaattattacaaatttttgtgttatttaaacaaaagattcatatattactaataaagagaataattatgtctattcattaaacaataaatatcaattgaaaaataactttgttcataaagtaacgaaaatataataattaaaaacaataacggataacacatatttttaataatatacagataaaaaaagagcaaattttaaataaatattaatccataatgatataaagaattatacttaattattcagtcggcaattaacgacaatcttaaaaatcgctcctcattatctgacaagtgattcaaaagaacacgagttatgttataaagaattatgcataatttaaaataaaagtttaagcattcattatatgattattttattaattgaaacaattaaatattaataaatgaataattattgcataaatattgtaataatagtgaaaattaaacattttaaattaatatgcaagaggtttcttggactcaggaaaaaatttaagttataaaatctatttatattaaaaaatcaatgtatacctattatctatgaacaataaatatatctattaaatcattagctaaattctttgtatgaaataggaatataaaatgtaaagttttaatattttttattttatttattttcattttattttgattgttaattaattgtttttcttctgtttctacttctctgaattgactttatgcaataaaacaacacatttttaaaactaaatatttttcgctcaaaacatttgccagaatatttttatggagctttgaattcaa

SEQ ID NO: 29759 - DNA, 1115 bp, Heterodera glycines
ccggtaaaggactaacttacactgaaatgagcgccgagctatcttgctctaaaaaatttttcgaaaatctgagtctttcgtttttatttattttttgcaaaattaattcataaatattttttcagaaagggttctgaaacgcaccaaattttatttacaagttaataagattctctgatgcttttctatcaataagggaggtgaataaaattttaaaaattttttaattgctttttaactttgggaaaaagtttaggcttaactttttagtgaaagtttgatcactcatattttttgctaattgagcagaagcataccaaactttacagggatactccccggtaaaggactaacttacactgaaatgagcgccgagctagcttgctctaaaaaatttttcgaaaatctgagtctttcgtttttatttattttttgcaaaattaattcataaatattttttcagaaagggttctgaaacgcaccaaattttatttacaagttaataagattctctgatgcttttctatcaataagggaggtgaataaaattttaaaaattttttaattgctttttaactttgggaaaaagtttaggcttaactttttagtgaaagtttgatcactcatattttttgctaattgagcagaagcataccaaactttacagggatactccccggtaaaggactaacttacactgaaatgagcgccgagctagcttgctctaaaaaatttttcggaaatctgagtctttcgtttttatttattttttgcaaaattaattcataaatattttttcagaaagtggtctgaaacacaccaaattttatttacaagttaataagattctctgatgctttttctatcaaaaagtgaggtgaataaaattttaaaatttttttaattgctttttaaatatgccaaaaaattaagcttaacttttttagtgaaaattcgatcactctattttttgctaattgagaaaaagataacaaattttaagggataatccccggaaaggattaattaacaatgaaggaacgccgaactaacttgctctaaaaaattttggaaatctgaatttttcgttttttatttatttttggcaaaattaa

SEQ ID NO: 29760 - DNA, 939 bp, Heterodera glycines
agtgaatttaggtagccagacagtgtgattggcactttgtgcccttttgacatcaaagcatttgccatttctaaacagaaattcggccaccaaacaaccaacggggcacattctgcaaaaagaaaattgttttttttaatttattcataaactcgattgaacaggtacaggtgaaactaaattttgaaaatcaaaatttttaaataaattcatttcttaggcaattttattaaaaatctcaaattatgtacagaaaatgccgaatttttcaaagtcggaaactcggttttctaaaataaatgtgatccggaattggtttaaatatatatgccatacaatactcattatcagcaagtggtggtggatttaactgctggtcacccatatgcctcacctgtttatccaagcaaacagaaagcacattctcagcaattgattgaagtgattggtcatctcgctgatcaatcttttccttatcatttgaaatccgggcgcctcttctgtcccgatcacttttgcaaatgcttaactgatcagcccaaaaagcgcatgacaaatggtggtggtgttgcataattataaacctcttaaaatatgttggttttaaaagttcaaaatttatcgaacaaaaaaatgcaataattttatgattaacaaaaatttttttaaaacacggcccgctgatcgatcgtacctgtacatattatttatactttgctaattaaaaaattctttgcacatttatcactagacaaaataaattaaaaatcaattgttttccataaaaaatcatcactattatgtgtgtgcgacttcattcatgttatgttcgttcatgaatagcttgtgcactttattggcggtgcaccaatttgcaacaaaacgcctaaatttgtgtgttcttttatcatttaattaatatttttattttaagtgttg

SEQ ID NO: 29761 - DNA, 1370 bp, Heterodera glycines
gatgttggaccctgacaccggactgttctcgcacccggacgcacagaaacagatgacgctgaaggagctgatcgtcaaaggctacctcaacccgtacaacacgcgcattatggaccgcgcgagcggaacggacatgcacttgttggacgccatccgcgagcatattgtggacgacgtggcgggcactgtgcgcgacacgctgactggtcgcgtgcacgactttgcgaccgcaacacgacaaggttgtgggagcagttggcactaaatccttataattaatcgcttatttactgctgctcttccaggcttggtcaaggaagacagcggcgtgttcagcgtcgaccgtcgcaccagtcgcacgtcgttgggcgacgccggctcgcctcgcattgttgagcgcaagctgcagctgacgccctacgctcaggagccctttcaagcagcctcctctaccggcagcgtcggttcggtcggaggaggcaccacacatggacaacacgcatcgctattcgacgcagcagccgcaggtccggtggtgagcgcagcaaagtcacgcgacgtgtggagcagcagcaacgggcatggcaccgccattatccgtgagagagtgccaatgcctgaacacgcataaaattttagccccaattttagcggcgacggcaaccgcaatcaaacccaatgaacgaatggtggatattgggggcggcaaaacggtcaaagtgaacgtggtacgcgacgcggacgggctggagaagggcgagtacttcgacccggcgagcaacatgaaattcaccatccaactgcatggcgacccggtgaccacgcagacgagcacaaaggcaagcagaaagcaattaatttccaatttcacataattaatattttgaaggttaattaaattttaattattttgatttaattttttaatccatttaaaaaaatttaaaaaaaaattatataagtaaataacagcaattttatggtattactttttacctttaaatattttaatttttatgatcattaacattagcgaccgaaaagtttagtctgtttaaattttgaaaaaattcaaaatttcaacgttagttttttggtttaaaaactgaaaaccgaaatttttataaaactttgtacaataaatttttgataattatatgaaatgaattattttataaggaaaaattaatagaagaataatttctcattttttcaagaaaaaataattttgaaatttaattgcattaagtccattttttcgtgatattttattttattaataataaaatttttattatctttttacatttccaattctatgtataaaacattttattaatttaacaattttccctggttcaggtgcgttc

SEQ ID NO: 29762 - DNA, 1121 bp, Heterodera glycines
  misc_feature (1055)..(1055): n is a, c, g, or t
  misc_feature (1065)..(1065): n is a, c, g, or t
ttttccgcattttttgatgcaatttgcgttcctgatggattttcaggtgcctatttaagtctaaaaggtgaacatcgtcgcaatgctttggccttttgccctaccgaatttgaaaatgaatgttttgtcgcacagttcgcattggtgcggtcggtcgccgctgtgaatcatcaaatgctgcgtcaaatggcccttctgaaaacaaattgaaaaactcattttaaacactaatcggcacgaaagcacctgaaaaaaggacttgccacaatggggacacgtgtgagagcgttttctgaaatttgtttaaattggcatttgatggcatgccaatttggccactcattcccctcctctctctcacccaatgtgccacatgctgtgcttcttcagcaattgacgagtgccgaattccttgccgcattgaactgaaaattaactctttcccatgtattttgcgtttgttttgtccaaattacggcatttgtgcggctgctcaccgctgtgaatgcggtggtgcgtggacagttcgcgtttgatgctaaacgattggccgcatttcacacaagcgtattggggactgaaaatgtggcaataaatggcggagaaaaaatatttgagaaaaaaggccaaaaactattcgcctcttaacggactgaccggtcgcggtgtgttttgatgtaatgaatgttcaacatttcttgcgaggcgaatgtgcgccccccggggcattttttgcacgtcagcgccgcgagagcaatgcccgagggactgacaatgagttggcccatcgaatcggaaacagagcaggaagaggaggaggaggaagcagtcggagaattcagcggaggaggacttgtcgattcggacttgatcaattgaactggctgaaaaacgaaaaaggcgtaagggactcaaatggaagagaggaaatgggggagggggagggactcaaatggtgggggctcaaatgggggaaatggtggagactcaaatggaagagaggaaatgggggggactcaaatggaaagcgaggaaatgggggaaagggggagggnactcaatggnggggggggctcaaatgggggaaatggtggagactcaaatggaaagagaggaatgga

SEQ ID NO: 29763 - DNA, 1013 bp, Heterodera glycines
aattcattcacatgggtatagttcagtgacatgagaccaaaaatttataaaaaacatcaacggtatcgccaaaatgcttgcgccacataaactcgggaaagtaactttcaaatgtgtttgcagtgtttccgctacgtggtcggaattgcttataatgatgccacattgcctcaacattttgggtataagaaccagtaatgggattaatgaaattctggctatggttaacagtgaaatgttggtacccctgaggaagattttgaatctgattgtatgccccccagagatcagaatggattatgctgcccgggaggatattctgttgaattagggggatgagatcatttgcacttcgtcgctgaaccggcacgagaaagcagcgtttcccctcagtgtttctttcaactccaccgaacagagccatatttgctgtttctcaggaaccctccctcgggcatattttatacgcacgcacattgtctcatcgatttcgacgtgcactccgacccctccgatcatgactcggtatctcactgcgcacacacatcgcgaaaaaagtttgtccaatcacaaattgtgtgattctccaatatcccggtctcatgcttgagttgttcatatgttccataatgttgggcccaaagataagagagatgaaagatttgctttgttgttaaatgtgtccccgcaaagaaggtcccttggagaaagccaatttccagtttgggtttggaatcagttcaaagcaaacaattcataatgttctataagctttctgtttatccagtgacaattacgaatgtataggaatttaattgtctggagttccgaaaaagtttaaacttgcacagagtacggctccatgtgatttttatttctagcatttgtacgtaataagtcgattgctttaaaattcccattcaatatggagagttcggtctccaaatcaaaaaagtgtatcgaatggctcaaaaaacgcttgcgcctgcttctatttacatttattattttta

SEQ ID NO: 29764 - DNA, 1534 bp, Heterodera glycines
  misc_feature (28)..(28): n is a, c, g, or t
tgtttaatattattttacagaatattantttgcgaaaaaattgaatatattaatgtgaatcattcattcagctgattgaccaaaaagaaaaaattaaacaaaatagtcaataataaaatgggaacgacataattgatcaaatggcttattatccggtttaaaaataagaaaaatacagcagaaaatgatcagaaactgagaatttatcaaaaattgaaacaattaaaaaaattatttaagaaaaaccttatccattcaattagtggatgttaattgtttttcttcacctgttcctttcccttggggcccgaattcggatggattgatccttttgctcaaacaaatatcttccaccctaaaatttagatgaccatcttgatattgtgctggttttgctggtcatcggccccgtgttcttcccaacttttcaactttgttcagtaggaaagaagcagaaaattttttcagattttttttttataaaatcaatttaaatatcttattttaaaactgagttttatttcgccacactaaagtcagtgttaattagcgataaaaaaaacaaattctattttaattctgcgccgcaagtctcattttgaatgggcgccgcaaatctcgcatcactttccccatggaatcaagccgcttcaaacaatgagagtgcgaatggaagcggtttcttgaggaatcatcataaatggaccaaatggtcaccaattgttgtgagctttgtgcagcggcttatgaagtaaaatacacttcgttattacaaaatccctgaattttcgaaaaatatcacttcggcttcctcaaaacacataattatgccaaatgatagcgaacatttaaaatcgaaaaacaaagcaaaaaataaacaaaagtcttgtgaaatgttaacgatttctttctcgtccctctaaatcttcacaataacttcttgaatgatttgtgttgcgtcattttgttgaccatcttttgcacatcgtcactttcaaaattgtatctcatgtaattggagtcgttcgttgccgcaacaattttgaaaatggcattcattttggcaaaatgcgcatcaattctttgctgtgcagttttgctcgctgttatcatttgtttttccaacaaaaatttgtacagcatttgtataaatgcgatgattttaccgtataaacacagtaatttttcatgcaaaaatattaaaattaaataaaaaattattattttatttatgaatgaatttttgtaacatgtttttcatttactattttaggactaaagcacagtttggcgatgtgcccgataaaataggagtcgtaaagatcgccataatacgaatggtaggccggtttccgggatcgggttatggggatggtatgtttgaatttggggtccgactaaaaagtcgagggtttcggggtgccacacttatccaatggttataaaattgcctctgtttctatattttccaactaccaaataagttttttttgctttgatttattaaattcttaattttttgtttatatatttg

SEQ ID NO: 29765 - DNA, 1616 bp, Heterodera glycines
  misc_feature (1591)..(1591): n is a, c, g, or t
cgacatcgattattcgagataagacccgttcaattacagtataaaagtgaaagctttggccaataattcaaaattaaaaagtttcgattagcacaaaaatatccaatttcttctcgactcggaattgcaaacaatttttcaaggaacaaatacaaaaaaaggaataaaattcaaaaatatttttaacagataattttccctgagataatcctttcttactctttaaaagcatttttatttttaattttgaaaattaaaaaatcattttgatcagtggcaacctacagagagccgccaaattttttaaaaattttctggtctttatttatttgatttcaaattcggacagcaattttttgtaattgtaatttagttcaggagagtgaatgatgatgaccaaataatgacattaataattctctccaaaaaatattaaatgactttaatttcaagaaatgccctcaggcagaattttgaagaatcaatccccttgcatttgcattgcttcacccaatgcttttgctcttttgatctcccccgcgggggagatgcgccgctcccggaggtaagtgcaataccgggccgacgcgcggtcgagagggggcaagccccctactgcgacctttttccaaaaattggttaatctctttgaccccggtaggggtcgttacggagattaagccgtaaagaacagatactacactttgatcttagccaaaaggccgagaagcgatgccggaacagcaaaatgggttccggaaacggaaccggcaccatcgaaaacatatgggtagcatttaaggcgaccaaaattgcacatttgggagcagagatattgaaaaaattggggaaatagcgtttaacgggagggacaaatgagggaaagaaacatgacggacgagagagagtgcttccgtaagaggaaaagcatagaagagagtgtgtacgacagacatgggaagggagaaagtggggggaggcagcagcaggtggtcgccatgtcgtcgcacgccgacgaccactttcgttctactctcattaactctcgctcgctcgctcgctctctctctcattctctatactctctcatctttctttttcgtccctgtcctctcattatcgcacactctttcccatttaaaataaataaattttttaaatttttgtataaattaatttgctttttattttctctctctctgactctctcacacacactctctcctctctctgctttgatcagttatgtaaataccccatccccccaagcacccacttgatctgccgtttgggctctgccgatcggcctccgctgttggcacgaccaccgccagcctcggccacccgatgtgtcgtgatcattgccgccgggcccattctgctgttgctgtttttggcattggcaccgcttccaccgccgccgccactcgtcagttggcacagcgtttggcccatccgttgggtgtccttcagtcgctgctgactgtgccgtttggtgatcatgtaaatgcgcatgtacaccacgacgagaatggccacccggatgtagaaagagcccagcgaggagtaccatacgtagtccaactctgangataccgtacactcgcccggacgct

SEQ ID NO: 29766 - DNA, 2265 bp, Heterodera glycines
  misc_feature (145)..(145): n is a, c, g, or t
  misc_feature (2211)..(2212): n is a, c, g, or t
  misc_feature (2219)..(2220): n is a, c, g, or t
  misc_feature (2222)..(2222): n is a, c, g, or t
  misc_feature (2232)..(2232): n is a, c, g, or t
  misc_feature (2249)..(2250): n is a, c, g, or t
  misc_feature (2258)..(2259): n is a, c, g, or t
gattagcaagaattgatcatacatgcttgttcaatgatctaaagaaattcttgaaaaacgaaagatatatccgctgaaaatcacgaatttacaaaaatttttcggaatttttttattgaattttatgcattttccgtttctcctntaataaatttattggttttctataatttttaaacataatttggcaattttttaatataaaaaagaatctctgataattatattattataatacaaaattgtttcataattataataattttatgtgcaaatataatttttttaatggtgaatatgcattatttatattgattatccaaccacatcaacaacctaaaaacaaagaaaaatatgcatatatttttattcacatgaaaaaatacatatattataatatttatatataaaagattaataataatttatgcaaaatacggcggaagtttttgattaggtgccaattttatactggtatgtataggcggcactactgcttttatttaacccaatagttttttatgctaaatcgaaaatgaaaaagcaaatattatatattttttaattatgctttattttttttaaataaaaaaatgacaaaaattttgcaacacaaatttcgatctaagcaaaaattagcaaaattttgcatcctgtaattaaaaaaacgtagggaaattttggcccggcgttgcagagaagcgccgccaaagaaaaattaagaaattttggacaggtttcttcttaacattgttgcaccaaaaattatgctttgtggctttttggttttaaaaacataacggaaaggttatttttcggattgaaaaaaaaatttggacggcaaaatttttgaaaaaatatgccgcaaatggaaagcaaaaaaaaatctctccgtattcaatatgctcattttttttctccaagattgttaaaatatttataataggaagcttaaagaatatatatatttaatacatttttgattgaataattcgttttgtcaaacttttgtatcaaaattcgatttcacattttcaagttaatattgtgtaattggagcctttaaatatgaacttagcttctttttaaaccaaatatcttgaccatagggtaaaccgggcccggatattttggcaaaaactggacccgggtaatacttggtacagaaaagccatgcttgggcatgggtacaagttttctaaattaggcctgggtacctggtccaacagggtacgaaaaacccaacaattatttttaaaatcttaatttaaaaaaactaaacaacctaaaatcttttaaaaaataataactaaaggataaaacacgatttatcctacgactaaataaaatcgacataaaagaaattatattagcagaataaaacatttaactccttttaatataaaactgaaattgcgaatgcgttggtttttaaggattaataaaatgaacaaagtcaaataaaatttgtttgaaaaattgaaattttttttatttcttaaagaataaattttatccataaattaaatattgtctttttttggaaaaaaatggaaaaacaaaattaaaaatgaattggaaacatgaaatggtcagcagaagagcctgaatgatgtgtagggatgccaattttaggtaaatacatttttttctggattttccatagcctaattagttggaaaatttttttgtatttgcgaacaaaagttgggacttttatttacatattcttaattttctgggtttttatacatatcacatatgtacatattttggactttttcgcactttttcctacattttttgaagtttttttgaaaatgtacccctaaaaattctttttttttcttcaaaataagagatatcaaaaattaatttttaaatactaaaatgtgattctaagcctatctaggtcatttttatgacattttgcctgtttcacccattacgaagaatttttttctaaaatataacaatttaaaaaatttatttacatatttgatacaattttggggttttagtagatatttcgggatttttcttacatatttacgtacatatttaaatttgcatcatattcattaatcagttcttcaatttcatcatattcttccgtttttgattttgctttttccaattcttcctttgctgtcttggcatttcacttggcacgttcgcatttattttcccatggtgtcgatcaaattcttnnttcgaanngntttggcaatntttcgtttccgtgaccnntgcaggcnnatgcaa

SEQ ID NO: 29767 - DNA, 881 bp, Heterodera glycines
agtttatgtgtttttatttacccctatatatgtgctttttatgcaccagataattattttgatccactcattcattctgccctttttagtcgatgattagattttaaactttcggcctctccaatgtagtgaattaagacattattttccgtttttattgcttcctttggcactccgatcacttggttttttctgtcttggtctttacttatcggaaatgtgtactgcaattcgtggactactacggcctgtccgggccacgtctcagttgttactggtcccatagagaaatgcgtgtcacaatattctcccgagggaatgcgccacatcaaaagttcaactgctcctggcaggcggatccagtcatcctttccgattgtgaattgttcgatttttagggaatccccccatgatgtgacgagcatttctccgtctaaaattcctccagtcccctcttcgatgactgtttggacattgtcataacagttcactccgtaccagccgtactccttcctaattggtttagaactttcccagcgtttctcgcttattctgttcattggacgatgatttaaagaattttgacagtcgtccagtgatgtttccgattcgaatttcttcggcggatgatcaagagtaaccacgcgtaagaatgattcggtacatgccactgtcgtaacattccagcatttgaatactggaaatgaacgcggaattcgtatgggtatgtagagaattgatttgttcatgattggttgtgtctcagtcgggagagtacagttcttctctgctgggaaactcatagtcacggatgatccttccaatggactcgttggacaaatttggtattgtgctagcgccggtggaatcgatgtcataat

SEQ ID NO: 29768 - DNA, 922 bp, Heterodera glycines
gtctgatcgcgaagcacatatgttagaaaaagtttctaaacatattgagttttggaatgataccatcaatgttggattttgattacaatgaaaaaagttatataaagttatagtgggaaaacatgctggcgcccaaccgtgcgcgcccaactgtgcgcgcccaactgaggtagaccggatctcgacagtgttggtttcgacagtgattgatttcgacagtaaagcttatttaaaaaaaatttgttctatatggcataagtctcgttaaattgtgacaattaaaatgataagaacatggctcttatacttgcagaggggttcgagattttcgaattcttgcttaagagcctgcagatttgaattttggcacacaaacccggcattagttagcagattttcccacacgatttgagaatcttatctacgaaatttgttgtatttttgactacattacagcaggaaagatatttgtatagaaaaagtgaaagcgataaattttttgcaaaaaaatcatacaactcttattttttattacttacttcaattataaattttgtatatgcaaattgtatattcatataaattcatgtgtacaataaatcatgtagaaaattaattaaaaagtactttcgaaatcaactgctttcgaaaccaatcactgtcgaaaacacctgctggtacgcatactattaccggatttttaacgaaaaaattcaaaaaaaaatgggtacgaagtgccaatctgttccgcaaagatttttaaattttacgattttgttaagaatagacactcctaggctcacccatttctttttctcggtctcggctctcgttttttgctaaaaaataattaacaaaaaaattctttgtaaaattattcttgaatttgcagaaaacacccttcattcaacgaagccgtcac

SEQ ID NO: 29769 - DNA, 1224 bp, Heterodera glycines
ggttcgttcaggtaactcagtacgggttccaaacgcatcgcccacgccctccgctcaaccgcgccatcccgccaattcccgagtcgcgcagcaacgagtcgattcagtcgggactggtggcacgccaccaaagtgtcggaagcgttgtgggaattcagcaacagacggcacagatcattgacgagaacaacccaattgatgtagaaatggtaccgacagcggaggaggaggaggcaaagacaaagacggagacggaacatttggaaatgatcgaaagcgaaacggaggaaggaaaagcggggaaagggaaaatgagagtagcggaaaaaggaggaaaagcatcacgattgccgaagatgatgcaacgcaaaggcaaagcgaaggaaagagtggcggaggacggcgataaatggaggaaaatgccgaaaagtccgctgatgtcagtggcacactcagtgaaggtgagagagaaagagagagagagaggggagaaagacagtggagaatcagagagaagagatagaggaatattgagaaagagaaagggagagagagagagggacaaggagaatgagagaggaaagtgatcgaaaaacgaacggactgaccagcagttgcctggctaactaatactgaatgtccttggaattttcatttttcataatttgccataattttgtttagactcggttcactcgtctgaccacgctcagacagtccaaagatgcgttgccgatgagtcgcagtttggaaattggtcgtcagcagagtcggattccgacggtttgcggcggcggcgacccaatgacaaagtcgtggagtttggagacgacagccatgcaaaataacaacaataacaagaacaatagcggctcggaaatgccccgacggggaccaatcaccacattaatgccatccccgcggggaatgccgcggagaatgccgacggagggaggttaatgccgaacaaattaacaaaactcaaaaaaatgggaacagaaagcgaccattacgcgggcgcgaaaatggttcaatttgcgccacttcccaacgacaaattcgaaacgaaagaactaaggaaaatgccagaattggaatttgccgaattgaatttggagaagccgacggaggagggaaaagaagcaaaagacggaggaggtaaagcaaaataaaagaaaggaaagcgaattaagaggacaatttgaaggggaaaagagggaaaaa

SEQ ID NO: 29770 - DNA, 93 bp, Heterodera glycines
tctctttcgttattattgtggcctgaggctcaaacgccccatttcgggatcgggtggtcgcccatggaaatgcacacgttcttcatttcggcg

SEQ ID NO: 29771 - DNA, 1063 bp, Heterodera glycines
ttttctggtatggaaatgtcccatatatgttcgtgaggtagcggtggtaatgacacggttggtaaggcaacggttggtaaggaaacgtttggtaaggaaacggtggtaaggaaacggtggtaaggaaacggtggtaaggaaacaacaccaacccctttttgaaaaaaaacagaatgtcaaaaatagaattttttatttctctaagatgtaatgccaaatgcttttttcaaaattttcaaagaaagagaaagaaaaccggaaataagggactgtccccttgaaaaaatacactaccgaaatgacttttcaggtgcatttacatactctaatattattgcaagttttatggaaatgtcgtcacaagaggatgaatatgactatctttttaaaggtacttttttcagagatttaaccgttctcggacataaataattctgaaatttctgtaataaaattttggtttttcgattttgtcatttcccttatttttgccctggctattccccatcatttttcagtggttttgatcggcgacccgggcgttggcaagtccaatttattgtcccgtttcacgcgcaatgagttcaacttggagagcaaatccgccgctggtgtggatttgtttttcgaattctcaccttccattaaggtgtgttgtgttacttgtgaaataggtgttcaaaatgtgatggatttggaaaataaaattttagttttttgaggagaaaaatttgcattttagggataatttctgtttttaatgatactatactgacaaatccgcattaaaacttgttttttttcggtgttataattgcaaatattacaattgtttcattcaattccgaatctatggaccagcgatgtttctagaatttcgcggcttaatgccaggtagggcacctacagaaaaaaatgtctttcattcaatttttcgggttttttatagatattctaaatttgagttttggatcgttttttagttaaaaatcccgtacccaattgatggatcctgttctctctttgtcattggcgaaaatccggtccgatctcacattttttg

SEQ ID NO: 29772 - DNA, 1111 bp, Heterodera glycines
cctaatttttgttagcctcctttttactgttaggttatccccgtggaagagacgtgccatgctaatttggacgaaattaagacattgttgtcagaaatggtcgtcaaacatttgaagggagagaagaaggacactccgccaacttacgcagtcgaattcaaagcgagcaacaccaaactgttgagcagacagcaaatttacgatttggttgcgcaactgatgaacgaactgtcaccggaaagtgccgtcaacctcacccagcctgatctgctcgtcattgtgcatgtaaaaaacaaaagcattatttttaatgaatcagatctcattacccaaattcgatgaatattttatgacgtacctgcgttaactaatgaaacaaatattaaactggaaatttttgtggttttgcttttagactattcgcactgttacaatgctttcgattgtcgcaaattattaccaacgccgcaaattcgctttgaaattggcaacggagagcgaaccgaaagagaaaagcaacgaaaaacagaacacgacccatgaagagggagagacttgaaagaattagagatacggccacattccttattatttattttttgatttcattataccctctatcactttactctgtgagaaaaatttaattgtttgctaaatttttggcaagacttccttgaaaaaataaataaaacaaacgaattttataaccaaataatggaacaaacaatgaatcgaattcgaaacgatgagaaaggaccgaaaatagatgagatgagatttaacaagcaaccaattggtgcaacagaaaatgatcggacaaatgaagaattcgtcatcataaagcgaagcggggagaacggcagagccacttaagcatagttgtagaggaaattgaagctaaaggacggggaagaaactcaaaaatcagaaagggagtgaaataccggctcagaatttgaggaaggctggcgatcagcggcccatagcctgcggaattgtcgtatagctcaaaaagaggcgcagcgaccaatttaaaatttttagggacagcgaaaaaagctaaaacaataaatatttaaattatctacaatagcaataaatagacctt

SEQ ID NO: 29773 - DNA, 1250 bp, Heterodera glycines
gaggtgttttgagtcagaagtttcgctttcaaaaaagctcgtagggatcgtccgttttcggcaaaatagtgcaccatagcaaaaagggcggaggttgatcgacacttctctagggtttgaggtgttttgagtcagaagtttcgcttttcaaaaagctcgttgggatcgtcctttttcggcaaaatagtgcaccacagcaaaaagggcggaggttgaacgacacttctctagggtttgaggtgttttgagtcagaagtttcgcttttcaaaaagctcgttaggatcgtacgttttcggcaaaagagcgcaccatagcaaaaatggcggagtttgaacgacacttctctagggtttgaggtgttttgagtcagaagtttcgcttttcaaaaagctcgttgggatcgtcctttttcggcaaaagagcgcaccatagcaaaaatggcgtagtttgaacgacacttctctagggtttgaggtgttttgagtcagaagtttcgcttttcaaaaagctagttgggatcgtcctttttcggcaaaatagtgcaccacagcaaaaatggcggagtttgaacgacacttctctagggtttgaggtgttttgagtcagaagtttcgcttttcaaaaagctagttgggatcgtcctttttcggcaaaagagtgcaccatagcaaaaatggcggagtttgaacgacacttctctagggtttgaggtgttttaagtcagaagtttcgcttttcaaaaagctcgttaggatcgtacgttttcggcaaaagagcgcaccatagcaaaaatggcgtagtttgaacgacacttctctagggtttgaggtgttttgagtcagaagtttcgcttttcaaaaaaatcattgggatcgtacgttttcggcaaaagagtgcaccataggaaaaatggcggagtttgaacgacacttctctagggtttgaggtgttttgagtcagaagtttcgcttttcaaaaagctcgttgggatcgtcctttttcggcaaaagagtgcaccatagcaaaaatggcgtagtttgaacgacacttctctagggtttgaggtgttttgagtcagaagtttcgcttttcaaaaagctcgttgggatcgtactttttcggcaaagagcgcacatagcaaaaatggcgtagttgaacgacacttctctagggtttgaggtgttttgagtcagaagttttcgctttcaaaagctcagtgggatcgtactttttcggcaaaatagcgcac

SEQ ID NO: 29774 - DNA, 1356 bp, Heterodera glycines
  misc_feature (72)..(72): n is a, c, g, or t
  misc_feature (101)..(101): n is a, c, g, or t
aagctcgtttttcacaacaaaaaaagggtaccaaaaattaatgtaaaaacatctaaatttgtgtggcatttngcgtcctattttatgcttttctacaaatntaatatctaaaaaatgcataacataaatttttatttgcatattttggtacatattttcatataaatttgccatttttattcggtttttttgttcataaaaattactaattgaccattttcatcaaattttgctcccttcagttacaacgttttccttatgttctctctgttggacatcaaacggcgaaaaattttgtcccaaattttgaaaaatttatgtgcatatttctcactttttatatgcatattttgcgattttatgtgcatatttctcactttttatatgcatattttgcgattttatgtgcatattttgggagccctaattatatgtattgatttgtcggaattttgctttttttggccaattaataatgtaaaaagcctgcagaataatatttgctcttttcttgcataatatttataaattcctgagatctttaatttgatacaacgtttatttattatttttagaattttaaattcactacgaaaaatcattttttttgaaaatttaaaccgcttttttcaaaaagataccaaaaatcaattttttctagtgataaaacattatcctaaatgtaattaggtcatttaatcttcattcagtgttttctatgaattttttgttttcgtgaattttttaaattttaaatattgtataggtacatatatttgcgatctttcttattacatacatataattcccaccataaattttattccaattttaacaagtcaataaaatgattttttgctgcgcgctttttccaaaaaagactgggaacagggggccgatggcgccagtatgcgccgccaggaaaatttcagaattttggtgaaattttaacagattttactgaaaattcgcaatttaatggtcgaattttgaaaattttgaggtttgttgggccgataagctaaaaatcgcaatttttgaataaaaatcagcataaatcggcaaattgtttagcatgtgtaaaatgggttgcgcgaacgaaggaaattttcggaaccatacgatcctgtgtcatccggaaattgcaaccactccgaggctcgtcgaggagggcgttagaattccatacatgcttggcgatttacatgggaatttcccacaagcttgtgaagaaagacacaaaggaaaaattggaaatttgtgaaattagaggtttacaaactgaaaattttttggcacttccttgttttgtcatccccctgaaatttttttccagtaattttttctaggctattt

SEQ ID NO: 29775 - DNA, 665 bp, Heterodera glycines
gagcactttgcctggctgaaaaaacaaaaaacatgaagatggttttgatggcctccgttgttccgacctgtgacccgtcgcaggaggcgccttggacgtggtgatgagacgaatggagggagcagccatgtggagaatggtggtttcagaaattaggacgttggtcgtttgttcgctgaaaattaaaagaaacgccaatgtaaaatacaggaaaaaggcaagcgaaatgtgcaaaagacgaaaaggcatttttagcacttttttttactatgacgaaccaaacgaaaaagcccctttcgattctttatgttttcctgatcactgaccaccagtgtgtcattttttgacccaaaattttgtacagaaatatcgaaaaattgcaaattatatttaaggaattcgcatgtggttttttattgggacgatcaaagtaaaaagtgcaggattttgttaaaaagagtggagaggaaaaagaatgaaaatagagaaaattgttttgaatagcgaggaatggtaatgcgatttgatttgactcgcctttatataaaaaaacaaaggcgcataaacaaattttttgttcggatgaaatttgaaaattcctccgattttgccattcacttattggactgatataaatatgcagccattttcacttaatgcttcat

SEQ ID NO: 29776 - DNA, 1055 bp, Heterodera glycines
acaaattagatggagatgtccaggtggtgggtcgaaaaacttttaggtcagttttactacgaccattatcagcatcatcatcattataattgttatgccgaaatgatgtgataactgtggaaataaaatttcggataattttcgttcaaaatatttatataatatttttctgataaaagttttaccattgaatcatcgagtgtccaatctctttttcagtgaatcatttttcccagctacatcaatttgctgattatgtgttcgccttcgaatggattgtcggtcggttgatctgtccaccccccccccttaattcacttttattcattttccatttttcctagtcttaaaatccatttaaaactatgaaaatccgaatggactttctatgtcgtcacccgatgcacttcccgccgattgttgcgttgttcgcccgctttcgcctttgtttcccttttacttccatgccatgataggccaaaaacaaataacataaatttgtaaaattcaccaatttaattttaacagcttgaggctttcctagagatgttactcggtaaaatagtttttgaaaaattacgttaattttatcgtaaaattctttaataagtccttttcaaattttattaattcccggcaaagacatcctctattaaaaatacgctcaattttttaaaaattcgaatgattttggttgttgatattttttagatttaggccttttacttgacattaatttagaagcaaagtttatctttttatgctgaccaaaaaagtctttccaacaacttgttctaatcacttaatggtgatatggaccctccaaaatgcagggcgacatttgcggaccgacttttgcggatcaaatttctgagttgaattgtctaaaaaaagaaagagagacgatgaattttcaataaattttaatacttctataattaaaattgatgaaggtatgctgatacaagtctgctttggcatatttcttgatcggagagattactagaacaagatatattaacctataattgagctgtgaaaatagtaataaaaat

SEQ ID NO: 29777 - DNA, 1556 bp, Heterodera glycines
cctttatgagagccaattaatgtttttccctccatccccaatgtggcataaggggtagtacgtcagtctggataccccctccatggttcggatccgctcgggtgcgggggatttttgataaattttaaatgcatttaaattcaacacgttaagatattttgacctttagatgtttaaattgaatttaaaattaattaaaataatttaaataaagtcgcgcagcaaaaaagtcgcgcagtaagaaaaaagccgcgcacccccttacaataggtttgggtttgcaagaaaagtcgcgcaaaaggttttgcttcagtactgaaaaattttggcgctcaaatggctggcgctcagttggccatgcacccctcccataagtgtggggggggctaccgtaatccggacaaatggtgtgctctaactactaaccattaattgcaaaaataattttaaaaacaaatttctaaatttaataaaatattcttaatgctttatgaaaaatctaaataaaaccaacgatgtaatacaaattttttaaaacaaaacctgggattaaagcttgaaaataaaccaatgcttattatctcgtcgaaatcattttccctcaattttagctaatgtcagttctcttatttataaatattgaattgagtttaaataaattcttcaataaaattatttagtataattataaatttaatgtaacttaattttgtcttaaaaaataattgaattatataaataatataaaatactattatttaagtgaaatttttacacctatgaagcgccaaatcttggaagctagaggaccatgccgcaataaaatggaaatatgtaaacaaattcaaccaacacttataataatatatataccataaaaagagaataaacataaaataatggaagttaagaattgtttaatatgaatttctaaatttttttttattaatacccaaataaaaaaataaaatttctttatataaaaaaataatatatgataaaaattttaaacaaataatataatttgaaacacatttttttaatataaatatgacatttttgaacagactccgttgagacatattatcaatatgaatcactttattttacctgttaatttttaatatttgaacgaataaattatctaaatcaaatacaataaaggcaaaatcttccgagaaaaaaaatgaatttattatagaaaagaatactaaataaataaataataagaacaaatttaaaataaatatctattttatacgtttacctgaaaatggtctcaacttgtgatgccacgatccgggacctactaaaacatcacaagacaaaacattatataaaaaataattatttaaaacaactatatttattaatctaaatttatttaaatatcatcttaataccgtgtaacaaattattttttaatattttgaaacaaacaaaaaaaaaacagaacattatgaaacaaataacaagatgaatgacaaaaacaaattcttattttatataaaataaaaaacccaaaacaaacaataaaaattcaacttatctgtaag

SEQ ID NO: 29778 - DNA, 1231 bp, Heterodera glycines
  misc_feature (1078)..(1078): n is a, c, g, or t
ccagccacagtttgttgccaaccggctggccgagatacgcaaatccacggacgcaacattccactacgtgccaacgagcaacaacccagcggactcggcaactcggggctctcccccgcgcatctgcagcaattcgagttatggtggaaaggcccagtttggttggcgacttcctgcgcaacctggccacgtgagctcgagttcaaagtggacgacgacgaagaggaagcaaccccagcggaggaactcaccagcgccacgctcgtagcacaaagggagggcactccctgtcaaaaggaagaatggcccaattcggtgcttaaccgctgcagtaaatgggcaaaagttctccgcgtgactgcctgggtcaggcgattcaccacgaatgttcgaaaacgctgtcagaggaagcaaaatgggagaccggaaactcccagccttgacacgggggaagaaagccccctgcggagcaaaaccaaacttggcggacaatcgttgtccgtcccaagttgcgacgagctaacaagcgcccaatggacggtcattcgcgcagtccaactcacttgccaaattcaggacaaaattcgggcggaaaaggatgaaaatggcgtccagagactgctcagccggatcggatggtgcgaagaaacggaagtcagccagccagtgctactcccgagagggtcaagagcgggggcactcatcatcgatgacattcatgtgcgttttcatcatgcgggacccgacgggacactttccgagttcctgagaagatggtggtgctcaagcgcgcggcaacaagtgctgagagtactcgggcagtgccgacaatgccgacgcctcagggggatggcctacccccttcccacaatgcccccattaccgatggatcgagtgcggcgacgggtgccctttgaatcggtggggctcgattttctcggcccaacagctactctggacgacagcggacaacgacagaaagcatggggtcttctgatcacctgcttaacaactcgagcaatttacatcgacgcaacacgggacatgtcggcgaaaagcttcattgctttactggcgnaggtttattgctcgccgtggggcaccaagtcggatcctgagcgacatgcaccgacatttacgattgttggtaaactttgagcgaatttgggataacgggagacgatccgctggagttcgcggactcccgggcattcatggcgatcaccccgca

SEQ ID NO: 29779 - DNA, 1561 bp, Heterodera glycines
attgctgcgtgacgatgggatggcaattgtgaacgaagtgacacgggactacgaaattggtggggcaattcactagctgatccatcatcactgatcattagggaatcggatttttagtagcgaaaaattgtccaaaaataataatgctagaatatcgaaaagaaaaagttaaaaacatctataaaattcgtcctcatctgatcgtttgctcggttgatcatccttgtgatcattctctatgagcaatcgctgatttgcttctctccctccctttagcgcttctctgtgacggtttgcaaggcgccgactttggcaaagttgagggcaattcgcaccagcgcatttacggcgtctattttcaccgggacacgctggaaaaagtgttcaacgaagcaggctttcgcatctgcttcagacaagtcgcaaatacccgaatctctccccaatggcaccgttcgcttttcagtccgatccaaatgtgccgactacaacttatgtgatccgcaaaaagccgcagcaggcgcgggagcccgtttttgtgaacatcgacgacatcgaacagttctcttggatcgaaccattgcaaaaagtggtggaggagcgacttaatgagcccgactataagacaatttggtcggcacactttgttttggtcttttcattggacactcttaaggctgaccagcacgcgcgtgcgtaacaatggcactttgggaatgtctctgtgttttgtcgaggaaaatgccaaatacaaccgattccgcactttggcagacatctctctgaagcccgagaatcggacgggtcctgaaaaattggatttggagtcgaaggaaatccaggaaattttggagttggacttgcacgcaaacaattaccgggacggcgactggggctcaattcggcacattgtagtcaaagaaggtctgtcggttctgtcccttcggacattggccccctgccatttcagtctgattttgttttgattttcagaagatgcgcacagctacaaagaagtggaacatgcattcatcaacacattggtgcgtggcgacgtgtccagcctgacttgggtggagagtggcaaccaatactttgcccaaagccgcgaccaactcggcccgggcctcgagctgtgctcagtgtattacgcggcggtaaacttccgtgacgtaatgttggcatacggacgccttccgccggacgccattccgggccaattcgcggaccgcgagtgccttctcggcatggaatttgccggtcgacttcaaaacgggcgtcgcgtgatgggcattctaccagcacaggcactggccacttcggtggtgtgcaacagagactattgctgggaagtgccagacgggtggacactgaaagaggcggcaacggttccagtcatttacgcgaccgcatattacgcgctggtgatgcgcgggcgcattcggaaaggggacaaggcgagttgggcagtgccggtcaccaccactgacttttctactcgttcaggtgctgatccacggcggcacgggcggagtgggccaggcggccatcacaattgcgt

SEQ ID NO: 29780 - DNA, 1293 bp, Heterodera glycines
attgtttaaaatataaatttacttaaaaaatcagtaaattaaaatttgaaagaaaaatcaatattttttcgaaaaaaaatttttcccgttcccgcccgggattcccgttaaaattgacgggattttacgggaacgggaaaaaggcgggaatcccgccccgttcattttcgttttcccgttcccggaaaaaaatttttaccggactctagtttttaggtagaaaatcacgtaaaaacttaaatatttaaattaaatgaattattaaatagtttaaagtttttttccgaataggtttgtacaaatttttaaaccaaaaatttttattaagaaaaaatattaaatttttggaccaattttttgaaaattttttcaattcttaggtgtatatttattgtttttattgcatttttgttaagaattttttcaaaaatcctaaattaggcactttaggcacaaaaacctcgaaataggcaaaaataggcattataaaagtcatcgtagacatccaaaaccaagcggaaaacgcgtttttagcacttatctttgctatcaagtgtgcaaaattttaggcatttgcttaaaaaaggaagccctaattattaggggtaatactggagaattggcggtgggggtcggtttagtcgggccgttttagtccggccgttttagtccggccagtttggtcggagggtcggtttagtacggcaagctgtttttgcccataactagggctgcaaaaaatatgtacaaaaagtggtccaaatatgtacataaatacgtaagaaaaatcccaaaatatgtacaaaaaaccccaaatatgtaaataaaattttttttaatggtattttttgggaaagaaaatccccgtaaagtatgaaatagccacaaaatgacataaaattactttttttggtatttttaggcaacattttcaaacttattttttctttataaattttcaaaatatgtaaaaaaatgaaaatatgtacaaaaatatttgccgaaatcttgaatttttttttgaggatttccaaaaatttccgtaaaaaatcctcaaaatatgtaaaaaaaatgaaaatatgtacaaaaatatttgccgaaattttgaattttttttgaatatttccaaaaatttccgtaaaaaatcctcaaaatatgtaaaaaaaatgaaaatatgtaagaaaaagtcccgatttttgttcacaaacacaaaaaagaaagtgtttttcctgctatttagagcaaagagaagccaggaaaaaaatatgtatttacataaaattggcagcccta

SEQ ID NO: 29781 - DNA, 1019 bp, Heterodera glycines
  misc_feature (81)..(81): n is a, c, g, or t
ataaatctggcgcatcggtcggggggaatgccccgaaaacaaaaatcgatttttcaagtgtcgttgggggtactcaacaanttatggggagcaaaaatccaaagcagaattaaagtacaggctatagggaagctattcccgaaggattcggtctccccataaatctgggcgcatcggttcggggggactgaccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggtccgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgaggcagagcacgttctaaaaaatatttatgaattaattt

SEQ ID NO: 29782 - DNA, 1591 bp, Heterodera glycines
  misc_feature (60)..(60): n is a, c, g, or t
  misc_feature (166)..(166): n is a, c, g, or t
caaaatatgcgaaaatgcgaaaagcgaaatgcgaaaagcgaaattttttctacaactttntaatagttaaaatcataaatagggcccggatttttatgtgctaaaaatcctgaaatatgtaataaaatatgtgctaaaaaatgctgaaatatgtgctaaaaacccncaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattaggaaaaaagtcgatttttagggggtgtatttttcaattttcttgtatttttattgcaatttttctcaaaaatgccaaaatatgtgcaaaatatgtgccaaaccccaaaatatgtgctaacatattttatgtgacaaaacgccaaaatatgtgtttttatggggatcgacccaattccctaccgccaattccctaccgccaattccctaccgccaattccctaccagccaattccctaccggccgattccctaccggccgattccctaccgccaattccctaccaatgcatttgggccatttccataccaaaagtttaaaaagacagtgaaattaaaaatccaagaaaattttaaaaaatttatttgtttcaaatcacggtctcatttcataatttcgagaaattccgatcaaaaatgtaataataaaatgatgattgaaagggtgatgaattgggaaaatgttagtgtctacgttattaagtggtaaataattttgaaccatcgtgagaattcggcggtctgcttcgcgatatttctttgccttttgcggtggttcttgtccagttgaacacttcgcgaagtcatcatcggataaatttcgatcctttcgcagaaggtcaatgaaatgccaaatcgatggatgtgaacaggcaaatgcgcattgcaggcgtctgttcgcggcttctgaatggttattcgtccggtcatcgccttgcaatgttcgagtgtaaacactccaaatgtttgggtcaaatcgcgggcgtgttcggtttccatcatgcttaagacgacccgtgtagttttcattatgaaccttatatataattaaagaacaataaatagtaaacaatttgtgagattatcaatttaccagtcaaggacgggagtaagttcgtcgggaagagccatgtccagagcaatgattccaggggtcaaatctccaattgggagaaacgcgagcgacgtgacacatcgtgccatttctgcgaatgtcgggtcattttgatagcgctaaaattttcgaaaattcgattttttttgtcatgaattcaactgtttcagcccaaattcagaaatttttttgtgaaaaatgggacgaggtggaacagacatccgcgcacttcagtgaa

SEQ ID NO: 29783 - DNA, 1871 bp, Heterodera glycines
tgtaattgttcaatttatataattataaaaatatttttatttatgctaaatgttttttattttctaccgtattgaaattattttctatttttctgtatatgaatatgtataatgctttttttaaatcattgttatttttattttaaaatttagttgtcttaataattaatttttttcttttcatggcaaatcctgaggttttcgaacgaccacccattatcgaagtttagaattagaataaatgttttttattattttcgtttataaaactttatcttttaattatgtcttttcaagagtttaatttactgaaattatagtgatcatttgctaattgtttttaagacttatcttttacgatatttaattattttttataacaataaattcattgacaacttaaattaactatttgtttatattaattaactatttgtttatattattttttaaatgttaaattcgttttatatttcgaaaaaaattcacttcttatatttataatgaatcacaaaatatattaagatttttcgagcctttcggataacaattcattaaatggttatttgacttatgtaattaataattctgttactttttgtatacgacaaaatgtattacttttattcaagaaataaaacacgtttatccaactactcatctaatatatattcgtttcttttttgttataaattttttattcatgtctagcattttttaaatttatgacatgtttgcgccgtatttttttatttcatttgtgaataacttaattaaatttttttatttttcatgtaatcgtaatattttctgctttattactaatttaattattaattattaggtattaaatgatgaaattagtttgaaatctattgaataattgtgggaatccttttttaagtctgtctgagcactcaatatttgctaattattataaatattattttaatatataataaattttttaatttactgattaattaggttcatggtattaccgcctttcaatagaataataataaacaattaaatttaaatcaacaaataatgaaaataaaatgctctaaaaaagttaagaaagaaaataaagaattgaaattttgaataatataaaaacatattttcaatcatttcaaaagattgaaaatggtcacttttcccttgttttctggatactcaattttcaacatttctttctccatgtaaagaagtcgtagaaccatcattgccaaaggccattttgtagcacattttgtgctctttctgcccatcacattcgtcttccacgaaaaattttttacaacccctaagatttattttttttgacagtcatttttgccaaatagttgtctaactttggataaatttcagtaaatcttttataattttaaacacttatgcaaattcgtttcggagacggtatgccaaagattcaattgaatccgctcaatttggtttaaaaaatgcatttaatttccatgatttttattgtttatctcttcacgttaataaatattagacgatttataatatgtttaaattaaatattaaatttttgttatctaagttaaaaaaaatcattttatttttgatatttcttctgtgtgtgtgcatgttatttaattaagcataattacactgggcattatttggttattctcaattcgtggtacggtatagtattccgcaacatcatcagaaactgctttaattgtaaattatttatttaacattgacaaatataataatttagttttatactcgtttttatatattgatcttataaatatatatatatatatatatatatttggattatattacgttgtgattcattcttttcaaaagaaagttaagactcaaaatga

SEQ ID NO: 29784 - DNA, 1651 bp, Heterodera glycines
tatgcagttgtagcggagctaactcaggggctcgatgcggttgtagctgacatttagctgatcgtaatggcactgattgtgatggtatccgggctggttcagaaagagttgttgctaatggtatggacatgctggcatgatcagaaaatgccgatttcgaactcgaaggtatcaatctttgctgaaaaattgtttgcgttatgtttgacggtatccttgcctgatcaggagtttctgatgtcggaaaagaaggttgccaaacctgatcagaaacgttcggttgcgaactggaaggcagccaagcctgatcaagcggattagatggcatccaaccatggtgatgagtcgtctgtgttgagttcggttgtagccaagccttttcgggtgtcgttggtgctgaatttggtgccaacaaagtccgaactgtttttgttggttgcatcggagtatgttctgacgatgtcgaagtcagaggagaataagatgcccaagtctgctcagacatttttggtgtagatggcactggtgacgaaacaatttgctttgaaaatgcctcttggaaatgcaatttttgcttttccctttttccgctgcttttattgaccacatgcaacgcatttgacaactttgtcgacttgtcaattgtcggacccttcgactttttgttcacattcgcttcttcgcgcactccgtcacaaaatgacggcgaaagtaccaaaatggccaccagcagaagaaaagattttgcggtaacggcactcaatttcatggcattgtctaattggcttgtttttataatttctatgaaatattaatgcaaatataataaattatttgctattatatgtcattgttggaaacggcacattaaatcaattgattgattgatttcattattatgtaaatatgtataaatcacatttaatataaaaaacgcgaattctttttgttttagtaatatttaatttatgaaatctcaagaaagggactgccagagagtaaatgtggaattttaatgaaatttattgacagaaattcaaaaagtgaaattgggtcagaattctagacgcaaagacaggtgacacaggaagagtttggataatttaggaacatatccttaagaagatgtgagtaatggttcaattgaaatcctatcctgcatttttggaagagtaaaactatcgcactcttgagaaccttggaaatttaagtgaatggggcaatattcataactagattcaaagcagagtgatgtggagctattatatatgcataagaatgattattaggccagcaccttatagtgacgaaaaatcccaaaatagataattaaaatagtgagtaaaaatgccacaatagagaagagatagtgacataaaagtggcagatagtgaggaataatgccatcattttcatgcagaaaataaatcaaaataatatatattccctaaatgcagttgcaaatgagtaggactgggatttttaagcccaaaaagcccgagaatagctacctaaaaaatgaaaaaaattaaaaatttgtttcaagaaaggaaatttcggagaaaattttttctcatttaataggagtatatatcgaaaatgaatagcttgattattaggggtgtattaatttgtaaagtttggataggtg

SEQ ID NO: 29785 - DNA, 1416 bp, Heterodera glycines
acaacagcttaaacttaatcacgccgtacctgcagctgcaggcgatataggactttttaaatatacatatgcgcatacgtaataaatgtaccccctacatacctgggaccgtctgctgttgcgcaaccgccccctgcggcggcggcgtggcgcccggcttcttcctcttcttagcagccttcgcagccacgtcggtcgcttcgcctaggacgatcttcagcaactcctggtcctccaacaggaagttgaactcctcgctgtcttcaatctttgccatgatcgcagctttgccaaagagacgcaacagcccctgctgggtagcagacatttgaaggatctgtaaaaaagtatataaacgatacccgtattgactgctgcccataaagatatcaaaaatacccgttgcatgctctgaacatattcgttgcagcagtcctccaaatgctcgatttccttctgcttttccacctgctcctttcggagctctctcttcagcgccttgatttcacggtctcttctggcaaccgcccaacgctcgttgcgcagcgaatcagtagattcgtgccactaaaaaacatagttatattatcatttaacatgttaaaaaagctacatgtttctgcaactgcttcatctggcgcgccacgcgcatcgagcgctcaatcagtcggttgcagagctcctggcgctcggactcttttgctgcctttttgccggtaatggcattcaggtcctgcgccccagcgacgagaatgtccttaaaaaaatgtctatttacacccttgagggaaaacgtgaaatgatttaaatatacgtatacgacaattacctttattggcatattccgataaaggtatatattttagcctaatattccagaactcgattttggactatttttattcttgctcttatgtctttctcccattcccgcttcaatatctctattgcctcttatctctctatcacacgctattaaaccaaacctcctcggccgctgcctccctaacatccctctgctccggcaggaggtcacggagccggacgtagtccgagttctgcggagttcggatgaattcaccacgcgcagccgcctgagcaaccgcccgcgttgatgcgttcttagctttagattccaagaacgcgtcccgccagtgcgcggcatggactccggctcccttctggaagtgccagactaaagttaaaaattattcataatattaaagataactttatcagcagtagccaataaatgtatcattaatataatgtgcttaagcgagcttacttgttgagaacaatctgtgccgaaaagcttccacaggcggccaggggtttgccaccaaccattctgcagccgcccgggattctggcgtgtagtcgcgcactttcccttccttcaggtttcttccgatc

SEQ ID NO: 29786 - DNA, 932 bp, Heterodera glycines
  misc_feature (32)..(32): n is a, c, g, or t
  misc_feature (37)..(37): n is a, c, g, or t
ttgaaagagcctataaaatgggaagaaagtgnatttntaggggtgcatttttgaatttttgttttttttcttagatattttttcaaaaatgccaaaatatgtgcaaaatatgtgccaaaccccgaaatatgtgcgatatttatttatatgccaaaatgccaacatatgtgtttttatgtttttataagtcgctctaattcgaaaattgttcggagaaaatgttatttttgggcttctctcgccataactaagccgcagaaaaaatatgtaaaaacataaaaatcccagccctaatcataacccattttatttaatatgaacaaatttaattcataaaggaatataattaacggtttggatatgttcaatcagtgaactttgaaattcaatgatgaattcgatttggctgctttcggcattcgaaataaatttaaaagtaaaaaatgacaaaaaaagttgatttttagaggggtttattatgtttttatgtgccaaaatatgtgtttttatgtttatttatgacttctacaccactcatttgtcagaatacatatcacaaggatggcacggaattccgacattttttgggtctgaattccgatttccgactttcgaaaaatttttaaaatctgaggtgctcattgtcagataagtgatcaacgcatttttaaactagggttgcgaccccgatgtcggggttggaagcgtcggggttcaccaaatcgcttggggtcggggtttttcaatttttgccttatgccatatagtagtgatgctcgagactctcggtctcgactcgagaaaagtctcggtttttttttggtctcggtctcgagtctcgggttttcagtctagatttttttacaccctctaatgattggattttggtaaacttatatttttataaattttaggccattttttgttcattt

SEQ ID NO: 29787 - DNA, 1180 bp, Heterodera glycines
cttttttattcgatttatctttattttcaattaataattttttcacattttttgagctttttgtattattttaccgccacttaaacgaataatttcttcatttccattgaaatagggaagccaacttttttgtcgtatttccataattaattcgatggtcgttttgttgccaaattcttcccactttttgtgcacccatttgggctgaggcaaattgtgaattatcttaaataattaatcgttttaaaattttaattgaataaaatatttccattaaattagttttctattttattttttgtttttgttggtcaataatttgtccattaatttctcagccgacggaatggcatttgcattttggcattttgccaagagttcgcttttacttcgggctttatgtgacgaagtgccaccagttgaaccatttttattggcttttcctttgaaatgttcaggtggggacggacaaagtccaccaacgggcgatatttgtccaacaaatgggcactaatctcatcagcaacaatttggcgaagatgcttataacgcgcgcacggaaaaccggacggatttagcaactgaaaaatataaaataaaatcttttttaaaggataacccaattaatttccgtgcgtaggccgtgccatgtattaaaaatgctcccaatttccaaattaaacaaaaaaaacttaacatattaaatgaacaaagcaattttaatttattggtatgtccgtcccatttcttcaaactctgtctcaccggtgcagtgacaaaggacccacggacaaaggacccacaaagacaaaggacttacaaaaaaataataataataatgcaatttcttaatagatttacaccaaaaaggatctttttcggattttaagcatttttgagaaaaaaaaagttattgaggtccgacggtgccgatttctctcaatgcttatttttaaatctttttaaaaatgcaatattattttgtgggtcctttgagaggacaccatctcaacgagtcgtggttcgcttcccgagtggcgtgtatcgcaattggcacccagttcagtgccgggtcgaatcggtccccgtcggactgtggcgggaacattccgctcagcagcgattgcgcactttccagcgcccgatcgacgtcggtggaacgaattattatctttgaaac

SEQ ID NO: 29788 - DNA, 1280 bp, Heterodera glycines
  misc_feature (24)..(24): n is a, c, g, or t
ccgatttgctccggaacaatttancaaatcggcagaatccattcctatttttcacaaaagggtctatctttgagtccgaacaattgagactcgagcaaagtttaaaagacatgtcaaatcggatgatgcgtcccgagttggattttactgatgtgagatttatggacttaaacctcacggaggcacacggagattcggtagccggacgccccctgaggaccgaatgcttgaacagaaagcatatgtattaaattacatgcccaaaatttaccaagtccatcagaacgagcggaagaaaaagagatgctatttgaacgtaacgattaatgggaaggatgtggaggctctgttcgatactggtgcggacgtaacatacgtcagaaattcaacggcgaaccaatgcatgctcaatgttagacgcggcgatttcccacaagcgcgagctgcaaacaaaacatcgattcgtttcttcggctcagctctggcagaaataaaattgggggaatttgaagggaaattcccgctgctcgttagcgaggatgactgctgcccatgcgcggcaataattggaaccgatctaatggattacataaccgaacaaggcgaggaggaaattggccttaacttcaaaaagggctcggtacgaattggacacatacacctgccaatggtcgcagcagttaccatcgagaagaaaccaattgagattcgtttgctaacaacacagactctgccaccattctccgacacattcgtgtggggacaattgaatcaaagttttgatgctgaaaaaattttcatcacgacggaaagagaacatcagtacttcccactccgggtgggaaagtgtttggccagcccaggctcaacacggaacgcaccattacgcttactaaatttcggaaactgtccgattaaagttcacgccggttcacgattagcgattctggaggcaatcagtgatacaactcaaattaattcattgaaggaggaagacaaaaatgaagacccaaatatcatgaatgaggctgaatggtcaaaatttaaagccgaaatcgatcatatttcaccggaggcagactggacagaccaacctttggaattcccgaaggaagtggagaaaatcaaatccattcttgagagaacatcgcactacatagggtgcccactttaaatatcgattgattttctccgcagagcgcagagagtatgagcgggcatgcccgtgcctattgagtgattgtgcctgcgtctctgacgggtggtgcgcggcgaggggg

SEQ ID NO: 29789 - DNA, 908 bp, Heterodera glycines
cgtattttattttataatatttaaacaaataataatcatttttaaatatataaatataatatacaaatgattaaaaattgatatttaatacgaatcatttaacttatataaaaccaaaaaacaacaaatttatgcaatgaaatttaaaaaaaaatcaatagaaataagttattgccattttaattttaaaatattttttttaaataatttaaaaccagaacaaacaaacttcttcaatatacctaaaagattttaataaagcttcagacaaaaaaataataataattaaaatacaatagaattgcaatagtttttaattctaaaaataataacaatttgtttttatcagttcttctctccaaattaaacgaacagcagcaaaagctttcacgcgacgaggacgagaaaaaaataaaatattttaagaaacattgcagttgaatatatttaaaaaaatataattttaaagcttaattaaatttaaatttatttaaatacaattgaaaacataactaattttcaaagtgacaatcgaaatttaataggccaaacgataattaattaaataaatatttaatataatacaagtttatcaaacaaacattattttaacgttatttcattttttaacacaaatcatccaaaagtatttagaaattattttaataaattaattaaaataataaaagtaaaataataaaatgatcatgagtcaatgtgtaagctaaaataaaattgtaattaaaatcaaaaatatatgaaaaagtttgcgacgattgaaagtaaaataaaagaattaaatattcaatattaagcaataaaaaaaaattatggaaaaatatcaccaaacataagtacattttattaataatataaattaaaaataatatatttctggctcctcgata

SEQ ID NO: 29790 - DNA, 1557 bp, Heterodera glycines
aaaacgattttttagaattttgaatgctcagaacatttgagctcttcgaatatacaaataaattgtactatttatttgttttgagcaaaactaaaaattttactatttataaaaaacactttcattgatgctgatttgtgatccgttataaaaaagccaaaattcatcaaaaagggcgttaaaaaaattgaatgaaagtttgctcaaaagcaatatcgaaatttttttttaatcttttgatagccctcaaaattctctattagcctgaaaaattttaaatattttattaagtgatcttgctaaatgttttcgaatcgcctgcaaatttcaaaaaatttggttaagtttaaaaaaatagagaactgttagggaccatcgaatgatataaaaaattaattgcagttgggtttgagcaaattttgtgagtaaaattttatgtttaaaattttcattttgatggtttttttatacaagataaatagcaccctttcatcaatgatctattttccattgtgttggcatggttttgccgctttctagttagcctattttattgggatttttgccactaaaatcctcaccctactaatgactcacttcattcattgtcagttgggtcgcatccatttaatagcatctttcagtgacctacctattcgtcattccttcatttttatctttgtttatccatgtacatattccaactctctctgaatcaataactccgcttttctcttcccaattttttttttattggtcgttttcgtttagtcgcaatattatggacattgtacccatttttattccaaaaattcattgttattttgctcaaaacaaataaatagtacaatttatttgtatattcgaagagctcaaatgttctgagcattcaaaattctaaaaaatcgttttgtttacaaaaaaaacacaaataaaaaatattttgaatcttttttttgttatagctttttaaaactattaatttttttgaattttaaattataaaaagttgaaattcccattatattaattgaatttaatatctcatgacccctaacactcttctgactctaaattttgaatttccttgcgcttacaaataatttaactaaatttaaatgttcagaaaagcgatggaaatttttgatgaatatattattgttgatgaaaaatcactttcaattaacattggctcaaagttcaatgaagtgactcaattcgctgcaatgtaatttattatatatttaagttttctcattatttttttgggaccaaccgagacgggtaattttggtggtgtcaaacgcataactttctaattaaccacttaaattaattaaataatgtgggattatatttcattaaaatttatgatttttttctcaggtgtttgcctatcgattcttaatatttttaaaattggagatttgatcttgattttgtgaaaaaagaacaagaatatattcatttgaaaataattatttaaagatttaaaaaacttttttttcatttaaaaattttcctgtttccgacggggttcccgtttaaattgacgcg

SEQ ID NO: 29791 - DNA, 1494 bp, Heterodera glycines
ccccccccccccaaaacaaatccgtaaacacatgggtaatggagagggattgggggggggtctattatgtagaagtgaacaaaataagtgagaacaaaagttgttgatcatgctgggaatgggaaggggggggggatcatcccacggtcctaggccattccacatttcttttttgcccatggattgggttaaatttgattgcacacagtgcgatgagggcctgaattgtttcaggccccatcgttactggaagcccattctatgtttacatcgcagcgtggacaatttgacatcatacctcagagaggggacttcgccaccattcccagcgacgacaacgacatcgacaaacgaaacaatttgccctcctccctcttccattcaatcatcacactccattttgctgttcatcctcacatttttcatcttcttggtgttcatcgcgcaggtagccccccccccccacccctcaatcaatttggacttgcccctctttaggctgttcaagttggagcgcttttgcgacgaatggtcaaaaatcgtatcatccaacggaaattgcaaaaacgtcagaagagtgagtgtttttttttttgaaccaaaccaataaaaatttcaaacaatttaaggaatgaaaactcttcgcagtcaagcgggccgccaatcgatgccaatggtggtgaattttggccgggtgggtaaaaactttttattttactattttaaattttcaaagtatttcagactggggacgcgcaaaggactggacaagtcgggggccgccgatcgatgccaccctctgttgtgccggcgaatttgggtggcgtgccgccataccaggtacaaacacaacaaatcccttcgcttccctttcttataccatttttttttaaaaaaggagccgcaaacgcagcgcgaggtgatttacgatgtgcctgcggatggtatgctggaagacgacgacgatgacagtttttgaacgatgagccgatacaacaatgagctttaattcctcataaatttttataaaatttgggaattttcatttcacatttaacaaattttggctaataaatgtaattcaaaatgattaattggcaatttataggagaccactaaataggagaaatttcaaatgttttactgttgggtattcagaacgttaggcgagattaatgctctttacgcaaaattttgaattttaagcatttgatataatctttttgaatgattaatgtgtgatatagtggagaaaatctgtcggtacatcaaatgagcaatttgtttaaaaatgggtcacatccattatcgggaattcgggatgctttggtgcataataaagctgccttgtcgatcgatgaccgatttgttgatggtgatgtggatgtatgatcattttttgggacatttaaaagttggtgctaaaatttgtccaaataaataagtggtgtggaaagtttgaaagggaaaatttaaaattgatttaaataatag

SEQ ID NO: 29792 - DNA, 793 bp, Heterodera glycines
ctcccattttattccttcgttcccctctctgctcgtaattgttcaatgatttattgctacaaaattcctccgaaatttaaatttggcgagaaaaaaggcataaaattaagcggattaaagatttatttgtcggtcagcaggtattaatgcaatcatgggcacaaatttgaaatttgccatttggcgccaatttgcccgtcacttaattagcaattcataaatcattttgttgcgtttgaatttaaactcctctctctctgccctgctgctgatgtccttttcgttcttattattcttctatccgtctttttgtctcaatttttgattcccctctcacctttttttgtcattgtgccattcttggcaaaatgttctgttgccggtttgtctgtcctccttttccgtaccaatttcgccttcctcaaatgcgcagcaacagctgagcaaacaaagaaagtaacaaaagtcagttaaagcaaaatgacttttgttatttcaatttggcacctttgcccaatgggaacagatgggcaaattcattaatttcaatggaaatattggtgagtcgggaggaaaatgatccactggcggacggggtggggagggtgacgacggcatatttggaaaatgatcttcctcccccctcccgcccacctgtcgcccgtcgtccataaattcaaattttggcatttcaaaacgatcacccgtgtctcatttcctcccctgtcggttgccccacccccacttttcattcttcatcatgcccacttcgctgtcccttcctcccccttcc

SEQ ID NO: 29793 - DNA, 1841 bp, Heterodera glycines
  misc_feature (827)..(827): n is a, c, g, or t
  misc_feature (834)..(834): n is a, c, g, or t
ctgagctgctgttgacgtcgacggatcgcccgatgacactgggatcggcaggatgcaatatgatcatttgcaaatgcattgccttgccaccgtgcccatatactggcataatgccccatattgaaattgtctatacccccgatcacttgattttgttctgcccgcgtgtccataaactgacataatgccccatattggaattgactatatcccgatcttttgaattgcttccatatgtattattgctgaggagtgatcgtatataaactagtcaaaaagggagattttcactttgacacttgttggctgtttcgcaccttctgtgttatataaagggggaattatttacagagatcataataatgactattatggcatcctctacatcctctatatgcaatataaccgacttattctcccttagacgacaagtcggaatataccctgaaaccttgagatccgcgctccaaacactgatggttattactggtgaaaatatgctcgcccgcaaaaaccattcatggtcttcattgaactgtcgctttagaccctcgaacagttgcttgagctatgtgttcaaatttggacggcatgttaatacacttgaagatgtcattcaataaactgtccgggagctggtggcttaaacatttagaatagttaaaaaattaaaaatatatatttatttaccctgctggatttgccatgagagattaagcgaagacgaagacaaacaatagccaaatatgccggaaaaaaagaaacttttgtttagactaaaaacaatggcatacgtattaaaaaaaagagaatggaaaatgaatatntggcatntactgaaattgcattgctgctggaaacctaatgagtgtgttcaaaagtgggggcgtcggcctactcaaatcattaattttatgtttccccatcagttcctcagttgagattatcttttgagtactttgcgggtgcatttttgctaggaattgggctgtgccatgtttaacagaggcagagtatcaaagaacggacgggcggggttaatgaggcatcaattaaggcactaattggggcgggggacggaggggtcaaacgcacgtacagtaaatgaccacaataagtcacactaacacaaaacaaaataactgtgacctggcttgcgtttcaaatttgaaaatttaattgatgcaatttaggctattcattaattagattatacacatttgacgagtctattagagagagagagagagagagagagagagagaaaatgggaaatttaaacattcattgtcaggggattatatgaaaaatatatatttgtctattttttagtgtctgccgatttatcattaaaataggcaattttttatgaggcaaattatgcacataatgaaagaagaataaagtttttcttccgaaaaatataaattttatgttatgtatagacaatttgccaattttatattcaaataaatgcaaaaagatgagagaagccattggacaggaggttgagttgggggatcccttccgaccaaacaatttttgatattcggcatgtcaaagaattcgagtgccggaatttgttggtaatccgtggggggggggaagagaaaatgagggctaaaggtaattcaaacgggcgaaaaagctacaaaattaccaaagagctaatcaaagtgatcactttttctcatcaactcattcattttccgtttgtagaacattaccattcccctcccctctctttctctcactctctcactgattaatgtgatcaataatttccaagggcgtagccagacccttgactttgggggggggggggggctgaagtcaaaaat

SEQ ID NO: 29794 - DNA, 1393 bp, Heterodera glycines
  misc_feature (1207)..(1207): n is a, c, g, or t
  misc_feature (1329)..(1329): n is a, c, g, or t
  misc_feature (1352)..(1352): n is a, c, g, or t
  misc_feature (1381)..(1381): n is a, c, g, or t
cctcagtgctctgtttgtcatcatctcacaatgctgtggttccaagaagaatagggtctttggcttttcgttttctgctaattttgctaatgccatccccccccccccaattaaggctatggaacagttcctcaagcaggagaatctcgactaccaagtacagtcgaccgacttcatgacccaggccaactcattggaggactttttcggcaaagtggtggtggacaacatcgtacaagagaagaaggtgcgtttggcatctgatcaccgatctgtcactgttgatctgactcattgggccttctgttcctgatcatttagggctttgaatttgcatgttttggtgtgatatttgtggtcattgatcacgattatggcatgcatttatgcgcatattccgaatgccggatccgaatcgaacaaaaagtcgagaattcatatttttactcaaaattaattcaagcaaaaattagttacaaaccattatagcatcaaaattagtcatcattctgtacatattttaacatacctacatatatattcaaaaattgggggtttcgactttttgttcgagttccggtccacgaattcggaatagccaaaaggcatgccatcttcatgatcaaaaatgaatgctcaattagctggatatggttaactgattggactcataggatgcattagagctgaattcgagccatgacagaccaatgatccctgaattctgcttgattcgttagtttagtgattctaactttcctctgttttcagaaggcttacgctaaacagccgaacgacatgaagggcatcgccgttaattgggacaaatggcccaacgtcgccagaaaggttgaggatgccaatgtagcgtccaaggtgggaaactgtgtccccatttaaacagtttaataacgcacaattcgattccacagattggcatcaaaccaatggtcgcaaaggcgggcggcgtcactttgttgggtcagtcgacgctggcggggtcggcccacggcaaaacgaaagtgcgttcattttgagggcattttattaaaaaaccaatataattgaatatgttttaagcgcgtttctcagaagaagcccggtaccatcagcaaacagttgggcagtggcacatcggtgacgcaaaaatcttcggcgacggaatcggcggccaaaagtacgacgcaaaaatcttcggctacgctgngccaaaagtcggaggcggaccgggagaagtcgaagaaggaggaggagacggaaaccgaaacggacgaggaggaggaaacgacggacaatgagggaagaggaggaagaaggcgaggaaagtgntgatgagaaacgagacgacgaangaggaggaggacgagggagaataagaagncatggacgagac

SEQ ID NO: 29795 - DNA, 1502 bp, Heterodera glycines
ttattatgtgctattacatatcacttagcttttttaaaattattctggtgtataccggtatactatttttcttgttcaccagttgaatcatcatctcctcttactcattgtaaagaatggaaaacactaaaatttttaattaatttaattaattttctataaaatgcttccaattctattttgtggtcttacaatgtagttacatacttttgttctaaactaggttttttgacaatttagaaaaaaaatgtaatttttaggtcagtcgacggatgatagacctacgtatttcaagtggattttttttatcaaattgatgaaaatagttcaaattgtcccaaaaattcaaccaagaaaattgaattattagaaaaatacatcataaatagtcagggatctgtccaaattgctcagatcaggcattttttttaaataaacccttaccacttgtcaatgtggcgatgaatttccgtgacaacaagtgccaaaacgaaacggaaccggcacaccattacaattgtcatcttcgcaacaccaattggtgttgcatgtcatgccctcagcaggcgaatgagtgccaaacgaacaattttgtgcacaaccataatagaaggctattaaaaaaatttagaaaaattttttgattaaaaatactgtataaaaaagggatgaccaattttaaatgaaaagcataatgcttatcagctgtggatgatctgatcaaaatgctcaagttcgttgttcaccttccaatttggtcggtgaagtaaaatggattgattactaattaatttgttaaaaaacttaaaaatttatggatttttaatatgtaggtcaatttttcaaaatattttaaactttctttttttttttgcccagtaatgtgttaatttgcaaaattttgatcccattttccttgccagcataatgctgatctctgatggatagataatctgatcaaaattctcagcagttcgttcaccttccaattccgtgccctccacttcgtaagtggcattttccggaaacagtttcttatcaatgcgttcgataatggcatcttttgaaatgatgcattgggatttgtagcatttgagcagatgatttgggcaattttttgtcgatttcgttacggaatatgttttcaagggcatatgaatgccactgttatgaaggcccaattcgggaaggtacactttaagttccgcttcggcagaaaagccgtgccaacattgcaactctggaaaaaatgccattattttcaaacgaatcagccataattacgggggtcttaataatatgatgaattatgtccagccctgttcagatgggatagaaatgttttttgtgaacccaaaattaagagttttaacttttttaaatcagctgactaatgtcgtaaatttaaataaaatttaaaaattttcaaggacttttttcaaattcttaagaacacccttagtaattttacatgcataacatatattagtaaatataataat

SEQ ID NO: 29796 - DNA, 1185 bp, Heterodera glycines
agtcaatctcgaaaaagaatagaaaaaaaacacaaaaaatgttatataaatgggaaaaaaatgccgccgtttgtaagattaaaaacaaaaaatacaaaaatcataaaagttaatattgaataaaaataatcgaatttacaagaatactcgaaatcgaaaaaagaaagctcgccgcccataagattaaaacaaacaacataaaatttaaaataaatttacatgaatattgtgtatattttaaaatattattatggaagaaaataagcatttggaggattcatagactgatagcgttaataccgtaatttgtttactgtaattataattaaatattttgtatttaccgtttgcttgcatcgatgccagtttgacccaatgatgtacctcagctttgctgcgcggcaattcctcatcaaacgcgacatggggcgtctgtgatttccacgcatccaaaaaatgttcgttgtgctcctaatgaggaggaagagacaaaatcagccggaacaaaacaaaatttcgccgaggaaattacgtcctggacaaaattttaccgccaaaatttaaaaaataaaataaataaaacttagatttttcaagaaaaaaaatcttagaatttttaataagaaaatttcaagaaaaaacgctagaattttctattttttcatgaaattttcttttaaaaaattatcttagatttttttcttgaaaaatttctgttttaattttttttttaaattcggcgacgaaattttggggcgcacccacatgaactggggttgttttttgcaaattttacattgaaaaagtagcaatttttagttgtttttttttttttgcgatattttgacacggcatgacgatggacgacctggaagtagaatttgatggcatgtagcgagaagtagcaactgctggatggcgactcgtccagctgtgcagcaaccgcggaggagggcggcgagtccgcgctgccaccaccgccgccggcaccgcccttgcgaccgctgcttggcggcttgttcaacgctcgtcgcttgtcatggtacatgaacaccatgtgccgatagttcaggttgatgccggcaagcgctggcccgtcatccgcgtcatgcattgccaaaaatgagtaagccgctgcggccatttgtgtgtaggagccgcgcaaccgcgtcacaaacgggtact

SEQ ID NO: 29797 - DNA, 256 bp, Heterodera glycines
cggtgtcctctgtgttgctggctcggggctcgctccccgggcggccgctcgtgcgggccctgcggtcgcttgcttggtgggggtcgcgcttgtcgtttcccgccttcagtttggcctctctcgtgggggtggtgggtggcggcggttgttccgggtggggggcgtctgtgtaagatggtccttctggggctgtgtccagcgtgattccctaaaatgagtcaattcaacaaatgtagatgtccacagcgttattata

SEQ ID NO: 29798 - DNA, 1013 bp, Heterodera glycines
  misc_feature (932)..(932): n is a, c, g, or t
aaactctaaatcccccagaaacttggccgggactgaactgtccgtcttcatttccccccccccttttcccttccatgcctcttctccctgcatggtgacaattcggctgccaattgtgatcatcccacgtccgtggttctcttcgctgcgcaacatttgcatatcctgatcagtcggcaaagtgatcagagacagtcgtttcggcaccccgcggcgcaacatttggagaaatacgggcaccaaaacggaagacgacgaaacgatggaagagacggcggacgaagaagtggtggtaaaaccttctgaaaaacggaaagcaaatgaacgggaaacaaacttgcaatgccttttggcaaaccttccaaaatcagtggtggcaccaaagtgccattgcaatcgtcgcccgcggcattggcattcagccgaccagcaaaccaacggtccaatcgcttcagtgcttgccgatcacgaagcacaaaaaagggcggcgggctttcacaattggaatttctgtggttggagttgggggaagaaatgtcatttacaaattagtacaaaaaaggaataaatcttacaattagaaggtcaattaaattgcaaattataattctgaccctgtgagggtcctctaaatttaagaaaataacaagaaatgctgctaaaggaattgataaaatcgacaacccatggccccaataaatagcaatttcttggtggctccgcggcacttcaacataatagcccatataaagccccaaagaattgggccataaaaataaaatgaatttgcgtcacctcctcccctctgtcccatttgcggtgtcccattccgacagcagtgtttcccactcgaaagtgaagggatgcgccacgttcagtcccttctccccaaatggaacccttcgattgtgcggtctccgctcgtatttccncctgcacatttagaaaattgagttttatagaaatttcagcccaactttctctgaccatcaaatgtttagcctcggtttgag

SEQ ID NO: 29799 - DNA, 965 bp, Heterodera glycines
tcagaattatcttcctcttgtaacattaattattttttctttataataaaaacgatttcttcactttgggagtgttttttttttaaattttgtaaaaaacatatttatttatttattagtgagtgttttttataattgggacaattttgggtcggttttaattatatttttcggatatttaattgccttctcttcttcttatcgttatttaattcatttttggattttatttttcattaaaattgtccgacgatttccctttccttcggccgaccacaatttgttgcaatttctcaatttgaattcaattgaatgaatggaatggctcctcttctcttccttcgcttttccgtttttgcggtgttttttttgatcatttgtccgtcccatcgttcgctttttcttttctcccattcgttcgttcgtccgttcgtttccctttctttgtccatttctcccccttattttttccaatggaatttaaattcatcggacaaaaaatggcaatattttttctgccgtccgtccgccgattcattcattgaataatccaacatttgtccatcattccgtccgctgatgcccacaaaaagccattttgcagaacaaaaattttcatatttccgctcactcagtgccaagggacaaataaaaaacactccaaaaaatgaaaggccccaaaaagctgcagaattttgtttttgcaatttaaaaaaaataaataaattttctttgtaataattttctttctttttttgataggaaaatgattactgtgaaagtaaacattctgttcaccagctacaatggcttctgccagcccagcggagagcacaaaatgacagagcaaatgtgccgaatcagcgcagaacgaaccgttgggcaacaaattgaggcggtgatgacgtatttggccaatgtacggggcgaagtgtacgaaaatgcgatgtgttgggtgggtaaaa

SEQ ID NO: 29800 - DNA, 1153 bp, Heterodera glycines
  misc_feature (18)..(18): n is a, c, g, or t
atgcgggcccgatgatcncaaatggctagatgcaccgtcacacgtacagtcacttcgaaccgtttaaaccatacaatttttccctttttaagttcttaacgtataaaatggtttcattgtcaacatgttcttccaaataccgttgttttatttagaaattcctaaaaacaattgttatttcagatccaattaatcagtgttgcaaggaccatgacaagtatgtttgaagaaattatgaaaaaaaacgaaaattttgttgaataagatgaaaaataatttattaatgcactccaaaaccgaagcgcctcgttgtttaagtttttttagtcccataaagtataaacatatgaaaatgaagaaaaaattaaacatttaaatgctttttttcctgaaatttcaaaatgcttcgattaaaaaaaaagtttcaatttttcgattagacaaaattgagggaaaaaaaatttttacatgagtgataaaacgcatgacaaaacaacaaaaaataaagaaagactttgccaatcgtatataaaatttataatagatttgactaatagaaataacatgatgaataatacataattgataaaatacaaaacaaagatttgatttagccaatgaagatagtgacactcacagacagaatgtgatctttttatgtttagagggataattaaaaaaagaaattttacattgaaatatttgatcagaaaccctcgataattgagtattttcttatgtgctttcatgatcatttaggtgttgtaatgagttggtagaaggttggacggagggtcagccgaaggaacgaaagaagccatgcgacccgatattttgtaaatgcttggaggttcattaaaatttcttgacagcaaattatttataaaattaaaattttgtataattaacagaacgcagctgacggggatctaatatgtctgggcgttctttcggttttttgcactacaatgatggctacctttgataaatcttatcaaagatggttggacgtgagtttaaaagcaaagccaaagagcgcaattttattttgtttttaatttagcgcgttgaccggtgccgaggtttaaagaaaaaaggggggtttttaaattttcgaccgaaaattctttaattcaagaagtgacaacaaaaa

SEQ ID NO: 29801 - DNA, 1692 bp, Heterodera glycines
gttgaattaattaattacgaattgcccattaaatagttggcattttccattaaatacataaatttcatttaaaattttttcattaaagtgtttgttatatgataataggggctaaaataaaaaaaaataataaataaaaataccaaatagttttttcatttctcggaaaaaaattatttagtgttttttttatttttaaatatttatttctatattaattttttgttcgtgtcaaattgttattaaaaaattcaaataccatcttattgaattagaaccctcggggctctattttcaaccactcctattttcgaatttttagccaatggaatgaatcgaacagccgttcccgaagagaatggcaaaatggagcacacttttgaacgcatgggcaacattcagtggggcgttggagaattggagtgggaggcatggatgcgccagttggacggaaccgtaattaattattatgtaataattaaatttaattttttaaattttttccaattctaagggctaccaaactggacacaagtacagattgccaattctgctcgaaccaatgacgaaaaagaaatgaatgaacaattaatacaatagagagatatttaacctaatgcaaggatattaattctataatttaatataataaagtttttttcgatttattttttataattaattaatcattatgttggggcattcaatttgttaatttgatgaatttttgccttttaaacaatttttctgcagctttgtctcgttgagaaatgaataagaagcactttttttgcctaacaaaatgttggctttcaaaaacggcacaatgcccaaaatccgtgacccttacatcttaaataagagattgttaaaaaataagaacaatttcattctttcgagaggatttttgcaaaataaataaaacctaaacgaatttttttgctacatttattgttttttgtttttgcctttttgagttgaattttataaaattttaaggaaatttgggaataggttggaaaattttggttttgtgttatgaaaaaaaaaatttcttttcctcaatacctatacaataaaaatgagcaaaaaaaaacaataatttggagggaaaccaaagtaaacaataatgaaacctaatgcacaaatcattaaggcccaaaaagtcgctgtcttagttcttgaaagttaacccgagtatcgaaccgatactcgagaacgagactctcggacagcgctagtgaatgtctcacccaaaaagtgcattgagacggagaaatttggattaattgcgggggctaattgtaagtgtcgaaataaattggcaattttgctaatgaaaaacaaaaaaaaaaggaagtagtgggaggattaactcaaatgcgtaggaggcccacttttgcataaacaaaattaaaaaattagagtaaatgaatgaatatgtcaacggaaaaagtaaacaattttttaatcatattttatttttaggcatttaatttgttgtatttccgaataatgcgcgattacgaatttttacgggaagtttacaaaggcataacccaacataaccaagtgttggcaaaagcttttgacataatggaccaaatccattctgaaggcattaaacatccaatcactttgctttttcaacgagcagtaaaatttaataaatataaaaataatttaaaataa

SEQ ID NO: 29802 - DNA, 1133 bp, Heterodera glycines
tcatattttttgctaattgagcagaagcgtaccaaacccccacagggatactccccggtaaaggactaacttacactgaacttagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatattttttcagaaagtgct

SEQ ID NO: 29803 - DNA, 743 bp, Heterodera glycines
  misc_feature (14)..(14): n is a, c, g, or t
aaaaattaagaacntcggttatgaaaaagtattttataacatttatatactcaaaaaatccgcaattttttgctctattttcttattttattttagctttttatcacttttttgaaaaaagttatagaaataaaagtgactttggaatttgggaccacaggggtgtgaccatgatttttgagtggaaaatttttttcaccaaaaatcttccaaaaatatgattttaggggttatttgggccgctgatcacgaatatgtaatcagattttactttagacatggttaagacctcagaatcccagtgttattggggattcttaggggtgggagcgcccgtcctgaggccgcgaagcggccgaatgtcccccaaaaaatttaaaaacgggcgcgaagcgcccgtcctgaggccgcgaagcggccgaatgtttcccacacaattaaaaaacgggcgcgaagcgcccgtcctgaggccgctaagcggccgaatgttccccaaaaaattaaaaacgggcgcgaagcgcccgtcctgaggccgcgaagcggccgacccacacaattaaaaaacgggcgcgaaccgcccgtcctgaggccgcgaagcggccgaatgttctcaacaaaattaaaaacgggcgcgaagcgtccgtcctgaggccgcgaagcggccgaatgtttcccacacaattaaaaaacgggcgcgaagcgcccgtcctgaggccgcgaaacggccgaatgttccccacgaa

SEQ ID NO: 29804 - DNA, 1092 bp, Heterodera glycines
  misc_feature (1039)..(1040): n is a, c, g, or t
  misc_feature (1052)..(1053): n is a, c, g, or t
  misc_feature (1075)..(1076): n is a, c, g, or t
  misc_feature (1084)..(1085): n is a, c, g, or t
ttgagtcccagcgattggaaagcctgagaattgagtctcagagattgaaatgctggtgggttgagtcccagagattggaatgtcattgaaagttggtgggttgagtcccagtgtttggaatgccggagatttgagtctcagagattgaaatactgatgggttgagtcccacgattggaaagcctgagaattgagtcccagcgattggaaagcctgagaattgagtctcagagattgaaatgttggtggattgagtagagattggaatgtcattgaaagttggtgggttgagtcccagtgtttggaatgccggagatttgagtcccattgtttggaatgccggagatttgagtcccagagattgaaatgctggtgggttgagtcccagcgattggaaagcctgagaattgagtctcagagattgaaatgctggtgggttgagtcccagagattggaatgtcattgaatgctggtggattgagtcccacagattgaaatgctggtgggttgagtctcagagattggaatgctggtggcttgattttcagtgattggaatgtcattgaaagttggtgggttgagtcccagtgtttggaatgccggagatttgagtcccattgtttggaatgccggagatttgagtcccagagattgaaatgctggtgggttgagtcccagcgattggaaagcctgagaattgagtctcagagattgaaatgctggtgggttgagtcccagagattggaatgtcattgaaagttggtgggttgagtcccagtgtttggaatgccggagatttgagtctcagagattgaaatactgatgggttgagtcccccgattggaaagcctgagaattgagtctcagagattggaatgctggtggcttgattttcagtgattgaaatgttggtgggttgagtcccagagattggaatgtcattgaaagttggtgggttcagtcccagtgtttggaatgccggagatttgagtcccagagattgaaatgctggtgggttgagtccacagcgattggaaagnncctgagaattgnnagtctcgagagattgaagaccnntgcaggcnnatgcaag

SEQ ID NO: 29805 - DNA, 880 bp, Heterodera glycines
ttgatctaccctctgcattattttcattatttgtatcatcttctttaaataaaagaatttcagaattgataaacacaaaaattataattttattttagaacattgctatgaaatatttgttagtttttaggctaaaatctaaaacattttcgaaatgaaggggccaaggtgataataggcgctaccagaaaaaatttaaaggtgcaattaatataattcagactgcttattttgttttattttaaaaagaaaaatttcaaaaggtagttaaccctggcagggttttttgagaaatttttaatttattcaaactaagacttatcatcaaattggaaatttttgtctgtggatatccgtattttagcatgcctgaaataattctcaacgatacaaaaaaatagtaatttccagagtaaaataagttatatatatatatatgtctgtacaaaaaataatcattttttaaaaaatggccaagacaaaaaaattgccaccctactcttttaacaaaatctttatttatttttagactatttcatttaattaaattttaacgtaaaaaatttaattagtatcccaatttccccctcctttatttttcattgcccacctctttcatcaaagagaattctgcacaaaatttgtttgattttttcatcttggatcattcgcacaaagaatgggttcatcataaacgcttccaaatccaaagttgtggcgccgtctgtccgcttttttaagtgcatgtcattttgaacggcaaatgccaattgtgtatcgtccaatgggcgttcgatacgcgcccattcgatctcattgacaaccatttcgcccatgttgaacaccaacaatttgctgttgcttttaccgttccgtttgt

SEQ ID NO: 29806 - DNA, 945 bp, Heterodera glycines
cccgtttttggcatttcctgcattcatcatggcagctaattaagactgatcaaactgatcagcagcactgatcaacagaatatcatcttcgggataagcgctgttttttttgcggatcaacccctttccggaaggatcaatttaaaggaaggaacccataattatgaggaaattcaaaaaaagaaaaaaaaatgctgctactccatccaagcatgatgctgctgatccatggcgatgatgatgatgtacatagttgacgatgaatgaacgcacttttcaccccgctgctggtgtcttccgctgctgatcatcatcatcatcatcacctacggtcggtcggtgggtcggttgttttcatggagtgcggtgcggcgcccttccgccgctcgtcgtccgtcataattgctctccatcatcatcatcatcatcatcaacctcatcatcttccacttccatcctcatcatcttcttaaggacgtcgtcctggggctggtcgtggtgtcccgtcccattctgccagcaccccccccccccccgctctcccaattctttcttcttccatcctccgccgccgctacaccggcggaagggaatgaatgatgagtggggacgtgcaagccccaacaaaagcgcgccggaaaattcagtccctgcaaaattttgttcaaaaattttggcggattttaccatcggcgaacctttccttagaatttttgatggcgaagaagagaaaaatgctgcaatttgtctatccaatgtcgggttgtcccgagtattttttgggtatttgaatccctgtgacttggtgccaactggtcaggactcaaacggcctgttggccaatcacggaaagggaatcaatgtttgtttgtgcgtggatgggaggggggggggagagggcctcagttgtccgactcgccaaggacacaccctcatcatgaatat

SEQ ID NO: 29807 - DNA, 968 bp, Heterodera glycines
ccccataattgtttgagtaccccaaacggacactgaaaaaaatcgatttttttgtttccggggcagtccccccgaaccgatgcgcccagatttatggggagaccgaatccttccggaatagcttccctatagtatgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagactaagtccttcgggaatagcttcctctatagctctgtactttaatt

SEQ ID NO: 29808 - DNA, 863 bp, Heterodera glycines
ccccgagggaatgttgacgatgaatagaggcggggatttgcctttggatgggcggcggaagcacagtttgttgctggaggggaaaagccgacgacgaattctgaggcggcaaactgcgcggcactgaaaaccaattttatatgatccgatcagtcgctgaacagtttgatcctccacctgacgccgccgtccttccccgcgattctacgcccatttcgagtgactgatggccatccgatggcattcttcattacaagaaaagtgattaggaccaaatgcttcttcttacgctgttccgtttatgctttgtcccatcattggcgttcgcgcggaaagtggtataagatattcaagtaaacgaataattgtaatgaaattatttatgcaagtcggtcgaggtttaccagttactttaggaaatggaacattttcttaaattgctttggcagaacgcatcaaatatactaatatttgaattgaagaatgaattattagtgaatgcatattatttttaaaaggtgtcggaggttcataaaagaatgctggcctcaaaatggcatgactcatggcaattaacccaaactaaggtaaagacaacgtgtcataattaacagagagctaaacacacaaatagttggtttatctttctttataattggccatttaatcttagtcaatatcgctccaaccgagagcaaagaagtgccgagttttcggtaaaatgtcttgcgcggaaagtggtataagatattcaagtaaacgaataattgtaatgaaattatttatgcaagtcggtcgaggtttaccagttactttaggaaatagagcattttcttaaattgctttggcagaacgcatcaaat

SEQ ID NO: 29809 - DNA, 1964 bp, Heterodera glycines
tattgggttgtaacataaattctgtcatagttgtgaatttatttatttgtatatttttaaaaaatgtcttcgtttttcatctcgttgcttttgcccaaagactggggagcgacgaattgttttttcttgttgtttgagcccaaagactgggaacaacactcgtcaattgcttttctcttcgctcaaagattgagataaagcgactacaactcctttggatacaattcaccgcaccagttttcgagaaccaagacggttgagaaaagtgtttgaattcggcagaaccaagacggttaaaccgaagattttgcgtgaaaaatttgagaaccaatacggttgaaaacaaatggttattacacgctcgccaaacttaactcgccagagaacccgacagcagggaataattttgaacaacgacgggaatcaaattcgggcaccggataacgagcaacaaatttagagatcatgattccggcttcagagcaaaatgaaatgagaaacctgaattagccgattaatcccgtaaatgatctttcaggagacggcagcattttgagtgaaacacagctgataaccgacttttggaagtggacccgcacgaattaaaccggcagcgaacgaagaaaggatggtcgaacacttagcgttggtggcgccaatagtcaatgcaggtttggggcgtctcgaaaattttggaagaaatatgggagaaataaatggcggcgaaataaggaatttgccaccaattggccacctttttgaaagaaatggagattttgaggatagttgggttcgggaaagacctccactgaactcaccgctattcgagtcaattcgccacgcgtatttgaatgtgggtagagccgaaaacaggggtcatcatttaccgccgagttttccaaatcgtgccgtcgaagcgtatgccaccggtggtcagccaactgcacactacacgcgagcccacgttatccaacaactgcacacgttctatacgcagccgattgcagtaaaaccgaccgtagtgcaataccaagcccatttacagcaacaatttgctcccgcggcaccaaatcgcatccatagtcctgtctcagcaaatttcaaccgtgatgcgaacattggtcgaaaccaacaaccgcagacttttcaacataaagaaaggggccaacaggtccacaaacaaattgcttatgcgagtcatgaccatttgccattccaaaaaggcacaaactcccgggatggaaattttgggcaaataaaccccgtgaatgaacaaaatcgttactatcagagtaaccaagtcgaccccaacatgataatggcgcagaccattaaaagtcttgacaatttctcgtactcaatgacgctccaccatttgccagagctgagaggaaatgccggagcggacgaagtgaatgtcttttttcgccagttggacgcagttagcgaagattggcccaacgataagcgcttaagcgccgcgttaaagtcaaattctcgggtaggtcagaacgcgcaaccaattccgccgttgccaacaatcccttccggtatgaaaatatccgaagagcgatgaaacaacaactcgattcaacggatgcgaagtcaacctgtgcttttgatgagttgatggcaggtgtccgcagaaggaacggagaaagcattgacgatttggcggaccgagtctcatcgttagtgcgaagggcataccccgggctcggcgaacattcatatgatgattattcgatccgacacctcatccgctcactcaaaaatccggatttggcactcactttggaactggcacgcaaacacgatatgatcttcgacgaattcgtggccatggcagctcgcgcggagatcacacaaaaattcgcaaaagcagccgagcaaaaagacacaaattttcgccaaaattttgatcagcgtcagcaaataaatttttgaccaccgaatcagcccga

SEQ ID NO: 29810 - DNA, 828 bp, Heterodera glycines
ctgttgcaaatggcaaatgtcgaccattgggccattctttgccggacactttttgttcagccaaaaagtcagaaacagagaaacggacgatacaaaaaaaacgaaaatattccttattacgagaagaaggttttttggacgaaaatttcctcaaaaagttgctattcttcagggattcttgaaaaaaggaatattagtcatttaaattttcgataaacacccgaaaatctccctaaaatttgctattttttgctaatcgttgttgtttcagttttctcggaattcatcagctgccagagaaaactgttgtctgatgttagccgacggtgtcgtcccccaaatgcgacgacggacagtggcgaaaagccaaaaacgattggccttttttgcagtcaaatgaatgcctacgcaaaatgctaccgacggactgcacaaaagtgcacaaaaaatgcgacaatagtaagagaattggggggggggggggtggagggtcatttgtttttgatggctccaggaaaattcgcacagtaatacagtattctagaataaatttctgtagcattaagcattgtattttgtataatgaggtcaaaaatataataaaaacctcacaaacaacgtgctaaaattaaataaaattttgaaaattgcccaaacccttaaaaacaaaatactgtaattggcttttgttaatttttttcccatatgattttgaccgattgaccaactgataatgaccgacgttttgattttttattaatcgatcgcatcaattagtcagtaattaatccgtgctttgtgaagatttcacgccgcctttccgatgca

SEQ ID NO: 29811 - DNA, 1256 bp, Heterodera glycines
  misc_feature (65)..(65): n is a, c, g, or t
  misc_feature (69)..(69): n is a, c, g, or t
  misc_feature (73)..(74): n is a, c, g, or t
  misc_feature (80)..(81): n is a, c, g, or t
  misc_feature (106)..(107): n is a, c, g, or t
  misc_feature (132)..(132): n is a, c, g, or t
  misc_feature (138)..(138): n is a, c, g, or t
  misc_feature (155)..(155): n is a, c, g, or t
  misc_feature (158)..(158): n is a, c, g, or t
  misc_feature (203)..(205): n is a, c, g, or t
  misc_feature (209)..(210): n is a, c, g, or t
  misc_feature (214)..(214): n is a, c, g, or t
  misc_feature (234)..(237): n is a, c, g, or t
  misc_feature (242)..(242): n is a, c, g, or t
  misc_feature (276)..(276): n is a, c, g, or t
  misc_feature (290)..(290): n is a, c, g, or t
  misc_feature (332)..(332): n is a, c, g, or t
  misc_feature (358)..(359): n is a, c, g, or t
  misc_feature (363)..(363): n is a, c, g, or t
  misc_feature (366)..(366): n is a, c, g, or t
  misc_feature (370)..(370): n is a, c, g, or t
  misc_feature (372)..(375): n is a, c, g, or t
  misc_feature (380)..(380): n is a, c, g, or t
  misc_feature (386)..(387): n is a, c, g, or t
  misc_feature (393)..(394): n is a, c, g, or t
  misc_feature (397)..(398): n is a, c, g, or t
  misc_feature (407)..(412): n is a, c, g, or t
  misc_feature (414)..(414): n is a, c, g, or t
  misc_feature (416)..(417): n is a, c, g, or t
  misc_feature (419)..(419): n is a, c, g, or t
  misc_feature (421)..(421): n is a, c, g, or t
  misc_feature (423)..(424): n is a, c, g, or t
  misc_feature (436)..(439): n is a, c, g, or t
  misc_feature (443)..(445): n is a, c, g, or t
  misc_feature (449)..(449): n is a, c, g, or t
  misc_feature (454)..(454): n is a, c, g, or t
  misc_feature (460)..(465): n is a, c, g, or t
  misc_feature (477)..(478): n is a, c, g, or t
  misc_feature (483)..(485): n is a, c, g, or t
  misc_feature (491)..(491): n is a, c, g, or t
  misc_feature (495)..(495): n is a, c, g, or t
  misc_feature (497)..(498): n is a, c, g, or t
  misc_feature (501)..(501): n is a, c, g, or t
  misc_feature (505)..(505): n is a, c, g, or t
  misc_feature (508)..(508): n is a, c, g, or t
  misc_feature (514)..(514): n is a, c, g, or t
  misc_feature (525)..(525): n is a, c, g, or t
  misc_feature (528)..(530): n is a, c, g, or t
  misc_feature (533)..(537): n is a, c, g, or t
  misc_feature (539)..(541): n is a, c, g, or t
  misc_feature (545)..(547): n is a, c, g, or t
  misc_feature (549)..(552): n is a, c, g, or t
  misc_feature (554)..(554): n is a, c, g, or t
  misc_feature (558)..(562): n is a, c, g, or t
  misc_feature (564)..(565): n is a, c, g, or t
  misc_feature (567)..(567): n is a, c, g, or t
ggggacctctagagtcttaatcccgcgggagtcccgatcccgccggactcttccataaagagacncagngacnnggaganncacgggaagaacccctatacccatnnaaaaaacgatggagaggaaacgagnacgaanccaaaaaacccaaaaanaanaggggcaaaaagacaaaaagaaaggaaaacacccaacaccgccannncacnngaancaggcgggacgcaaccggannnncaacnagaacatgggggggggggggggacaaaacgccgnaaagggaaaaccanaaaccggaacgacggggggccaaaacacgccggaagacccanaacccacagcggcgcccaaaccggcnnaaanacncaanannnncacangggccnngaaaannaannacgagaaannnnnncnanncnananngggaaccccagnnnnaaannncaancacanaaaaannnnnnaaggacgggccnngccannngagagngaananngcngggnaanaaaaancaaaaaagggnaannngannnnnannnaaannnannnncncacnnnnncnncncccttttcctcatcgctcgtcactttttccttcattttggctcgaagaattgggctttcatagttcagtttcactaagttttgttccttcattgtttcaatgttcagtgttatggatttctaaaatttaataaaatttaaaaataatttaatttaaattgacaaactttggccatttttgctggtccgaattcaatgcgaatgttttgccaaccttttaaaatatttcggtcaattttaattacacttttttctccctcccaatttgtttttccgttttggatgacttcttcttttgagtcaatttctttcaaagctttgtcaacatctgtgagaacagtgaccaacacttcgtattcattggcaggtgcaaattgaaaggtcaaataatttccatcaccacaaaaaactttggcaaattgtaacacaataattaatgttgtaattagagttaatgagcagctcatttttgtcaaaatattttttaattttaataataatataataataatttcagttttgcgtaagtgaataatagcaaattttatgtggcttgaaaatcaatagtcaggcgctatttgaaaatggttttgaattttttaaaatatttatccattggtaagcattaaaatataataatgacgtactttagccctaacactcagtcgacaaataagttcactaatgtat

SEQ ID NO: 29812 - DNA, 1150 bp, Heterodera glycines
  misc_feature (57)..(58): n is a, c, g, or t
aaaaaaagagatagccatttttttggacggtccataccctcacatatactcaacggnnccgaaaatcatttttagagcataacaactgatgacagccactgtcattgtttccaaagagatttctattaccagattgccaaaaaaagagatagccattttttaggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccataccccacatatactcaaacggcccgaaaatcatttttagagcataacaactgatgacaagcactgtcattgtttccaagaaatttctataccagaatgccaaaaaaaaaaatagccatttttttggaaccttccatacctcacatataatcaaac

SEQ ID NO: 29813 - DNA, 1001 bp, Heterodera glycines
aataaataatttaaaattattttttagaaaaattacccttgtgttgtgttgggtactaaaatttgtattccgaaatagaggctttttaaataaatatatggaaaaaccaggggaacaattccataaattcatgaaccaaataaataatttaaaattattttttagaaaaattacccttgtgttggggtactaaaatttgtattccgaaatagaggctttttaaataaatatatggaaaacccagaggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgtgttgggtactaaaatttgtattccgaaatagaggctttttaaataaatatatggaaaaaccagaggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggggaacaattcccataagtcatgaaccaaataaataatttaaaatttattttttagaaaaattacccttttgtgtgggtactaaaat

SEQ ID NO: 29814 - DNA, 1102 bp, Heterodera glycines
ccagcaatttctgataattttccgactgaaagcgagcaaaacgaagatgtgtttgttggcgaaaatgaaaacaacatttcaaagcttgacttaacagaacctgatgcatcatttttgcgttattaccaattcaataagggagacaaaaacgcaaaatgtcgaatttgtggagttaaaatctcacgcaaagggcgaaacactacaggaatggacaagcatctgacacaacacaaaaagtcttaaaattttctttcatttctaagttgtttttcaggtatcacaagatgtatgctgccgcaaaagaacaaaaagttagtcaaaaaagaagtgcttcagtatttaatgaggaatcatcttcccaacaaccattaaaacaatatctactagttctatagtcagcggtcgtcaataaaaaggaaaaatgatacagaacaaataaacaccccgataaataataaataacaaaaattgaagaaaaacttttggttaacaaattacacttatcggaaaaagattgcaaattaactgaacctaattgttaacaatgtttcggtgtgaagttagtatagaattaatgtcaagtatttttgcgtgtctctgctcaaacaaagaattgatccacatttgaatcggcgaatcaagtgtcaatttcaaatccgatccgattattataccggccaattcaccggcaaggttcagcactgctcctccggaacttccaacgttgcttcccggagttcctactaaacagcaaaatttaataaaaaatcaatgtacaattttttttacatattccatttccaacttctccgatgattcctttatcaaagcgagggccattattttcagttccatagggataactcttaaatatgagagttaaatggtttttgacagggttggaactcgaatttcagggaaaattctgagcaggatagaataaaacatgaaaaacccaagaccgggaccgacttctctttttggctggaaccgtgattagtacaaccacttttttagaaagtaagagtaacctactatttcaaaatcaataatttgatcataaacgattatttacatacgacgataaaaaaggttgctccct

SEQ ID NO: 29815 - DNA, 1368 bp, Heterodera glycines
taaacaaaaaacaaagagctgctgtctgtcctccggcgcgcctccgtttttgcgctttatcaacagacagacacaacaacggaatacggggtgagaaatagtgtgtgttctatagggagaggggaaagaagcagagggaggaaatattgcatgagacagagaaagaggcgaaaaattggacacgtatacataaagcatcacagcaatttaaacaaatgaatgaggcgcaggggcgggtcgccatttttaaaatgtgtgtcaacactcatcaatgaatggttagcagcaaaattaatgatgaggaagaagagagggagggagggagggggggatcaaacagacataatgagagagtacataaaaagtggagagaggggaaagcagacaaaaatttattgaggaaatagtataaaaaatacgttgaaaaagaaagagaaaatagagaggacatacttacataaacacaaaacaatgaagagaaaaagaaatttgttttttatgatggcgtcgtctctgtggtcattcctttttttcttaaccaatgcaacaattttcagcagtgtgtgttctctctccattttctatttctctgtctctctctatacacatattacaaaggggcagagaaatgaggagggaaaggaaaagggaagagcataatttgagaaaatagtacatggaaccagcaagcaaagcagagaaacagagaaattgaaggaaaaggaaaaaaagaagcatactttgagaaaatagcacacggaatcagcaaggaaagcaaagaaacacagaaattaatggctgacgcgactgcctgacgcagtttgagtgggtgtgtgtgtgtgtggtggtgcaacgcggcaccggttgacaccgctcgccaccccgtgtcggccgcgccgcgccccgccggggtctcccaccagggacggcgagcgggcgggcgcacatattcagcctcaaaatgtgtgcggcgccgcgccgaagcacagcggcagagacgcagacagacatgtagcatgcttctttttctcttcattttggctgctatttccgtcattttttacttccctgcactcaattttttttgttggttgcacagcaaatgcttgggaattcaaaattttcgctccgcaatcgccgcgcctattttctctcgtcagcgctctctctctctctctctctctcacttctccattcattcaatcattcacataggtatataagccagtgggtgtgatcactgatcagcggagagcacacagaaatggggggggggggggagatgggctctgtgaacgcgtaagggaagcgcaacgattgtgaaacaaatggaggaaatgaatcgactgctgtagagggggggggggg

SEQ ID NO: 29816 - DNA, 976 bp, Heterodera glycines
  misc_feature (25)..(25): n is a, c, g, or t
cgaaggattcggtctccccataaantctgggcgcatctcggtctccccataaatggggggatcggtgcccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctactccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggtttcgggggggactgccccgaaacacaaaaatcgatttttggataaaaatccgtttggggaactgaccaattatggggagcaaaaatcaacgcagaat

SEQ ID NO: 29817 - DNA, 1372 bp, Heterodera glycines
  misc_feature (94)..(94): n is a, c, g, or t
cctacaaatttatgtttgtgattgatcgctgtttcgaaaacacaatcaattttctattatgcttattacatgcaaaagaagacaaaaaatgatntaaaacattcatttgtaataaaaaaattgcatgttttaaaaacagtccgaaaaaatttctgcaagaaattacataagaaattaaaaaattttttaatttctgagtcgggattgagaatcgaaaataatgatttatttattacaaaatataaaattatcaatttgatagtccacaaacaaaattttaaatctattggtataaaagttaaattcttgtcgcgtttttgtccagcctgtggtgtttggaaccaatcgataatggagtgtactttgttcactcatttccctttggcatatttcctccccacatataagcaagcgatggtttccctccctccctcgttcattctgttctttctcccatttatttccttcaattgcaattcccttcgcttgagcattttattattatatttgtgctccaaataaatattcgttttattcatatctgttgttctcggacacaacagattttgtcgcagtcagtggagcaaaagcgaactgaagctgagcggcgaaagggctgagaagcaagcaaatttggattgctaattccgggacggaatagcaattttccaaaaatcgtcaaaggagagaaagctaattcctagttggaatagctgttcacccaggtggtagcactctcaatttctggtgttaagccagggcggataactgccagcgacggatcaccgaatttggagtaattcgagttaaataacagttgaccagcaccaattttcattgttaatccggtacggataacaattgaaatcactgtaaatcaagacggattacagttgatcatcatcttaagtttgatccgaattggacaaattaagaaagacaaatatggcagcagtaacaaatgctggaaaaggcccaggaccatttttgccggagatgtgttgggcaacatggtggaacggttcgaattttcatccagctgaaaggcgtgaccgatgctgcaacaaagagccttctcctgttcaccgaaatgggtcaggtttatgaagaggtgcgaagaatggcatagcctgaggattccgaaccatggtcctcaccgaaattgaacaattgatggtggaacgatttggcgaagcaaaaacgattgccaattgtaggcattaattgttttagccaagcagcagacagggcaatcgataagggactattcggtgcagttgcgaagcttgatagcaaaagcagaatggagccgcgacagcattgacatgtgtctttgcgcattgtttatcatggcatctcaaatgatgcaatt

SEQ ID NO: 29818 - DNA, 1951 bp, Heterodera glycines
  misc_feature (64)..(65): n is a, c, g, or t
  misc_feature (174)..(174): n is a, c, g, or t
  misc_feature (209)..(209): n is a, c, g, or t
aatttttgtacaattattccgtctaagcttttatttatttgccattcattcgcttttcaaatgnncaattgtaaaataattcattaatggcaaatttgtttcgtcataattcaatctgtgctcattcaacaacttggtttcaaaaatattgtcaagccatttgaacagagattntaatttatattcataatttttattccaagataatntaaaataaaattgcgaaattttcgccagacaattcaccacataaattattggcccattaatttcaatttggtctttaaatacaaactttggcttcactgtgtgaataccgttgtattctctgaacaaatattcgtacaaaatgtccaaaaatttgcgatatttttggcattcggtgcgttcatattcttcaaatttctctgctattttgtcacatttccaatgatggcctttcataaatgcaattagcatattgtcatcaaactaattaaaatagccccgtaaaattaattactcggattaattaactcaccgatggaattgcacatgaaatatgaattaaataaagatgtataatagcagtaataaaaaggagaatggttgaaacggaataaaacattataaatatatctttctttaataaaaaattaaatctaaatgagaaatatgacaaatcacacagccttacaaatgtatcaaaaattgggtatttaaataatgatcataagtaggattatccaaataaataatttacttaattgaatttgattattattattattattaaattatgatgcaattatttaaaatggtgattttatgagttttaaaatagtaaagaaaaactcaatcagatgatgatcaatcatttttttattaagaccgttcgtgcggcaaaaactacaggatcacggtgtgtctcttacagtagcaaaactgccttataaacggttccaaaattggatttgaaatagtgttcattagagttaggaatttcatgtacatacatattttacttaaaacattatttttaagtttaattaggtcatttcggagcgtttgtgcggtcaatattacaggaacacggtatcactattacagtaaccaaaaacttttttaaatgtgaaccgaaaaaactcatcgattttccgtggcaatcctttccttaaccaacctcgtcatggcacaagacacacatcagcttggccacaaaaatttattgttttactcgcttcgccctaacggctgaatctgccccaattcccatgggcattttccgtctccggcatttcttaaatatgagcaaaacaaaaaagcccccccccatatatccgcttcattttcacaatttctatagtttaaaatgccatttatcccagttttaatggcatttaaaataaatttttcgcaacattttcgataaataaatcaataaatattttttaagacggcaaaattatataatgttttagcaaaactgtatttattttttatttgataacttgacaattctcggtcatacatataaaatagaaattagtgcactttgcaaaaacatatttttcctggtattggaaagtttttagtattttcaaaaaccttagatcggctcccgtttaaaacggccttcctatatttttaaaactgaaaaattttccaacaaatcacttctatgaatttttttaagtaaattgccaataaaaaaaatgaaaaataaaataattaaaaataataatttgaataattgaaggaagatttcaatcttaattggtcaggaccagggaggggggataaaggctagaaaatctggggaccggtaaattggacaccagaaaattgtacaccaagcggaaaattggacaccgtcggaattttggacaccaaaggaaaattggacactgtaaaactgaacactaaattcctcttttaaaatataaatccagtaatttaaacattcaatatg

SEQ ID NO: 29819 - DNA, 1646 bp, Heterodera glycines
  misc_feature (1575)..(1575): n is a, c, g, or t
ccaatgtgattaattccatttatagacacaataaaaacgtattattattttatcatttatttattttatttttgacaattttattgctgccttttcactcctcttttttgtgcttcatgtgatgatgatatttgtattagttaatgtgtttatttggcccaacaaaattaacattctcatctatttatttcaacgctcgcaaaatattatattcaataaaataaaaacaatttttgttatttttattttgtcctcaatttcccaaaaattttgatttaattatttattttgattaagttaaacggaaactttaaattatttatttttagatttaaaaatggaaagaatttcactttttgtcaatattgccggcattgtgttcatctttttctgtattggaaggtgatagccctataatttaatattaaaaaaaacagtaaaacttttttttaatagaattaaatatctaaaataattatttttatttgtttagtaattaatttttgttaattaataagttattttgattaaaaaatatctttaattaaaatattttttccattttagtgatgccgtttcaatttcggactgtgccgaacggcgctttcccggctccgaatcatttgtctgtgtgtgcaatcggacattctgcgacctgccaattgggccccatcggttgggcaaaaatgacaacaatgccattgtgtacatttcggacccggccaaattccgtctccatcaacagcaagtgccaattgaggtggaatacagtgaccaaaatcgtcggaaggataagccgcagcgcatttgctcatcggatgacgaaggtatggaaaaaccagcacattttggcagtaataattcagacctggcaaatgccatcaaaaaatgttaactttgccataaatcaattaatgattgagggcctttgaaatgctcagttgttccttttttgtttccttaatttgagtgcaaaatgatcaactttacgtagttttgtgacattttaccggtactggggagcaaacgtaaagaattattcaaattttctaaaaaaaaagaagaaattcgcattcgaaaattcataaaccctagcgacccatagaaaaccaaaataatgattatacttaatgcctttgaacaaattttaaagtgtgaatttttggacaattttttttattaggcttagcagtaaacatcctgtcagtgtttttaccatggagttgggttttttttttaattcggaaatattagtaagtcggaatttttatcccgttctaaccactattttattttctattttttttattatgtcttccataaaagcgtaaaaaatgtcgctgaaatattaattctcatatttttgagtgctgataagaataaccagaaaaatagtttaaatctaattacactaattttatgaaaaattccaatttaaatttaaggtttctattgtgccaaacccaccaatgtccttgtcaaaataggcacgcaacagtgttgcacgcgtggtgttgctcaacgcgttcaaattgacgccagccgcgtcagtgaacgcaccgccagagcccaganctgtttgatactcttttgaagaatcctttaacggtttcgatcccttcatctgaaaaataatgatggttttt

SEQ ID NO: 29820 - DNA, 934 bp, Heterodera glycines
aaatttttcacccccagaattattaaatttattaattagagcagaagtagtgcaagagttgtgcaggagttgttcatcagtggttcattagttgttcctgagttgttcaaaagttgactattttacataccaagatgcgcatgcagtatcttggtgagacttgaagttatatccaaaatttaaacgtcaaacatctttttacactgttttaagactttctgatgtattacttttgttctttctaaaaaaattttttttcggattctggacatgattccgcatcaagtatctttgtgtttatttgacatgtaatgcctaaatgcatgtagggcgtctttacgcattattttaagtatttccagtgtaaaaattttatcataattacccaacaacccctcagaatccctgcgtatcacccctaattctgcaggcaaaaatttttttgaaatttttatattcccgtggattgcataactcaatttaaattagtgctaaaagtatgcttaatagctcattagaaccgccaaaatgtgaaggtgtgccctttctccaagcccaagacgctatctttaacacccatcgcgctagaggccgacaactgcggcacgttcaaaaaatttccgaaaattttcaaaaattttctgaagaaacttttttttacgttaaaattttaaaaatcgctttacaccaatcgatgcaaaatccttaaaaaatagttgtactcttttgttcggagccgatccgagcattttgaagagagttattcagaaaattgccggaaaacctacattttcctcttatatagggaaccagggccccaaggggccctgtgaaagcgccggggccgctttcaacaccggggccagccggggccattgggttttccccgcgcttaagtaacttcgctcggccgcttcgcggcctcgttaggggc

SEQ ID NO: 29821 - DNA, 1475 bp, Heterodera glycines
aaaatttcgaaaattttcaaaatttttcgagctaggcttaaaaaacggttttcgggtttttgaattttaggattttttaacgaattttcccagaaaaacgaaggccacttccaaaacatagtttttcgagctctatcgactggtatttttttcggaaaattttcgattttttcccggaaatagaaaaaatttttggcctaagcgggacatttgagtcccgggcccataactcgtcaggagttggttttagccaaaaatggccttagagcaaaattgtagagctttttaagctctatcgaatggtgtacttcatgttcggaaatttttaaaaatttcggagctaggccccctagaaattttcgaaatttttttttgggttgaaaaagtgggtgaaaattccggtccggaggccaactgagcgccagcggcgctgaaacggccaactttgaaaaacgagctcggttttcgggctgtaactttttcttgggaaccgggagcggaaaaagtctgctgagagggcacaccccagacatgttggctacaactttgtcactgatcactttttgatcagatcaaatgccgagcctgtagaaattggcgactgaacggcgctcaaaatgccggttttacgtttttcgggaataactcgctgggggtttagcggagcgggttggcgccgcttgagcatttgtgtagtttttaaagctgcatccgatggcgttttcagattttgaaaattttcagaaattttcgagctaggccccctcgaaaatttttcgtttttgaattttattattttttgccgatttttcccaggaaaacggagaccactttcaagcaaccgtttttcgagctctatcgattggtggcatttttgaaaaaatttcaaaattttccggaaatagaaaaattttccggaattgagctccccatttccgttcaaggcttataactcgtcaggcgttgattttagcgaaaatttgtctaagagcatttttgtagagaattttaagctctatctaatgtgctttatctcatgtttttatcatgaatttaaaaaaagttataaaattaattgtgattttgaaactcaaaaccataggggggaccccatggttttgcatttcatgaaaaaattttttactcttaaattagccaaaatgcatttttatggcataatttgaggtgctgaatacgtatatacgctttattttgcgtttcagattttttggaaggtgtttaaaattttttgaaaaatcgtcaaaatttgagccccggaaatccagtgaaatttcgaaaatccataaatctccttcgtttttggtcaaattttattggaataaagctttaaaaatagaagaaaaatggggagaattttatgggatttattagaatttctatcttccaaaataaaaaaagtatcccaaaatttctgaaaaaaattccatttttccaaaaaaaaattcagaactccc

SEQ ID NO: 29822 - DNA, 1072 bp, Heterodera glycines
  misc_feature (1064)..(1064): n is a, c, g, or t
gccacgcccaccacccccgccccagaagagccatggacatggcaatggcccgtattggtgctgttggtgacggtggtgatcgccgccgccgcacttggtggtaagaaaatttactattttggttaaatattttatggtaaaatttaacttttcagtgggtttgtggtgtcggtatcgccggtcgcggacggggcctgacgacgtggagtcgcaggcgcctgttgcggtaatcataatttttacaaaaattcttttagaaaaattcttttttgggtgggtaataaaaatgtggggttgaaaacaaaaaatgctaaaaaaagttgctttatatcccccgaaaaaaattttcagcgaccggaggaggaaaatggcaaggacaaaaagaagaatgaggaaaatggcaaggacaaaaaggaggaggaaaatggcaaggacaaaacaaaatgtcgtcatgcaaaaagcgacgaaaagttctggaaaatttactaatctaaaacttttttaagaaaaaatattatgaagtttttcttattagaaaattctaagaaaaaaacttagaaaattattatggtgaattactaagatttttcaaaaaatttcccaaattcgttgaaatttattgtgaattttttttgttagtaatttttttggaatttctggcgttttttggcacgatttacgacgttttgtcccgacgacgtttcggccgacgttttgtccggcgccggcgcacccttgcttgttcactttgctctgattgtgaattaatggtggtgacattggtgggtcaatgccagttcgtacagtaaaaaggtttacaaaattacacctaagactcagcttataggcctaagcctaaagttagggattattctagcaatacacctttctagaaacgtctattttacgaactgtcaattcaaaaaaaatttctgttttcggtggataatgagtagggctcggatttttatgtgctaaaaatcctgaaatatgtaataaaatatgtgctaaaaaatgctgaaatatgtgctaaaaaccccccaaaaatgccaaaatatgtgctnaaaatatg

SEQ ID NO: 29823 - DNA, 1045 bp, Heterodera glycines
aaatttgttcactttttttgcataattttttttatgcaaaatttgtttttttaacattggaacgtattgcatactatttaataaattgaaaaaaacattttaaaagataatttagcgctagttaaaaattttctgtataaaaatacaaaaaaaaaattttctaaaaaagtgaaaaaattttcaaaagagggcttctttaaactagcaccaacttttgtgtttattaaagcattttttatatttcttcagctacattgaccattccgtcattgaatttctccgttcaaacaagcacatttgggacagaagaggcaccaatttggaagtgtttgtggatgcaattgatatgggtgttcaaccgatttgggatgtttttatccgtcaaatttggcctatttttgcgacaaacattcaccatttgggctttcgcaatgccgatgctttgaacaacttgcgcagtcgcacttcgccaacatttctcactgatcttgatcaattgaattcaattgattccggttatctgtgccccgatggaattgctgatgatgggccaaatgcaactgctggccaagcgttgaccaaatggctgcacactccgacaaaaaatgggcaaccgaagcaattacgtttccgtgcttatgtggttccaccaaatctcgaatggctcaacagcttcaaagaggtcgtctcgccagaattttcgtcaatttgtttttgttttaccaatttttgtgtttaggcattccgtcgtgccaccacttctgtctgttacaatattcaactttattttcgtgtggacacaatgccaactgaacaatttgaattgatgaacgaacggacgaaagaaaagctgacactgaaacaggagatcgacgaattcgacgtaaatgtgtataattggctgttgcaacggtgcccaattggggagacggcgacggtgccagcaattaaatggaaagacagcttagatccgagtgccaatttgaacagtatcagatttgatctgtggaatttcgataaatccattgggtgagcagcaacagca

SEQ ID NO: 29824 - DNA, 660 bp, Heterodera glycines
ataaataagaaaaataaaacagatattttataataaattaaggcgataaaaatctaaaaatagaaattaattttaataaattttacaccgttctgagatgaagaaaaaaaatgaagcagaattacaagaagtgtgaataatttaagtatgatgagattgaaatagaacaataagataagaatataataattaaaattatttacaataaaattaagaaattctgtgtgtaaatgagcgattaatgaaaaagcaaaattaaatgcgtaattatattaaaaaaagaaatattttaaatttttaatagaatttcactactggtaaacaattgacacaagcattttttaagatttataataattatattaaacataacggataaaaatgaaattatagcaaataatcggcaaaatatggaaataattcacagtaataagaaggaattaatttgtagtaactagggctaatatttataggcactaaaaaccgccaaaataggcactaaaaaatggaaaataggcactaaaagggatgtaaaatgaaaaatgtattcaaaaaagtaaaaaaattagggccaaatcagtattgagataaatatttttaaaatcacaaattcttgtcaacaaacaaataaataaattttggagaaaaattttttgaaaa

SEQ ID NO: 29825 - DNA, 1248 bp, Heterodera glycines
gaaattcctttttccattggaaaattgaagcaccgggaaaccactcaattccttagcaattttaatttcccatttcaatgcatggcattttttgtccttttcttttcagttgtttttttctttcttcaaattggattcactatattaaacttatcttgttttgaatattgtttatgagctgaatatgtaaaatatattaataatttattaaattaatattttagattttttaaatgtttaaatttaaattcgtctaataaattcccttaaaagacaggtaaaaattttctaaattaatgcaaaaccttttcaattttaaaataaatttgaataagagaaccaagtcctatactttttctttcgtttaagtataaaaataggtagtctattatttcaaatttatataatttatttttgtacttgaaagtcccaattcttttttccatcgacttattgtatttcggccaacgcccaattctttggcgattttatttgttgttattggctcctccgcacattcctgctttcttttttgaaattgcttaataattcgaagtttttcatcgcgttcgtgacttattttttcaactaaatattgaaatattctattattatataaataaattttaatacaatatttaaaaataaaaatttagtttcattcgctagcttactaagtacgctctattaattactattaaaaaaggtataaaattttgcaatgtaatcgagaaaaaataatgcctatcgaattacactaaaaaaatattcgtttggtgcttccaaaaaaaaatgtgattttatttaaaatgaaatatttgaccaaatggatcgcgacgaaccagggttgcacgcattacggcgctacggaaataaaggcctttttggactctcgtaattacggattactacttccgtatgtcgtaattacgattcacggattaccataattgaaaatccagttacgggtagccttaatacgaactcaccatatccaaattgccttttccaactataaattgagcttgcgctggtttgtaattttttcgcaatttgttcgtccattttgctaattagaccagctccaaattcatttgccaattgctcttttattttaatgaattttttaataattagtaatttttcttcatcttaaaacagttaaatttttatttaattttataatgataaattaccttttcgataaaagaatttcttctttgacttatttttataaatttttatttt

SEQ ID NO: 29826 - DNA, 939 bp, Heterodera glycines
atgatcagcagtaatgaatggttaaagaatccacatgctcagcctccaaccattcaattgcaaactgtttcaattcatctgaaacaattccgtaaccaaaatggcaaaaccgatctgctggaagacaacaaaaaaggcgaacaattaatgggggaagtgatgaccatgagcagtttaatggggacaaataccacgggaaaaagggatgccatgggctgggcagtttaatgggacgagtgccacggaattccatgggcattcatttcggcatgttcagatgggatcacgggcctatccgcccatcagattcaaatcctacagaagatttgggaacgctctccggaagtggagatctccgactgtgcccgcaatattatggcccacctcctccgctcaaatgcccaaatgtaccaattcttcgatttggtgcttttcgcttttccgttcccttcgccctctgtcccaattttatttttacgtcagctcggcctcagtgatcgcgaaatttcgagcagtccaattttcgagcgtcaatccgctaatttcgttgtcgttctcgactttgttttgggtaatcttctcgaggaaatacaaaaggtttctctctctctatccttctctttttgtttgattttcatttcttttaggtttgcttggcacttcaggtaaaaaaagttattaacaataagacaaattccaaacaatttttagcatttgggcacacaacacgcggtaaaacagaattaaaagcattggaaaagcacaattcatttaaatattgcaacaaataaacaattaattcccctttcagcgacttccctttcccatcgaaacgtaatttgcccattgccattgccccccccccactgatttatgtatttccctttcccttgcattctctaatcagccaccattgggcattgttcagccgctgctttg

SEQ ID NO: 29827 - DNA, 1285 bp, Heterodera glycines
cgacttttggggatttgcaacttggggacccgacatttggggacccgacttttggggatcccgacatttggggacccgacttttggggatccgacacttagggatcccgacatttggggatcccgacatttggggacccgacttttggggatccgacatttggggatcccgacatttggggacccgacatttggggaccgaacgacatttgagcaaaagacacttaagaaaaccacggacatttggcaacccgacatttagggacccgacatttggggatttcaataaaacaaaaaaaaatttaattctaagccacaaaattagacaaaattacgtctgctttagccagagttaattccattgcagaaaaattaattaatattttaaaaattaactctgtttccggactcaccgcgaggaggcgcagaattttgagcccatactaaccacaacacaatagacaaaccacaatacattttttaactacagtagacctttttctaatttttatttaaagtgcctttcccaagggccaacgggaacagaaatccgtcaaggacattcaaaaagttccagccgactttgctgtctaattgcgtacagcaacaaaatgccgaggtcatcttttcggtttcttatctttcgggtgactttgttcggtgctttaaatgaattttttaacgaattaattttttgtggctgacctgcaaaacaaatctcttccactggtcgccctatttcggtatttatttttccaaaaatatatccagggtgtagtcatcaacattcacactgaattcataagaattcagagtgagcacaaacgggaaaaactcctttaagatctgtttctcttcgcaagctaaaataattatatcttttcaaaaaataaagatttttatccttttatttcttgtattagcaaataaatgttgagggaaactgagcccatttccatcaaaattgtggaggcggtaatgtacgggtgggctttaatgtaggtgcttataccgggggggggaaggcccaccacgaggccgcgaagcggccgagtgagtaccttcggtgcaggaaaatattaaggaagagagttcattatttatttgttttttgcaaaattaattcataaatattttttagaacgtgctctgaaacacacaaaactttatttacaggttagtttaggcactcagatgctttcactatcaaaaagggagatgaataaaaatctaaaaatttttaattgctttttaaacgagcgaaaaactttaggcttaactttttt

SEQ ID NO: 29828 - DNA, 1205 bp, Heterodera glycines
  misc_feature (1150)..(1150): n is a, c, g, or t
  misc_feature (1168)..(1168): n is a, c, g, or t
  misc_feature (1175)..(1175): n is a, c, g, or t
aattttgaaaaaatcataaaataataggagacgcagaatttcgaaaatttattataaaagctgatgacaatctaacccgataaaacaggttaattcttttcctttcagtatccctggaaagtttggggcgcttctgatcagtttctgaaaaaaaagttaagcctaaactttttggcctgtttaaaaaggaattaaaaatttttaaaaattttattcatctcccttttcgatagaaaaagcaacagagtgcctaaactaacatgtaaataaaatttggtgcgtttggagcattttctgaaaaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaaggtaaaaataaagtagaggtatatcgaagctattcccgaaggattcggactccttataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcggggggactgccccgaaaacaaaaaaatcgattnttttcagtgtccgtttgnggtactncaacatttatggggagcaaaactccaacgc

SEQ ID NO: 29829 - DNA, 1656 bp, Heterodera glycines
aaacaaagtccgctgctggttttgatggagttgggatgggacatacggggaattgatgagaaggggagcaattaaaaatattattgcactaattagtatgcaatattactttcaagaaaaaacactcatttaacatatttaaatatgaaacccaagttattttttgatttatttacatattctcctcgtcagagtgtgacaatgaaagatggcagatcgttgatgagcgcttctcatgaagatgacattcctccggatgttcccacgtgcggcttcgatggcaacggatgtaccgtatccgtgttcgagttgtacaaagtgggtacaggaacgaaaacaaacacatatgtgatttgctaatcatctggtaagtaatggacattaaaattcattttgacttttagggatactttttgggcggcatcgctttgtttgtgctgatcattggcgccagcattttctgcgtcgcttatttgatacagtatgcaaaataaaagaagcaaaaggccaaaataaaaatgggaaaaacaatttcaaatttagcgcaaaaattgttgacaagcgaaaaggcaatttgcagtggaaaatcccttttgcgttgttgcagcgacagaaccaaagagtgagtggacgaagaaagaaaattgtattattcgaccgaattccctttcgaatccctaaattcgaggctatgaccaattccttgggggatgaggtttaacatgaaagaaattcctttgcctgagaccgaagtcaaggagaagcgaacccattaaagccctaatactaattaaaggcccggattgattttactgggatccccgattatcgtttttagggtgaaatgccgaatgcgcgagtcacaagaaaacgaatttttaatctcggaatccctgtccattgcaaggctccgttcccagtttttttttcaaaatccgggatcaatcaataaatggggttgttgaaaaagccttatttgttttctttaattcagcgatctgaacggaccgccgaacggagtcaccactctctccgctccaaccaaacaaatatttccgcgttgacccatgcgaccaccagcagcagcttggcacagtcaaaaaacttcacactgtacgcttacaatggacaaatgtgcattgtacacgcgtacggcccaacaatgttggccatgccattgtctgccgaggggatggccgagtgccgaacggtagaagggaaattagcaataatcaataatatggtagactaaattgcaacaatacggtaagataattaacattaataaacaatttggtagaataatttgcaaccatacggtagggcaattaacaataattgtctttattgagtggtgtgcttgctctaaactgagatcacagtcttgaaaacaagaaaattcaaagcttcttggtctgttttacgccatatttcgaattagaacacatgcttccctcaatgaagtagccaaaattggccataactttcagttgcgactgtttgaccacgtgaatttaaatcgctttttgggactgagtttggacgggcccaatttgctggcggtgtggaatttctgtgcccgcgggtcgctcaaagatgtgataatgtccggtaatgcgatggtcagagacgtcgtgttcatccaatcatccatca

SEQ ID NO: 29830 - DNA, 975 bp, Heterodera glycines
gggggaactggacagagatatggaggggagtgagggggaggggaggaagggcgggggaaattaatataaagcaaaattttgagaaaaataaaataattgggggggttttttcaagtttcaaacacagggggaaaggaaaatggaggagttaaaatttaattggcacatatttccgacacaggcggcagaaatttaaatatttttaccaatagcattacttttctcatgcaaaattataaaatgaaatatttttccaataaattttttttaatccttctcacaagggtgaggatttttttagtttcatgtacttttttatggttttgtttcacttataaatgcacaaaaaaacattatttttatcgcggaaacattcattttatgtcactattcgtaaccattttgaattttagaaattagaaacaaaaaattcaataaatcgaaaaatacttaagacttgtatttctacaaaattaaaaaaatgattcctagagtcagaaatgttcaatttttaataaatttctattgcaaaattctataattgtcttttgaaaaactaatcctcaccctttgtcactaactaatcaaccactttcctttttctcttcctcttctccttcttcctttttctcttcctcttctccttcttcctttttctcttcctcttctccttcttcctttttctcttcctcttctccttcttcctttttctcttcatctgctccttcttcctttttctcttcctcttttccttcttcctttttctcttcatctgctccttcttcctttttctcttcctcttctccttcttcctttttctcttcctcttctccttcttcctttttctcttcctcttctccttcttcctttttctcttcctcttctccttcttcctttttctcttcctcttctccttcttcctttttctcttcatctgctccttcttcccttttctcttcctcttttccttcttcc

SEQ ID NO: 29831 - DNA, 966 bp, Heterodera glycines
aaatgaactcgcagacgtcgtgtggagtccgagccagagtctcttttctggtttagggtgtgcgtgcctggaagtggctcagcctgagatagggatgttgcgcccgtaaagcaccgcggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgcgtgctgttctttcggggatggtgcgtggactagtggtgagagctgcttgtggagcgcttcagctgcgtgtatgctcgtcagggtatgcacttcggttggcgctgaacgaccagtttagaactggcacgaactcggggaatccgactgtctaattaaaacagaggagacggatggtccttgtggacgttgaccgtgtctgatttctgcccagtgctctgaatgttaagccaaggaaacttgattaagcgcgggtaaacggcgggagtaactatgactctcttaaggtagccaaatgcctcgtcggctaactaccgacgcgcacgaatggatcaacgagattcccactgtccctatctactatctagcgaaaccacagccaagggaacgggcttggcaaatttagcggggaaagaagaccctgttgagcttgactctagtctgactttgtgaagaatcatgagaggtgtagcataagtgggagccgcaaggcgccagtgaaataccactactttcatcgattccttacttaatcggtaaaacgggagtgcgcccgaaagggtgtccattttgtgttaagtcgggccacccggtggcccggcgacccg

SEQ ID NO: 29832 - DNA, 1222 bp, Heterodera glycines
tattttattataggcgttttttcaggggtatctttgcctcggtggtcccgtgccgccgcctgccggcgacccggccgcgccccgctttccctgtttccccgcaattcccgggtgtcccggaagtccttctgggccttgctctcctgaaaataaacaaagcattttaaactttacttacagatcagaccgtccgtcccgtccgttcccggcattcccggctctcctttgtccccctttggtccaggaaatccctgctgcaatttgaatgtttgtctccgcattcactttgttagcttttacctgtcctggtgctccgattggtccttcgggtccttggggaccttttaagactcaatatttcagctaaacaattccaactcacaaataatgcatttctgggcttcttccaacaaaagtgttatggcgtccagtccggggggtccgtcttcccccgtgtcccccgactcgccgtcacctccgacttcacccggtggcccaggagggcccactcgctgaggagggcactcatctaattggcgtttgacaagccgtccaaatgcattgtccgtcagactgccgccactgccaacggcgaattggctgacccgacggaattgttcatcgaagagacgagtgttgtgcttaaacagaagcactcactgaaccgaaattgcccaactgtcaaacgtgaaagcgacggaggcgactctcaaaatcgttcttcagctgttgggtgtgctgattgagccaagggagaaggacaagttgagtgagtacacaaagggaagagacggcgaaagtgcccatggcaatgatttggtagaacattcttgaatcagtcgcctttcaaatgaagcgataaaatggagaaattggggaggaacaatcagtgatcaaagtggtggcagagcgagtgacctcgacctattaaggaaagtgtcgaatcggaattggggcatcgacggagcgaacgcaatttacaaggggggggggcgacagagacgaatagtaatgacagcgggaagggtcggttctcgactcgagatttacgtggccgattcttcaattctcaccaataaaaaaactaagagattctcctctattctccagggtccctgtcaaaagtgcaattgaattctggacgccaaaaaacaattgacacgagccgggttcgaaccggcgacctcgattgtgtgagactcgcgtgataaccaactacacc

SEQ ID NO: 29833 - DNA, 1118 bp, Heterodera glycines
atgatgattaaataataaaagaaatcgaacggaaactgataatattagaaaaagcaatccaaataaccagaaattcagccacattattgtctttcttcgacgagttctgcaagccttcattgcatgtaaagttgttgctgaggacgttgtgcctgagcggcggcgtgggtttgcttcatctgagcttcgatgagtgcggcctgttcatgcattcccatggtgcggtagtattcggcccactgggcactgtagtccggttgtccagtttgcggattaatcgcaggtccgccagaagctgaacaaaggaaacggttttatgtgttgaaatcggttatatatagaaaactattcgatttatacaaataaaatatacaagaaactgcgcccattccggcggaaacagcttgctgaggctgagcaatggtcgcttgctgctgttgatggatttgttgctgctgcatttgggttgaatggagctgtgctgcttgtgaaacagcagtttgcatagtcccgggcactgtttggtaatgctgtgccggcgtggcaccaaaagaagcaggttgggaaggcggaccccccgcaattgccatcgcttgttgttggttgtaatactgagtccaagccgaagggtcttgctgagcaggcgcagcacctataacagggttgacagcgcctaaacaacatctttaataaaaataaaaaactaatttgcgtcaaaaatctgctaatatggttttccaggcggtatttgaattttgcaagactggaaaagatccttttgggctgaaaaattatactcgggatatggctttgtttaaaattaacagatgtttgtttaatttactaaaagcttgatgcggcgtgggtccgtagggatttccaacggccaaaggcgttgtggcattggtaatgccagcattgccgtgaaaagatggtagtggtgttcccggtgcaacatcgcccactttaatacggatgatgtgttggacatgatggatttggaatggagtgccttttatgacgaatattttctcagtcgaattgggtggcgagtctcgcgacagttcgacatgggcccccgtctccgcgctaatctataaagaaaaatattggtatac

SEQ ID NO: 29834 - DNA, 497 bp, Heterodera glycines
ttttattcttaaaatgtcccttttatttacccccccccctcccctctcattaccatttagactccatattgtctgccattttgatgaatggttgacggatcaattttcgatgcctaaccctcttcaactgcgaggtcttcaatagagaccttacctgcccctgcccgaatccgcctactgcctgccaccatattctgcaccagtgcttgttgatgcttcttgtcttcaccatgattacggctagaccggcctaatcgaaacccccacctttccgccgccgtaccccacgatagccacctgcccgtgaacggtgcatgtacctctcaattcaccgattctataatcgcacacaacatgactctatttgacactactccttctgcttagctttgactcattagagacgtaacattcatcatgacttggtccgcgtcgagtacgtaagtcctaacgattgtgtcattatatctatgaggtagtgtctatgtaatactaca

SEQ ID NO: 29835 - DNA, 786 bp, Heterodera glycines
aaaaaaaaatgggggggggggggggggggggaaaaaaaaaaaaaaaaaaaaaaaaaaaattttggggtgggggggggggggaaaaaaaataaattttttttttaaaaaaaaaaaaaaaaaacgcggccgcggcgggggctcaataaaaaaaaaaaataaaaaacccggcggggggggggggggggcccccaaaaaaaaaaaaaagaaaaaaaaaaaaaattcttttttttttttttttttttattaaaaaaaaaaaaaaagaaagaaagggagtttttttttttttttttttttgtgggggggggggggggggggggggggggggggggaagaaaaaaaaaaaaaaaaaaaaaaaaaccacgcccccccccccccccccccccctttttttttttttttttttgggtgggggggggggggaaaaaaaaaaaaaaaaaaaaaaaaaaaaaaatattttttttttttttttttttttttttttttttcctttctctagaaaaaaaaaaaaagaaagggggggggggggggggggggggggaggggggggggggagaagaagaaaaaaaaaaaaaaaaaagatagtttttttttttcccccctcccctcccccccccccccccccctcccccccccctcggccgccggagggggagggggggggggggttgggttgtcttgtttttcctccgttgagggaggcagtaaggggggggggggggggggggggggggggggggggggggggggggggggggggggggggagggggggggggggggggggggg

SEQ ID NO: 29836 - DNA, 940 bp, Heterodera glycines
tctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttgaaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgcttctcggcgcgtttgtttgggaaaaatttggaaaattggctatctctttttctgctcaacagtaataggaattccaaccgcattctcagaataatacgccgatactaattgttctggaatttgtttctctgcgcgttggtttggaaaa

SEQ ID NO: 29837 - DNA, 941 bp, Heterodera glycines
  misc_feature (58)..(58): n is a, c, g, or t
atgccagaaaaatggttatctcttttttgtgagaaattttgtaccatacaaatgttcncagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgtgagaaattttgtaccataaaaatgttcctagcatgggcagaggggcgcggagagcaatggccattctattctacagggaatttttaaatttattctctatgccagaaaaatggttatctcttttttgtgagaaattttgtaccatacaaatgttcccagcatgggcagaggggcgcggagagcaatggccattctattctacagggaatttttaaatttattctctatgggcgcggagagcaatggccatctctattctacagggaatttttaaatttattctctatgccagaaaaatggttatctcttttttgcgagaaattttgtaccatacaaatgttcccagcatgggcagcggggcgcggagagcaatggccattctattctacagggaatttttaaatttattctctatgccagaaaaatggttatctcttttttgtgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagcggggcagcggagagcaatggccattctattctacagggaattt

SEQ ID NO: 29838 - DNA, 901 bp, Heterodera glycines
ccccccccttttccccggggtatttttttgtaaaatttttttttccacaataaacttttccaaccccatttttcgccccggaaatgttatttttattgaattttgaaccggtttgagttgattagactagaaaaaattgaaaattttgaaatcatgtttccccctcccttttcccaggggtatttttttgtaaaatttttttttcccccaataatttttccaacccccttttttcccccgggaaattttttttttttgaattttgaacccgtttgagttggattgcttagaaaaaaatgaaaattttgaaatcatgtttcccccccccttttccccggggtttttttttgtaaaatttttttttccccaataaacttttcaaaccccatttttcgccccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaat

SEQ ID NO: 29839 - DNA, 1134 bp, Heterodera glycines
aataatagaccaaataaaaccttttttgctcattttgaagggaaaattcttgagaatattctaagttttatttgattgggccttaatttgcgcacttggttaaaaaataattaaagtattgaaatgttcgtccccttcaaaaaatttttctagcttttaaaatttcttcaaattttgcataggccaatattttgacccccctaacgattccaagtttattttgtgaaacttaagtttttaactagagatcggctcttctatttctgcaagggaaaagcccaaaaaattttaagtttgcaaagttttggcgttctgattactaaataaataataaacctatttgcactgaaagccaaaaatcgggccgctgtgtgcactttgggtgcccaatcgacttttagacgcacaaataatgaccattttcatttcttttgggttatttcagctgtagtggggtgaatttccaaaatcaaaaaacggaatgggactttaatacgttgttttttgcattggaaaaagggacgcgattagtgagaagaatgcaattcacaatatatttaaaacgaaactacatttaacttttataagaaacagtaaattagaaatttatgctttttgtgcaggtcaattaaaacatgtgaatataaaattaattgtccatggaaatcttgttcttggtcaacagcttgttcaagccacgctcgatggatttgacatcggcccggacggacgcgagatcctctttgagatcggcccgcacggacgatgggcagcgcaaacggagcattttgatcacaaaaaaaagttgtaaacaaagaaaaaaaatgttaaaagcaaaattaaaaatgaaagaaatgtgactgatcgattgacgcgaacagggaaaattcgttcgaaaaacgaataatggaaacagaaacatacatttgtatacaaatatgtacgaagtggaaaaaaacgacaacaataacaacgaacaaaaactgggatgagaatcggtggagaatttgtttgtgttttgatcaatttcggggagtgtgaaaattcaatcaataatgcgacaccgtccgacacaattcgatgagatctgtaaaggagaaaactgaatttttccgcaaattcgcgaaaattaaa

SEQ ID NO: 29840 - DNA, 1344 bp, Heterodera glycines
  misc_feature (9)..(9): n is a, c, g, or t
aagttggcncaaattgcgactcgaagagaggtgccaaattggcattggcaaaggaaacacttagcgaatgtttgtttattcctttcagtggcacttcgctttccgacctttgggcagcagcagaaaaaaacgcacaacttttggccattgttgtggacaaagagacgacaaccgacgcatattctgttggtcattcatccttttttaagtgtttcagtttctcagccctttcatttaaatttccattttcaaatgcctaatttttgctttcgttcgcctgtcactccctttgtccattctttccccccttcagctgatgctcaattacgccggcgattctcgacttaccgtttcgttttgttcgccttcccatccgataattaccggaaaattcgccgaaatgggactcaaaattccatcgcttttcgtattttctcgtcaacgtgcggaccatccaattttcatgtccaggtaataaacaatttcgacctttacctttcagatgttgcgttgtcttcggtctcttttagctcttcgattgattcgtgggtcgaaatgcaacacaaattggacgaacttttggcgcctttccctaaaaacgatgcgcctccgctcgacttgcttttggtaagttttcactttcctttccttttttaatcttgagaaatgaaaaggggacgaagtcggatgctcaacaacaaaatgagaatgggtctgcgatggcactcgaaaaagtgccaaaaatcgactggaaccaattcgaggtgggcacctcccccccccccttttgcccatttgttttgtttggctcaggtccaatatttggacttagtcagtgccctccattatttgctcaccgtggaagtgcctcgaaaccccgttcttggaaacaccgaattgaccgcgttgaaacgtttcgtaagtccattcgaaccaagcacttttttaatgatgctttatcatattttgtttaaaagtgtttgggttgaaacaatttattggccattttaattttcaactaatttttataataaattgcttcaattttttaaaaatgtcttttcccaccaattgttttccgttccgtcgtttgcccagtgtttgtccctttccccataaggtccatttgcttcgtcttcatggccccggttcgacatccgtccgacgccttttctatcgtctggacgaatggctgtcctcgcagcatcagccggtagtgatgaccgacaaatatctgtccactttggacgaaattcaggtggttctcttcgagggggggggggggggtaaaaaacaaaggcatttcttaggcactttcaaaatgcgttaaaaaaatgcttttcg

SEQ ID NO: 29841 - DNA, 1121 bp, Heterodera glycines
  misc_feature (12)..(12): n is a, c, g, or t
  misc_feature (28)..(28): n is a, c, g, or t
ttctgctcacangtaataggaattccanccgcattctcagaatattacgccgatactacttgttctggaatttgtttctctgcgcgtttgtttgggaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggatatctctttttctgctcaacagtaataggaattccaaccgcattctcagaataattacgccgatactaattgttctggaatttgtttctctgcgcgtttgtttgggaaaatttggaaaattggatatctctttttctgctcaacagtaataggaattccaaccgcattctcagaataattacgccgatactaattgttctggaatttgtttctccggggcgtttgtttgggaaaaattttggaaaattggctatct

SEQ ID NO: 29842 - DNA, 1174 bp, Heterodera glycines
ttccttgttcatcattttcatttttaacaactatttcttcctttatcgcattaatttctccaaatatcggttttttgatgttttttgaggtcgatggcttaagatttttccacaaatcattaaacaaatcttcatcaattccgtcaattagtacgattagaaataagatgaaaataatcacaaaattaatttccatttttttgtcaaatgatttttgttttcagcttatatttattatagatagatatatatattatgtaatttataaaaaaaaattttcataaagtagaaattatcaaattaattgcaatttatcttgtttttaatcgtaaataattgattaaaaaataatttcatttacatgtaaatttccgtttccgtatagtaaacccttgaaaaacaattatggaattccaaaaaattttatatatggtaaatttaagaaatattactcggttgaggaaagagttttggcccacaaataaaattttacacaccgcaaaaaaaaattgcaaaaatttccatttttggcactgactcagagagaatttgtaacagttcgccatgtgccaaactttttttgaggttgaatagcggcggaattatgagcgttctggttgagaatgttaatgaatgatttatgcttttttgaatcgcctctttgtatttgactttggaaaattgtcatttagttcgtcatttccaatttggatcagaatctcaccaactttcgacgaaaaataagtattttaaaagtcgattgacaattcggctgcatttttggaagcgattaatgatgtgtttagttttttggccaactctcgagcctatgataggaaagacgaaatttggaatgggtttgaaaagagaacacgaattttggaaattccttttaccaaaataacgaatttgttcgttttggtataggatttggttcgcgtttggcaattggaatggattttgtgaatttctgatttgaaccgaacgtccctatgttttctcttccaccaaactaagacgattagcgaccattaaaagttcatcgtatgtttgggacggttttgattgacactccaaaaattttgccatgtttgtgtcattaatgttaagaacgaaaaaatttttggaaatttcgtctctttgtgccttacttaacccaacatgggcacaattt

SEQ ID NO: 29843 - DNA, 1368 bp, Heterodera glycines
tggatagagcaattgaggctatggaactatggcctaaaattaatgggttggaaatttcaactgaataatggtttcgttttatatttagggagaaataatatgaaaaaagaatattttattaactcacaaaggatttcagaatcggataatgttcgtgacttgggaattataattgactcgaaactgaatttttcagaacacataagcaaaattatacgaaacgcatatcttagaattttctagattttgagagtgttgaaaagcagggaaataaaaactctaacagcagcctataaaacttttgtacgacctcaattataatacgctaccgaagcttggaaccctaatttaaaaaaagatatagacaaaattgagcgggtacaaaaattttttacaagaaaagcacttagaaaatgtggttttgtgtacaaaaaatatggggaaagactaaaaatcacgggtttacacaaattggaagaaagaagaaaaatcaatgatttaacaacagctttttaaataatcaaagggttcaccagcctcgatgctgggaaaagtttctttttctcagaaaggctcaggaggcctttatttttgcgagtaaagcgccacacggccaaaacacaaaataatttttttcataggatagtaagaaactggaataaccttccagtggtagcggtgcaaattaataaggcaaaggaattcaggggtttactaaaagcaatgagttctgagtaggattttccatgttgccatatttacactatatttttatcacctgtgaatttttaacatttgatttatttttattcatttttattacggtattcattttgtattttttatttgatcatttttatttgtttgtttttggcaccatataagagcactaatgtgcctttggtttgctcgataaaattaaattaaattaaattaaattgtactgtttaaatttgcgcctgttgcaattttcccagtgaatggagagtggtgccctacttttgcctgttgtgaatttttttttgcaatcttttttgttctccctcctcctcagcatttaaccatttacattcgttgattagcccaaggcaattctgagattttttttgccaaaattgatttttatgtataaaatttaaaatatttgagtgtattagagaccggcacgatcatctttaacatctctaaatcggcctttttcggtcatttttcgaattatatcgaaaaaatgattaaaaaaatgtttttttttaaatttttatcacaattttttttaattcttgtatcgaaaaaaagatcgaaaaaatttaaaatgtttgatttaataatttttttaaatattagaatggatttgttgcatatcttaca

SEQ ID NO: 29844 - DNA, 926 bp, Heterodera glycines
atttggtcggtgtggcgccgtcaaagtgagccaaaaaaaagctgggttttttgagcaattttacatttattgcctcgcaaaagctgcatgtaaggaaaggaaacaattgatgatgctcactttctctgttcaatacattttgaccatgtttccaagggtgcaccccaaaattccgccgacaaatttttttaaaaagttttaaaataagaaatttccaaaaaagatttagaaaattttttaggaaattccaatgaaattttttgcgattttttgggaaaacattcgaaaaaacttactatatcatcacaaattacaaaaaaaaaaaaatttgttgactaattttgaaatttttttttgaaatcttataaaaaatgtccccctccagggctgtctattttggctgctactcgtgcatgaagcgtttcctgaacgaccaccccgaatggattcagtccaactcccacgccgtgcacatgttgtccgccggcagtgcaggtgtgctgttgttttgccaagctcctccctcatgtatttctcgtccaaaatttataaccaaactaaaaaaaacagaaatttagaccctcttccccccccccattgtggagtttccaaggcatgggatgcgagtactttttagacaactctccggaaaccactcttttaggacaaacatttgaaaatcggagcaggtcgtttcccccccgaaaaattaaaaaaaaaaatttttttttctgggggggggggtgggggaaaatgaagtgcaccctttgaaaatgacgtcttcaaatttgctaattaaaaaatcaatacaaatttcttcaaaaaactgtggtttaccaagaatacttcattttttaacaattaaaaaatatataggccccctttttggaagaaaattttttgtttaaaaaagtcgtgaaaagatg

SEQ ID NO: 29845 - DNA, 1589 bp, Heterodera glycines
gaagttccatatgccttgatccttatgaatatttttcacacttttttttgcatatttggcattttgtgctttttccgcgatttaggggtgtccactgcatttcggcgctggcgtttcggcgccagcatgtttttccactataacttttttctttagcatccaaatccaacatttttgatatcattgaaagcctaacattgtttagaagctttttctaagctattgcttcgcgattagacaattactaaaaaagttattatgaaaattgcgaagagacgaaatttttgaagttttttcttaataaaaatttttccatgcttgaaaatctttttgtttttttgtaaagctaatatagcatgttaagagctttcgaatgataccaagattgttggattttaatgccaacgaaaaaagctatagtggaaaaacgagctggcgccgaaactcccgcgcgaaacgcgtggggttctagatttaggtgtgcatattttatgttcttgttttggcacttttcaaaaaatccacattttttagctttgtttgatgcttctaggatggagttcaatatcctgtttttccaaagtatacttcgaaaattcatgcacccaaaatttttcattattattcaaatgttatatttcgggtgggccaagctttaaaaattaaaattaagcaattgatgaacccggccaatgggtggtacaacgaaaaggatgactcagtgattttggtggctgaagtgtcaacgtattcgcctgcatatccgcccagttggtctcagcagaaacggcgatggactgactgactgattgatccatttgagcaatcgctgccactgatctccttattcttatctccaaatttgacgatttttttaaatttccaatttgcattttttcatttgaaatatgggtgatcaaaaaattttacacttgttgagattggattgggcaaagagatgaggatgcatcgacagtagagaccgaaatttagtaaatggccgcgccttggaaaatcgactgggattggatcccgggtccgggactcccggtcctagtttttgggccggagccccgccgtgaccgggactttcaaacttcgtggaagattaattaacttctattttagcttggatgtcaatgtgtgctaatgttggttgattggtctggtctttttcaagtaaaacatcattgttgggatgttgtacatgattagccggtctacgtcagttgggcccctgcacgttttggcacctgcatgtttttggactataacttttttctttgtcatccaaagcaaggattattggtatcattcgaaagcccttcaaatgctctattagcctgcaaaaatccaaaaaatttcgtcaattttgaacaaatttatggccaaaaaggttggaaaatttggttttttgaatttttctggccataacttttctgaaccttaacgaaatttttcaaaatttttcaggctaataaaagacacttagggctttcgaatattaccaacaatgacggatttggttgacaaagaaaaaagttatagccaaaaaactgctggggcccaggcccaactgacgggttccg

SEQ ID NO: 29846 - DNA, 611 bp, Heterodera glycines
cccttcaaaattttgaaaaataaataaaataataggagactcagaattttgaaaattttttataaaaactgatgacaagctaatgtgataaaacaggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttactcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtgg

SEQ ID NO: 29847 - DNA, 1352 bp, Heterodera glycines
aatttggacactacggaaaaaataaatagaaattcttagtccaaaaattggccataacaagaatttttttattgtaaattttcataaattattcaaataatattttcgaaaattttttgtgtgcctattttttcaaaaattatttttgcgtcttgaatagaataaaaaaaaacaaaatctgctatatgaaattaaaattacgtaaaattaaaaaattgtaacaaaaaatgatttttaaaaagatggcgcaaaaaatttccaggacgaccgccaatgatctgtgaggagattgaaattccgccatgcaacccgtgcccgcctggcccacccggcaggcaaggcccaaccggacagcccggcacacctggcagatccggacctcctggccgacctggcaccaacggtgagtggagttaaaaaagtagtttttgttttttaattttacaattttaggcttgcccggacccccgggccctcctggaccgcccggcacgcctggacctactggacccgatggagaggtacagtctattatgtcatactgtattcttctagccaaaaatttcattccatgccaatgcacaaagccgaacaaaaatcgatattcgaaataataaaacccaaaattttcgaaataaaccggaattttcgcaggcttttctggatggcgcccggaaaatgcgtcagtggaaaatgcgtcagtggaaaatgcgttagtagaaaatgcgtcagtgaatgttttattgtcataaaacaagttccttgcgttttcgggggcacagaccatgaatccggtatccatttcggccaaatccgaaccccagacccgaattcgaacaaaaactcgaaagtccaaattttcgaatttagcatttttggttcaaaacggcatacatgatctattattgaaagactgatggcttttagtttgtttccgtgtatttaaatagatttttaagaaaaactctaatttcgaaattttgacttttcgattttttgttcgagttcgggtccggcgttcggaatgcagaacgatgttcttatagaagtttatttctatattacaatacaaatgccatacaactttattttaaagtatttttatcactgacgcattttctactgacgcattttccggtcacggcctacgcccttgatgccaacattgttggtaccattcgaaagctcttcacatgcactattattcttagaaaaagcgaaaagattttttggcttctgaaaaagttataaaggaaaaatttcgacttgtttataacttttttggtaattgtctaatcgcgaagcaaataacttgaaatagcttctaaacatgtttaattttcgaatgatac

SEQ ID NO: 29848 - DNA, 1124 bp, Heterodera glycines
ctctttgcccccctcgctccctctccttcgctccttctcatcactctctttctcgatatccccgtacatcctcacaaaatctcatatccgtttcccaatcttctcctgtcgccgatcccttccttctcgatcctccctcatccgtcctccccccccctccccgaattttcacgctttgtccatcgtccgcccttcttcccctcattgtcgatttttatctttctatccgttatttttcagtccatgaaccacgggttcaagctgttcgaccagcaccataaacaaaatgtagcacagattgccgccgaagcagtgatgcaacacaatttcggagcagagaatatggaagaggaagtgcagaaaatggaattggccagggttaatggaaacgatcagcagacgataatgacgacgatggcaaatggaaataacgtaagaaaaagggagaaagtgggaggagacgagagacagacgagggacatttaaaaagagagatacattgggggaagggggagggagggaaaggcgattgagtgggaaaagcaatcggaaaaatcgagaaaagatgggaaaggccttttgtttggggcattcgatcggtcagtgatcgctccttctgtttctctctgattttccttccttagcactgctcctcctcaactgctatcaattcctatggcattgtgccgtcggcggtggccggcgtgccgcaattgcaacacaacgcccacttttattaccccccgcctttgtccgccggtgccgcgcgttcgtccgtcgattgtgagcaaaagaaataacgaaccgattggtggacaaaacaacaaatgttaaagtgtattggtgcgctaactcagctagcacagcgaaccttttggacatcgttcaaacgccccaatcggtggaccaacagcaaacaccggccgaaggcatggggacgacaaatggcgggacgaacaacgcgatgtttggcacatgtaaggattagttagggattatggatcgaattactaattgctaattagtggattaattgtacatccggcggctttattagtcgtatcaaatgccctagtaaaaagggagcgaaatttagcaaatcagccgcttcccttctacaatta

SEQ ID NO: 29849 - DNA, 902 bp, Heterodera glycines
gtgttaaatctataaaaggggatgttaaagcgtgctgatggattaaaaatagaaaatagtttcagatctgttcggccataaacaattttacgtcattttggcgcggtacttttttgccaattttgtttttcaatcgtttttctcctaatttcagtcgtggaaaatgggtgtttccggttcttcattgtctgcttacgtgcaagtcgcagtccacgtacgaaaagatgtttgacatgatcagaaaccgctggccgacatttgcaccgaaaaacgcatccatggacttcgaacaggcgatggtcaacgccctccgcgcaaaacatccacagagctcaatcaacttttgtctcttccacttggtgcgcaacatgaaatctcgcctaacagacgaacaaactcgcgtaagaaaaataaaaatttattgattttgaaatctcaaatttagcgtttcacaaccgacgctgcctttgcacaagctgtcaaaatgatcacttcgctggcgtttgtgctgcttgaggacattacaccggcgctggcagcgctcgaagatcatcttccggatgagcttgagggcgttctcgattggttgtttgagtttaattttttttttcaatttcattagtcattttaaaggtttgtaatcaactatgttgggcgacttcgcaacaacggcacacgcactcgctccgccgcataaagcaaagcgttaccgtgaagcagacagacgaattttgaggatcctggagcgctacaatcaagaaaaagagcggccgcaaatcgaaaatgatcaccaatattgccaaaaccaaattaatccgagaaggattaatgaaatgcttaggggaattccagcaaacgtggtgggaatcaatgattttctttttaattgcattattatttat

SEQ ID NO: 29850 - DNA, 1241 bp, Heterodera glycines
aaatctttgaaatacaggatgaagcccaagtggcgacgaaggaattgcaaaaaatgttaagaaaaatggaaggaaaggaaaaaatcggaaatgaaatggaggatgaaattgggttgccgggaaatccgcgtgaagttcgatgttttaaatgtggacgttctggacattttgctcgtgaatgccgtgatgctggagaccgagaccgtggacgcagagtttggcgcaattggggcgacgctcgaggtcgaactggacgtggaacgtggcgaaacagcgaccagaacgaagtcggtgagggcccgtccacttcgacgtcatcagcgcacttgacggacttcggcacgttcttcaattacatcggaggaaaccaataaatgctaagcgatcggacattttcattattcattcaaattatcttactctttttaatctttaatttctctattttttaattgtattagtcaggaccggggacggtctattcggagggggccgatgatatacttaatttcttaattctctctttctctctcttatcctctgatcattgttcccccgtcaatgtcagcccggggggcggtccttcttttcactaatcgagactctttataagtgttcatccgcctcttctctctctcagtcttgcccggggctcccgcccatcagtctctgtccccgagaccgaatcgggttgggggttgcccattgtatcctgaacattggacaccagaataaagactgtgctgttggtcattggaagagtcagacattgacacttagaccttttgggcacccccttgtccccattgatattcatggaggtcccgccttaggggacgagacttggcgagactgattgtaaatagctgcacatatacggaaaaatttaataaaataaattaattaaataaagtttaaataatgttaaaaagcatttaaatgaaaattgtccgatcgattggagttgaagcaaaaaggaaaatggacagacaaaaattttaaagaaattaaagggcgtatggatcaatttaacaaaaagaaaaaagagaggcccgctgagaaattggccgaaaagtgattgttgaatgatcggcggcagctaaagaaacaatcaatgagaatgaaattgggcaaatttttaggaaaagggattttacattaaacagcagaagtgaatggcacaggaaacggatcgaacccacgagtgcaacgagtggaacgattaattggaccaaaaattt

SEQ ID NO: 29851 - DNA, 1299 bp, Heterodera glycines
  misc_feature (67)..(67): n is a, c, g, or t
  misc_feature (80)..(80): n is a, c, g, or t
  misc_feature (105)..(105): n is a, c, g, or t
tttgattatggataaatttttgggaaaaaattatttttaaaaaatcggaatcgtaatcggaatcgcnaataatcggattntgggccataatcgtaatcggcgatntaatcggaatcggattttgtctggctcggcacatccctggtatgtatataattatttcaacattttaatagtcagaaaaaaatttcgggggggggggggaatccgaagaatttttttggtcaaaatttgtttagattatttaaaaaaattcagcaccggagagcaaaaacaggaattgtaactatttttagccaaaaaagactaatttttgccattttggagtcaaaatttaaaaattatggtccggcggtgccgataggtgccgccgggcaaattttttttgaaaattttaatgattttattaagaaaaatcgacaaaaaaatttaaaagtcccaatttttcctgtaaaaatttttaatttttcatttcgggcgggggaatggggggggggggggaatgcctcccctcacctggctaaggttttatgaattttcataaaatgcgtgaaaaataggtgtgacaaaatgtgatgcctctattttctaggcgaactacccaaataaccttaacaacaacaaataaaaaattataaatctattttaattcttaaataaatcgaaatacgggtagccctttaaataaaaaatagaaaaatttgttttttataaaaataatcttacaagaaatcgtctcgaaaaaaataatccaaaagtcaaattacggatcaaaattacggaaaaatcccaaaaatccgtaacccgtaatccgtaactcccaaaaccccgtaatttccgtaatccgcaatccgtaatccgtaattgcgtgcagccctgaaatagacgtcactgggaaattttatatgtttctaattggtgctgggcgttcgccaaactgccaattttacaatcttttcataaaaaactcttcctggactgttcagacaccgccgataggcgccgccggaaaaattctaaaattttgagtgtaatatattaacagaacttgtcaaaaaatgatcaaagttttggttaaatttgcagttttaggctgtttaaaaaaagaaaaaataataatttttaaattgaaatattttttattaattaaaatttcaattgaaaataatttaaagaaattattaaaaaaattctgtaccgttggggaattgaacccaagagaaaaataatgaaaggcagaaggtttagccagcagaccataaggaatggagctatccaaaaatagagaaaacattaagg

SEQ ID NO: 29852 - DNA, 1530 bp, Heterodera glycines
  misc_feature (23)..(25): n is a, c, g, or t
  misc_feature (214)..(214): n is a, c, g, or t
  misc_feature (241)..(241): n is a, c, g, or t
ccccccttctcggaccccccccnnncctctctgacgacgctcccggctctctcacaggcacgggcttgtgcgcgaaaaacaggcggcgcgcgaaagcaggcggcacattcaaagacccgcaccgcccccacaggctcacgcctgacgacggtgcgggtggtaaaattacttattgggataaagaaattgataaaatatttagtaaaataagctnttaaacatattttaattcccccttatntaatatttgaatgctaaattatggtgaaaaatatcaaaaacaaccaaaaaaattgaattaaatgaaaaataacgagattcatatttaaatattccgggaaattaattttaatctttttcatttgaaatttagactcacaaactagaacatatacaaacaagaagaataaaaaatggcaaatctatatgttttccattatttgggaatttgtggaatttttaatataatatgttttaaaataagagctaagtaataaaaaccttttattaatttccaatatgacctggaaaatttaaatctaaaatgaaaaaaattgttcaaaaaatatttatcgaaaaaagttataatttggcaaaaaattaaagctgatagaattatgagccagaatgaaattggtcatttggtgtcatgtgaattaattattactttaatattaaaatctaaataatgggaaaatataaataaaatataaagtaaaagttgtcacttaattacattaaaacatttttcgtcgttcaataaataataaaaataaatcatgtagaaaacacgaagaaatattccataactttttaattcattcgtataatgactattttcatccgaagaaaatataccaagaaaaattcttaaaactttttaatttgtgtaatgactattttgaagaaaaacatgacaagaaatgccccaaaattttgaataaatttgttaaaagtaaaaataaggtaaagaattaattaataaattaatatcaattaaaataaacaagcatcgtcgttcaattcccttcgcaacgaagaggacgtggcgtcgctgatgcccgaaaaactaggttatttgatgagaaattatctaaactcttcgttctcaaagaaaacaataaataaaaaatattaaatttgaaaataaataatcactaaaataaaatgcaatgctaaaatttttagtaacattaatttctcttttacatttatttatcctgctagtaaaacttaagtaaataatcgttaataaaactcagattgagttgtttcatatttatcgatattttgataaaattaaggttttgactgattatctataaacaaatatgttaaatttgttatccaaagaaaaaaaattatttaaaagtcaaacaaaaaattgtattacatctatatcaaacagtcagtcaggatttgttttagagttttcacaacgtatttattctttatgattttaaaaacaatatttagatagttattaagaataaaaggagataaaatataaagagcgggttctttatgtga

SEQ ID NO: 29853 - DNA, 2229 bp, Heterodera glycines
  misc_feature (2133)..(2133): n is a, c, g, or t
cggaagtaaaggcagaggcattatcggtgattagttcaacacaaccaccgtattttaagtagcaattggtaagaaaagcgtgggcaattgtttgtgcttttgtgtcggggaccgggacagaaattacgtatttggtgaaccaacaaacgatatttaaaatgtgtttattccctttttaagtgatcggaaaggggccggccaagtccagcccaactttggcaaaaagtgtgttggctggcaccatgagcatctcttcccggtacgcgggtgttggattgtgtctcaattggcaggtgacacacaatttgacccaagttaaaacgtcagagtacattttgggccaaaaatattttttgcatttggcaattgttttcctgtaattcaaatgaccaccacccaaaagagacgagtgaagtgattcaaaaatgagtccacgtaacgaaattgggacatagatcctcggagggagtcccttgtcctcaaaataaagaattcccgaaatcaatttgtaattggcagtgctacagcaaataactattttctttctcatccaaatcagctggaaattccccatctctgacaaacgcaatgtaggctgcggcttcaggatctcctgcctgctcttccaacaaactaactttgtaagtgtttccatcctcgtgtcggatggtcaaagtgtgcaaaaatgggtccgcgaccaccctggaatgtgccgccaaagcgagacagaccggaaattcgataatatcctcgagttcatccacattgtatatctccgacaagggcttgtcttcagcggcacgagaaagtgcatcagtcaaagtgttggcttttcccgccacgtggacaattttgacctgataattttgtagtcaatgagccatcgtgccaattgctgattggttcggattttttcagcaaaaacgcgaggggtttgtgatctgtgtgaagttcaatgtccgacatgaagatgaatggtctgaattcccttaaagcataaataatggcactcatttcaatttgaactgccggccatttcctttcagcagcagagagggttctgctgcaataggaaatggcagaaaatgtgcccgtcacgtcatccttttgcattaaaactcctccttgtccagtcgatgatgcatcagtgaaaatgtgaaatgctttgtcgtaatctggaaaaattaaactcggggcttgcgtaagtaattcttttatcttgtcgaaagcgttttgctgttccctgcccccattcgaatttattgccttgcctcgtaagcttcagcaatggctctacgaccattgcaaagttctcaatgtgccgtctgtaaaagcctgcctgtcctagcactctctttacttccttaacatttaaaggcacaggcatttctttgagaatttcgattcgacttaagcttggcttaaaaccttcagctgttaaaacaaatccaagaaaattcatctcattcgaggcaaaaatgcactttttcgggctaagcttcagattgtaaagccgaaaacgctccaaaaccttccttaccgccgttaggtgctctgaaaagttcggactttttgtgaaaatgagcacatcatcaacgtaggccaatgaagtatcctccaatccagacaaaacgatagccatggccctcgaaaatgctgcagttgcatttttcagcccaaatggcatcgtaatcatttggtacactttgtcttcagttataattccacattttcttgacgtttcttcactcaatttaatttgaaaatagccactggccaagtcaagagagctgtaaaattggcaatttccaaccctttccatgatgctatcaaggcgtgggagagggtacttgtcgggcaccgtaacttcgttgagtttgcgaaagtctaaacaaggacgaattccaccgtccttcttctgtacaatgacaattggagttacccatggggtatcggactcaaccatgactcctgcttctaaaagctgattaatgtgcttcttcaattcctctttgtatttgtacggcattcgtcttggcgcagatgcgattggttcctcagttgtggttgtaatgtgatgttcagcagctgtgaaaagcccagatcatacctaaacttactaaaaacgtctgnaaattcttcaattaatgccttcagctcttccaaatctttgccttcaaccattgccttagaaaagtcaactacaaatgttggggtcattttccattt

SEQ ID NO: 29854 - DNA, 1056 bp, Heterodera glycines
  misc_feature (960)..(960): n is a, c, g, or t
  misc_feature (1040)..(1040): n is a, c, g, or t
tggccgttaagaaaaagaacggtaaaacacgtgtttgcattgatttttcaacgggattaaatgacgctctcgaactgcaccgtcacccgctgccacgtccggaggacatctttaacgcgatcgccggatcaaaattcttttcacggctcgatctacgtgatgcatacctccaactcgaattgtcggaagagtccaaaaatctctgtgtgatcaacacgcaccaaggccttttccaatgtcaacgattgccattcggtgtaaaatcagcaccttcaatttttcaaagtcttatggacaaaataattgcgccgattcctggtgcctttgtctacttggacgatgtaataattagaaatcaaacactggaagaacacatcaagactatttttcaagttttcaacaaaattcgagagtacggacttcgcattcaattggaaaagtgcacctttatggaaccccaaacgcttttcctcggccatataatttccgaaaagggaattcaaccagacccatcaaggtccgaggccatcaaacagatgccggcaccacacgacaagtcgacactccgatcatttcttggagcactgacatattacggcaaatttatcaaagaaatgcgtgagctacgaagcccgctggatgaactgctgaaaaaggacataaaatgggaatggagtcgacaacaacaggaggaatttgaaaaagcaaaggaattatgctttccgacctcctgttgacccattacaacccaaaattgccgataattgttgcagccgacgcatcaaaggacggaatcggcgcaacaataagccacattttggccgacaaatcagaacgtgtcgttgaacacgcgtcgtgcacattcacagcggcacaaaagaattatagccaaattgaaaaggaggctcttggtttggtgtttgcagttcagaaatttcaccgaatgctgtatggtcgaanattcacactgctcacattctggctatttttggatcaaagaaaggaattccatttactctgccagtcgccctgcaagatgngcactcatcctttcaa

SEQ ID NO: 29855 - DNA, 1322 bp, Heterodera glycines
aatcaccgctttgatggcgtcaatcatcgacaacaacatttcatcatccaagtacaacgagcattcgaacaccttcggcacattgtttgggcgcggagtgaacagccatttggccacgaattgtccatccgatgccgtggcactgtcatcggccgggaattcgatgaagaaattgtccaaggagacaacgcgaagcgatgcacaatcgtcgagaaatgacggctcgaatttgcgcaaacggtggaatgttccgacggacaatcccatgctatgaatgttgtttccgagcagtggccaaatgttgcgcaaaatcaacttccaaatgcgataattaccacaaaacgtttggatggacaaataaattggacaggcggcgaaaagtggacgaaaatggtggagaaaagcgatgacattttggtcgatgaaactgtgaaaatggatggggaaatgttagcctaaaatttttagcataatcgctcaattttacgaaatggtgatgcgtttgaatccgatgacgttgcgtggcaattggacttgcggaattggcaatgttttccaatagaaatcgacaatttccatttctttcgtgaaaaacttccaaaattggcgccaaatttccatggagttcagcacccaacgccgcgttttgaactgttcgtcgacgatggtgtcaaatcggtggctgaccagtgcaattccaagacccagttgagaaggcgcaagaaattggaacaccgacagcaaaacgtcgccggaaatgaaactgaaaaaaaaatttatataaatatttgttgtttgttttacattttctttttgtgatggcctcgtggttttttgaagcgattccaataaatccaaagaatggcacaacagccgacaaacattggcacgccgtacagactaaaaaatgagaaggaaaagggttaatcgagaaaacaatgcacaaaacgtacagaagcatttttgaaggtattgtcagggagcaattttgaagacgaaaattatgaatggagaaatgaaaaatggcgggatagcaacgacttttatacaaattttttgccaaattttatacgattttattaacggtcgcattcgctgacactttgctataaaagcactccttcctctcccatttcatttcattcgctcactttttccttcccttgtgcttcctcaatttctttccttgactttctcagttttcttcgtcacgtacatacattttttaatatttttttgtccgcagaaattggacaagagacgaaaaggaaataattttcctccatttgtgggaagataaaaaggagccccccttttggatg

SEQ ID NO: 29856 - DNA, 1607 bp, Heterodera glycines
agtttgtacccagacataatccgatttccaatttaaacctcctcaaaaattattatttttttagatttaagccaacgtgtagaaagtgtgcgggaggagagcacgcgattgagggcggagaatgtcgtgttgggaaagtacatcaaaaatttgatgcgttcgacttcgctcttccaaccgacgaattcgaaggaacaaccgccaaagtaataagagaacgctttacatttggagtgaaatgtttgattgtgttttgctttgcagttcgaaaccattttattctgggttagaattttttgctgtcaatatcgctgtttttccatgccatatttactgaattagagcccccccccccatgtggctctattttcaactcccctcggaaggggttttatttcaagggtgattctaattcagaggggtggttttaattcagtaaataaattaacaatgtattaacctagattttgatccaaatttactttgtctgatctcttttacatgtcctctcggtttaatggcaattactgttcgggtttatgcgcctatgcttgaaatcatggaaatgcgtgttaagtgtattctaaaataaacaagtaccaaattcattttcaagttaatttttttatcgagtttaaatactacctatcgattatttaattctgttatgctttgtaaaaataaaaaccttaaatttgaaccatattttgttataggcgcaaatgtctgcacaatgtcctttcacctcaaatgctgctgttattttaacccttttattattttttttttgtaattttttgcttgcagcaaaataaagcttttgttgttaataattagttttaggcgcgattcacaagaaaagatggtttacgatgaattttggtgaaataaatgaagctacacaacaattgccggctaaatgcaaatacaaatatctgcattcgtcttattttttgaaaatttttcgggcatcatacgttaaaatgttttacgatttttggaaaagggaccaatgatcatccaaccgattgattgtaataattatatgcaatggagatcagtccataaaaataaaaaatcggaactgaggaagaaaataaagcactcacaatcataaattaatgtttttgagtcatttccctgtgtattcgttcataaaaatatcaaaaagcgaagcatcgtgaaattggtcctaaaaacataaatcattaaaaatctaataattttatacacctctcctcccatttgcaacatctcaagcacttctgagcacaaattaacttaaaaagaaacggaatatttttaattaaattaaacttttaagaaaccaatttcggaattgctcgacatcattgagtttgagcttaggaattgcacattttcgaggttggaccattgcgactttagggcaggctgaaatatttacaaaatatttttaaaattttttaaaaaagatgcctctcgcttgcaaagctcttttatgattttgagcatggccaagtaaaggtcgctgtccaaattgctaccggtggtgaaagaatggagcaattcgaacggccgaaattcgctgccactgctaaaaataaataaataaaaagacaataaat

SEQ ID NO: 29857 - DNA, 1233 bp, Heterodera glycines
  misc_feature (1198)..(1198): n is a, c, g, or t
aaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagaatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtagataaaatttgggtgcgtttcagaaccntttctgaaaaatatttaagaattattttgcaaaaa

SEQ ID NO: 29858 - DNA, 428 bp, Heterodera glycines
aaatggcacaaatttgtcatccatctgtacagacagtttcgtttctggtcctttgtccttgctaatttcgatcgttctccaaatagtcaattcgcttttgccatcaaaatgtttgtccaccaacgcattgaaacgtggcgaaagcaatgccaatttgaggccgagttgagcacggtcaaaagaggggaaaatgtccatccaaacgtcgttgcaaatccaactgaaataatgaaagtaaattagggcaaataagaatttgtgacttttcaaattgcttaccgtctgttcatttttgtggcaattagcacaatttggccgagttccgaatgatgtcacacaaatatataacagaataattaattgcgttgggtaaagcctggatttttagagttttcctatttttacggattgcacttgatgaaagaaac

SEQ ID NO: 29859 - DNA, 1024 bp, Heterodera glycines
aaatgcatttttatggcataatttgaggtgctgaacactaatatgcactttatattgtgtttcagactttttggaaagtggttaaaattttttgaaaaatcgtcaaaatttgagccccggaaaatccagtgaaatttcgaaaattcataaatctcttcgtttttggtcaaatttagtggaatagagctttaaaaatagagaaaaattgggagaattttatgagatttatttggaatttctatcttccaaaataaaaaagttattccagaatttctggaaaaattcgatttttcagaaaaaaattcagaactcccttctgaaaaagtattttataaaaataatatactcaaaaaatccgcaattttttgctctattttataaattttaatttagcttattagcacttttttgaaaaaagttatagaaataaaagtgattttggcattcgggaccaaaggggtgtgaccatgatttctgagtgaaaaaattttttggacaaaaatcttccaaaaacatgtctttaggggttatttgggccgctgattacgaatatgtaatcagattttactttagacatggttaagacctcagaatccctgtgtgattggggattctgaggagtgtgagcgcccgtcctgaggccgcgaagcggccgaatatcccccaaaaaattaaaaaacgggcgcgaagcgcctgtcctgaggccgcgaagcggccgaatgtcccccaaaaaaattacaaaacgggcgcgaagcgcccgtcctgaggccgcgaagcggccgaatgttccccacaaaattaaaaaacgggcgcgaagcgcccgtcctgaggccgcgaagcggccgaatatcccccaaacaaattaaaaaacgggcgcgaagcgcacgtcctgaggccacgaagcggccgaatgttcccacaaaattaaaaaacgtgcgcgaagcgcccgtcctgaggccgcgaagcggccgaatgttcttaacaaaattaaaaacggacgcgaagcgcccgttatgaggcctcg

SEQ ID NO: 29860 - DNA, 760 bp, Heterodera glycines
tgcaggtcgcccaatgcgacaactgaagcccaacaatcaattgccaaatccatgcggtgccatcccccttcgatgccaaccccgcggcgcttgcccccctctgccaaggctcgtccgaacactcagcgcgccgccgtccaactcggcaatgctcagttgcagctgaacaatgaattgcaacggtttgttcctctttgtctattcaatgcctgactcaccagtgttgtgttggccatgtccaaaatgctcagcaatggcacttcgttctcttgttgctgtttttgtccgtgtactgctccaactgttgttccttgctgctgctgatacattttcctttgtggtcgttgcaaaaggacgtgaaagtcgaaggcgaacggtaggaaggagtacggtatttggagggcggagcgaggaccaactgcgaccaattggggctgaggcatctatggagggggtagggaggggtataaaacaaaacgaaaaatggccaaattggaaaaaccatgccacccccattcatcatcacacctgacatgacggcaacaatttgggcgcagaggccaacaaattgagtccgttcagctccatccgggccaaacatccatagaaggaattctcgagagaaaactcaatgatctgaataatggagagtttgccatgtttttgccaaatgttttaacccctccccctctctttcacctgttcatctccgatctcttcaggtcggcccccaatttccacctgtgccaaaaaagagtga

SEQ ID NO: 29861 - DNA, 2555 bp, Heterodera glycines
  misc_feature (33)..(33): n is a, c, g, or t
  misc_feature (57)..(57): n is a, c, g, or t
ttgaaattccaaaatcatttataatgatcaaanagccaagcaatattataccatatntaattaacatattcttaataaaagaaaataatttttatccgaatggcaaatggttttaaacatgtgcaccacactgtactagcataattaatcgagaaatttgaacttttataattttagaacattaaaaaattcttaataaaataaacagttattacaagaaattaaataattatccgtataaataatgaaatttatttaaaccgaatataaatatttttaattaaacacctatttagtccaaaaaattaaataatgctcatgaatataaaattgaataattttgaaagtttatttttccaaactcgtccaaaaaaatttacataaaaatgaaaatataaattcttcggaaacgagccatgatagcggcgcagtgcgaagatgcgtcaatttccacagtgtgagcaactcaaatgtcgcgtcattctcggcaaggcattttgagctcagagtatgaggcgtggcggaaacgcacggggcgatcagccgcaacgaattgggatcactttctttccccgccgatgaataacaaaagtcaatttttgttgatatatattttcgtaattaatataaattttaataagcaaaaaaagcaaaaaaaaaaataggaaaagcaacttttattattggaaaattagccagaattgcaacaaaaataaagtgaatattgattatgattattatttataaaagagattttcattttgtttttaattaaaaaaaaagatcatgcttgggaatcaatatttggacaactttattttctaaaaatgctttgtaatcaatgaaattttttggaaattttataaatcaaagtttggcccaatgaaaccgcgaccattgactagaaaatctgcagcacacaaaaataaccttaagaataccttttcggactttttaatttattttgaatttttgagaattttttaagggaatttttagaaatttttttgtccaaaaaaccattttaaaatttttattaaatatatgatacatattgtgagttttttttgtacctgttcttataaagcaaacagaaaaatatctttaatcagtgagcttgaatttttttttttggtcccaaatatttggagactttcaaaatcactttttagagaaattttctcgaaaatattaataaaatgacattccacttaatttttacttttgtcctaaatttaaaaagatttatatatatattttttttttgttgttgcaattttatgtccgtattttttgccatatttacgataatttccgtataattttgagccatattcattcatcagcaggaacaaaaacggaacaaacggatgttgaagcgggaaacaaaaatgaagaaggacaccgaaccaacaaccaacagaaaagcaccaaaagcgatcagaaaagcataaatcgacaaagggatcgcttttcgcccttctgcttcccattccgcgaccaacaaatcgccaatgccattgcacaaattgtcggcacatgtcaagcaaatgccgttgccgttgtattgcgcgcacagtttggcggcggcatcgcaatttgtgtcgttggcacagtcgcggaaagtgaggggcactgaaagcacaattcgtcaaaccggagataaaaagaaatctaatcaaaatgaaaaattgtatttttatggtaattaataattcgtgatttgagatgacgtcattagtgtgaattacttttatttaatgctttatatttaggtcaattaacgaagcacaaataaaagattcttacattttccaccatcacaagtgtaggtttgacaaacaaaagtgtcatcatctttaatattttcatttattcattttaataatttcaaaaaattaccaccaaaactttcgttgccgcattgcttcggttcgaatacgctgttttggcctgcataacaattttttgttgcatcttaatttaagcaaagtaatttttttattaattattaaatgttctttattgtttttttttgttaattaacaaggctaattaattataatacaatttttaccagatcgtgattgaacaagcagcagacacagaatgtaacagaacattttggtgtcaaataatcctggacacattttcaaatgcttaaaaaattttaagataaattagctaaagatgtatcataattctttatttcaaatattttcataaaaatgtttgtgtccattttcctatttttttgccgttttttcattcattgcataaaatttccattatatacatttcacattcaaaaatatgttttgccgaacatttcattaaagctgtgttctgttaactaagtatgtactgctccagctcgatgcattaagctaaagcattattggattaagcggttttgcaatttgttagggtttgcttgcaaaattggagaaaaataaatttcgtcaaataaaaaatattgagaagaaggcaaacatcgggggccttattcccgtcaaagggttaagttcttaaccgcggttaagataagtaaacca

SEQ ID NO: 29862 - DNA, 1596 bp, Heterodera glycines
aaatcccataaaattctcccgattttttgctattttttatgctttaaatgagctgaattggaccattttgaggcgagttatgaatttttaaaatttaggttgaattttcaagggccaaaaattattgatttttcaaattttttttaccaccttccaaaaaatccaaaacgcaatataaagtgcatatacgtattcagcacctcaaattatgccataaaaatgcattttggctaatttaggagtttaaaaatttttcatgaaatgcaaaaccatggggtcccccctatggttttgagtttcaaaatcacaattaattttataactttttttaaactcaaggtaaaaacatgagataaagcacattagatagagcttaaaattctctacaaaaatgctctaagacaaattttcgctaagatcaacgcctgacgagttataagccttgaacggaaatggggagctcaattccggaaaatttttctatttccggaaaattttgaaattttttcaaaaatgccaccaatcgatagagctcgaaaaacggttgcttgaaagtggtctccgttttcctgggaaaaatcggcaaaaaataataaaattcaaaaacgaaaaattttcgaaggggcctagctcgaaaaattttgaaaattttcaaaatctgaaaacgccatcggatgcagctttaaaaactacacaaatgctcaagcggcgccaacccgctccgcttaacctccagcgagttattcacgaaaagccaaaaccggcattttgagcgccgttcagtcgccaatttctacaggctcggcatttgatctgattaaaaagtgatcagtgacaaagttgtagccaacatgtctggggtgtgccctctcagcagactttttccgctcccggtttccaggaaaaagttacagcccgaaaaccgagctcgtttttcaaagtccgccgtttcagcgccgctggcgctcagttggcctccggaccggaatttccttatttttcccagatgcgccgtcaaaagttacccctgcctgcaaaatttcagccccctccgggcaaaccacggggacttataattttttctacgaactgcaacattattctatatatatataaactagcgtgtggcgcagtaattgctgggtgtagacagtatacttttggtatatatgggcgggcgctgacatgagcgcttcgcgcaaaggacttcgttgctagtgcatgcgcgattttgaaatgaaacgggcgctttgcgcttctaaatattgtggactcattcggccgcttcgcgacttgcacgacggttcctttgtcgattcgttcaccaattcaaatggcatcattggaattgaccgatgaacagaaaaatgaatttggtaactgacggaagaaatggcattggcacgaagaaaatgctaaaaacaatttgattgaaaacaaaaattaaggcaattaaaaatcagtgattgttgaaaatgttgggccacacctccttgaaattgttgacccaattggtgttcccttgttcgttgtaattataacaactcaatcgcttgggttggccatcttttctcggagagtgcaaccatctggaca

SEQ ID NO: 29863 - DNA, 1952 bp, Heterodera glycines
tttaattgttggacataaatgagaaatgaccaattttaagccaaattttgaaaatttaacagaatttagagctcagctgatatgcgccgatgaggaaaagttttgcaaatttaatgaaaattgggaaagaaaattaacccaaaattttctaaagaattaccccacgcttaacgggcatatgagaacccctattgaaaagtttggattggatttcaacaaattctgataaaatttagtacatgtccccccccctccctcccactactcctccattgcctgtttgtattccatagtccgttggctttgcccaaattccaacaccacgcctgtttctcgatcagaaactgttgctgaggacctttgatatgtgatttttaagtacggtatttcctaaaatactgtcccccccccattaaaaagggatcaggacattccgccagtgaaggacagacaatccgtcggtggacaattcgtcaaaaattttattttgaacaatgatcaaaaatcttgcgaaaatcattgttaaattcaacaaataaattatctaggtttttaaaacatttggtaattgtttaagacttcatttaattgatcatctatagaaattatcatttaattcgttaaaaaataattatttcatatttttttttttataaaataacacaaattattaattcatttttttagcgattgaaattcatttcacttggttttaaataaaatgtggtgtttttaaaaataaattttgctgacggattgtccattactgacagattgtccgggagcccaaaaaaaagacccctcccctgaaataaagaatccatttagagggggattgaaaatatccactgggagcttgagttttcggaaatacagtagtatgtcattttttctcaattttttcccgtcctaccgatcactgatccaggacgacacacgcgaagccaacccttgaaaaagttaaatgaaaattataggaaattgcaatttcaatcccagaaaaattttatattgtatgagaaatgccattgacccgaaaatccgccgtcggaaaacaacggaattatttaatttgttgacagaaaaaaagcaccaccatgcattgtggagcggtcagccgatagtgcttcatcatccaacatgcgatcatgcaccccgtacggccaagtccggcctttaaagaaaagttgcaaaatttttgtggctcgactaaaaaaacaaaaaaatttttgggccattttttgataaattttacccacctccataaattcttttaaaacagtaactattgtaaattttcagctttttttttttggttacggcgccgccaaaattgatcagagaaaaattgatttaatgaaaatgccagcaaaatatgtgttaattattctcttacattttaatgcccatttgtcatgggttcggatccgcacgacagcttggtgatttattttgaattttttttctaatcatttttttgatcacttttggcgccgagaaatttacaataaacaaatggaatatgctctatgacgaattatggatgggaggggggattaaattcttttggcccaaaaatggataaaaatgccataaaatttaccaaaaaccctcaaaatcaaagagatttcataaaaatccatgcctttttactagttttgacacaaaaaaaagaaactgactttacaatgcaccgcaattgcgcccggcgccgaatcgacgacatccaaaaatcggagcacaatttcctcggtgggcgtcgaaccgtcgatgaagtacaagtcatggtgtgcaaagccagcatcggtgaacctttaactcacacattggttagcttagccagagaaaattttagcaaaaaattgagcgaaaaactcaaaatttttaatttaatttgggcgcattttgatgagccaggtcacacatttaactgcaaatctgtctgataaaat

SEQ ID NO: 29864 - DNA, 1268 bp, Heterodera glycines
tgttcgggtggaacccgagagacatttatttaatttgattattgtcatttatgtttatttgttgtgtctgaccttttacagacagacacattccttattgatattgtgaccatttgccctcccctcttttcattcattcagtttatgatatttgtgttcacattttccaattgtctcctccgccgtcctccgacatatttatttgttattttaatttgtcttcaataaatatttatttgttcgtccattcgacatttcggggaccgaacactccatttgctttgttttttttcttcagcttattatacccattgctggcaacgttttacttgcttaaaaaatcctattaattcttagtggattagtcagtatatgtaaaatgttttcgttttattagattttttcatgtattctttagataaataaaataacatttttttaccgtgtcaatttattgtattatttttttaataattaaaattttcataaaatcaaattattgattatttttgttatatcatttaaatagttgcactgagagtgtaatttttattatcgtccagatcttaattaagtcattcaattaaagaattatataagaatatttgttttcaacttatcccattaacggtgtgaagaaaatttaggaagaagtaaaaaatgtttgacatgacaaaaactaaaattttaattaaaaaaaggatcaaagaaaccaatgtatttaaattttttacattttttatataaatgaatgcaaatgcaatgaactacttagaaacaatctgttgtgactgaggcatagacaatttggccaaatggtctacgcctcattcacaacaaaaagggaactccatgttcggtccctcctcgatagaaggggaccggtaaactggacaccagaaaattggacaccggaaaatgggggaccggtaaattggacaccaaacggaaaactggacaccgtcggaattttggacaccaaaggaaaattggacactggaaaactggacaccaaattcctcttttaaaaaataaacccaggaattaggttgaaaaataattgatgtggataaatggattaaggcatttagagtggatcaaacattaaataggaacgatgattgatcaaatgtggcaaaaagtgtacgaaattgggcgatgattggttcatgtgccaaaaaatgcgaaaaaatgggaaccctatcaaaataaagtttttttcgttatgaatgtatgaaggctttctgctgctgatgttacaaataata

SEQ ID NO: 29865 - DNA, 1117 bp, Heterodera glycines
tctgggaaaaaatcgaaaattttctaaaaacatcactaatcgatagagctcgaaaaacgatgttttggaagtggtctccgttttcccgggaaaaatcgttaaaaaatcttaaaattcaaaaaccaaaaaatcgttttttaggcctagctcgaaaatttttgaaaattttcgaaattttaaaatttgcaaaaatcgagctcattgagctctacaataagtctgctggcgccccctggcttagatcaaacccgggcgtgctattcgcttggtactgaagtgtccaaaaaaagtgattcttacgttgcctaacctacaggtcaggcctttgatctgatcgaaaaatttttgctggcaaagttgtaggccacagttggggcatttcgcttttgtggtcctctatgttctgaaagcaaaagcaaaaaatttcgtaacagtgaaactgtcagcaaagtcagttttcgcgccgctgggactcagttggcgaccggaccggaaaatccgtttcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaagaattcggtctccccataaatctgggcgcatcggttcggggggactgccccgaaaacaaaaaaatcgattttttcaagtgtccgtttggggtactcaaacaattatggggagcaaaaatccaacgcagaattaagtacagactatagggaagctattccggaaggattcggtctccccataaatctgggcgcatcggttcggggggactgccccgaaacaaaaaaaatcgatttttttcaagtgtccgtttgggggtactcaacaattatggggagcaa

SEQ ID NO: 29866 - DNA, 1531 bp, Heterodera glycines
tatattgtgtgtgtttttgtttttttttcttaattgcattcgctttttttttgcttatttctctcttcctgttttgcttttaaaaatacgtgtccaaaacggtcccgtcaaattttatcgtttttttttgtatgtcctccaaaaattggagcgcgttttgcccgctttgttataccaatcattttttgttcgaatattacgctgttttttttttcattgtacaacaatttgtttgttgtttaaaatgcaaatttaagcgaaaacactcaaaaaaagcaaccaacaaaacaatttgcaattcgcgaaaaaaaatgtcgtcttcgtcaagtgctcgacgctcggacagcgagtcggaccgcaaccgacgtcatcggtcgtccaagggcgccccgccgcgtcgtgcaagtgatgagcaacggttggttgttgtgccacaattacaattttgcatttgttacttttcctggcacggcatttttatgccgtgccaccgctggtgttgccatatttgcttcaaatgaaggcatgatgggtgtgatttgaacaacatcccggcacaaaattgggtcatatgtcaaagagttacaataaaaatgtacaagacgggttcactacgaacaattacattgagacacgggacaaaatgggttcactacctcctccaccttaaggaaatttttttttaaaataaaaacgaaggttgaacccttaacttgttgcgttgcaactttttaccaaaaaaacaaacaaacacaacttataatccttgttttttgaccggattttttgatttatgcttcacctttgggaactgacaataagttgtgcatcgcctatccctggtgtaaaacgaaaaaaagcattccatttataaaagccatgactacaataccgcaaaaaatggacctttttggccgataccatttttgttccttattgcatttcttagaaaaaaaactcagggcaattcatggtaaacacatagaaccaaccatcaatgtttataattttgttaacgaaggaagatgatactttttttggtccaaaaattcgtcttacaacatttttgagtgcacagaaatgtgcaaaattattgtaatacctcactcatcgaagaattgaaaattcgaaaaaggtttacgatgtccaaacgatctgtgcccgtccggcgaaatccccctcctggtatatacgagtgcaacacaacttgctcgcttttcatcaactatctctaccttcctatttatttttgtctttccattatttcattttttaaaaaattttattccgccaatttttgcttattgagtaagtcgaatgaatcgctgacgatgcgtgaacacagggaaattgaaactggacaacacccgaattagctgtttgttgttcggtctgtataacgatgttcccgtttacacgataatgcgtgtgaaccgtgggctggctggaagaagttcctcttccaatccccccgacccgtttaaggtggccggatgtggatttttttaaatagccgaccacccgctccccc

SEQ ID NO: 29867 - DNA, 826 bp, Heterodera glycines
cgaaatgaacgtcatattcgtgattagcgaccccgaaaactccagaaaaaaaattaaattttttttttatgtggcgtaaagtgaaaaagtatcggaatttctttttttagttttatgagaggttgtgttaaccttgatgttgagcagtgaacccgaggagcgtgccctttgcaaaaaacgcgacatcgaaccggaggacatgtattcggtgatgaaaataatctgaaaaacggggatggacactgaatggtactttttcagagttatccccgaccctcaattctgtgtaggggtcgggattggcacacgcctaacaataaggatgatataccgatatggtactatgtagaggaaaaggaaaatcggttcctacaattttgataattcgtgaattttttttctcccaaaacctttttgatgaaataccatgtaaatgatactgatgagtaatatttttaatcattcaactgagaaacccattgcaccaaccctgggcttgtccgatttggtgtccatccaatatttatggaacttgacaagatttgggtgctccagacggactaagttgtcgaacacagcgcgaatcttctcctaaacgattcggataaatgttagattagtcaaaataggtgggaattaaccatttctaattgtaatttctggatttgtttggttttgcgggaatgaaaatcaaccaatcaattaattttaaggggtctgtgaaactgcattttctgtgaattttttttcggaattaatcggttccggaaaatacggttctgatatcgattacgaccaaattcgaaacctgaccctgtattcaaaa

SEQ ID NO: 29868 - DNA, 1398 bp, Heterodera glycines
  misc_feature (1299)..(1299): n is a, c, g, or t
ttaccaaaaccaaataatggaaaacataaaatttttgtggccaaacgaaactcaattaaattttgcccagaaaatgcgacgtaaacgaacaaaaaatgaccagattgatgaagaatttcgaaaaaggagcacagtgccaaaagataattaacggtgccattgagtgacctaaacaataaatattaaattataaaatatatttaattactttgtcctaatggtgacataaatgactgaaaaattaagaacaattccaagagtggcgatgaaaccaaatatggtagcaaagctgatcagtttccagtttggagtttcatttgcgaattccaaaaagaacttaaattcattaaaaaataataatcacataaaaataatttgttaattaccgttaaattgttcagatcagccattattgcaacagtttattaatgaccagaataataagaaattgaaatattaattattatttggttgggtcattaattacccgttttaatttcaaaagtcttgggtggaggaatggcaccgcacttatgagtttgtttaaaatgagtccatgacaactatggcgtgataaaacctgactaattgttgcaattttccgcagcaaaatattactgtccatctattcgtagtttgcaattcatttgataaaaattggagaaaattaattgctattaaaaatagaataggttttaaaaaaattaattaattaattacataaatctgaagaattttctgaaaaatgtaaaattacttaccaaaattgcgaaaagaaagatcaaataggactaataaatataatgaaggatcaaaggaatgagacaaaagaagaaatagtagagcaaaattttattttcttgccctaatttgatcccaacataaggaaaagaaatagacgaacacttaaatttgggaaaatagccaatgggtgggtgattgattctattaaaattaacccgaggcgcatgacgaagaaagttataaaaacgggcaaatttttggaatggcatttccattttagcggtgatttaaatggcagtttcaatttcgaaatttagaccattaattaataagaaatcgaattataattaattaattaaaatgacttcattaaatgcctaattgctttgtttttaataatatttattttctcaactattattcctctttgatattcttcggcttttcatgattctccccctgttcaacattctgtagataataaaaacattcatttcaaccaaaatgaaatgatcaaacaaaatcagcttaaatttcatcattatttttttttanattttaaattgatgaacagaaatttgacaaagattgccaattaaaattggataaaagcattagaaaatgattaaatatggaatatataacattttctat

SEQ ID NO: 29869 - DNA, 1075 bp, Heterodera glycines
  misc_feature (994)..(994): n is a, c, g, or t
aattaacattgaaattcagacagcatttggacgttacgtataatttggttggggaactaccgtaatcacattacattttagacaaaaactattttaggaaaaaaacaaaaactatagttatgacgcacgttgtttttaacccggacaacgtgaattggtccgcgttctttgcgttacagcagcagcaggagggaagcggtgagatgcagtattttgtaggcaataaatttcagcgtggtggcggtctgttacaaaatatttcgcggttcctgatgcctgtagccacaaacctgctaaagtctgcctcaaaagagggcatttccgcagggacacggatgcttgacgatctcgcgcagggaaaggcgtttaaagagtctctcaaaactcaggcaaagcaaggatttgagaatctggccgaaaagctcaaccagtgcggaaagggtgggcggcaacggcacaagacaatcactcatagaaaaaataaaaaaactggtacattgagagggaaacgacagatcatcgatcagctaacacttgcacattaacatttggcaccacacgaagcctataaataggtaggataattttattttttttcactatcgactacactctcagcaacatacattaaatattttgagagaaacatactaaccaaaaaaactcagtggaaaatgagcgtaattaaaaagattgacaaagacagtgttgagggtctggaaggaagtctgtcattattctctttgccgccaaccaatgtggccataaataagacaaacgtccgtgaattgttgcctctgtctgcacttaatcagacaggtccctatttgtttcgcctgttctcggacagccaattttgtgacttgagcaaaacctatatgtacctgctcagctcaattgaacggaagaatgacgcgggagaatgggtagcactcagtgacacggacccaaacgataaacatgttggcgtcattcaaaactttgctagcagctntgtccgctcgctgaaggtcaatatgtcaggcattgaggtgtttgacagttccatttattatcactaccgcgactacataat

SEQ ID NO: 29870 - DNA, 1495 bp, Heterodera glycines
ggtgtacggacatttcgcctactcgacatctcgcctactgacatttcgcctactaagccaaaaacattcattttgcctactaattagtaggcgaaatgaatgtttttggcttggtaggcgaaatgaaaagtaggcgaaatgacagtaggcgaatttgggttatgtagtaggcgaaatgaatgtttttggcttagtaggcgaaatgtcatgtagcctaaaaaattcattaaggaccattacaaattaaatgtaataaatcgctacttttgatacagccgatcaaatgaggaaaatttcgtttggattgtccttccatttttttgctaatctggatttgttctcaggcaacaaagcatttaaattgtttcgactgatagggaaaagactaaagttcaaatatagtaagtagtaccagtttagcaaggggtcgtggtcttcttttgtgcgagtgaacagagtcaaagtcacagctttcaatctcccccccccccccccctctttcgtaaaatacaccggcgcgaaaaatcgatcctttggccgcgcatcttttttcctctcatcaatgagcaagcttagacgtgcgtgtgagtggattcactccatccaatattttcgaaagtcatacaaaagaaatcactaatgaaaaaataaaaattgttgaggaagatgtaatatttattaaattaattaaaaagggtaaggaatttaaatcaaaagaagcgattaggtatttaagtaatgattcacaaccgaaaatgcccaaattttgacattttttgagagatatttcttggtttctctttcggtttatgtgttcttttctttaagccgctctttacgcttcctccgtccatctcgacccatccaagcgaatgttttccacccaatcgtcgcacatggtctttccttcctgaacatttcgcattgtacaacacatgaattcgtccttcgtttctcccactgtcacctcatccttcacaataccactgcacgcgatcacagcctcgtcctctcgaattgtgaatccgttcccaatataatcatcaattttggctgatatttctacgaaatgcccttcccgtgtaaatttttgtattcttccggttttgtccaaaatgagcaatgagtcaccatgcctataaaagaactttttgtcagattaaggttttcaggaaaaacttttgcaaacatcgcgggaaaaatatttgcccattgtctttgccggcagcggaaaatgacccaatgattcgacagtcttttgtagcaacccatttaatgcactgtctggaaaattaatataaaaaaggatgaagttattcgatgcactttgaatataaattaacaggcgatgaaacaacggcgactgcaagggtttcattatctaacaaaaagcaaatttaatatagtagaattttattcatttaattaaattttcttaattagtagcaaacaaaaggaatgttaaaaatgtgtgaattattatgagaagaataag

SEQ ID NO: 29871 - DNA, 956 bp, Heterodera glycines
gttgaggacattgggccgcttcacgcacgttttttaattttgtgggaacgttcggccgcttcgcggcctcaggacgggcgcttcgcgcacgtttttaattttgtgggaacattcggccgcttcgcggcctcaggacgggcgcttcgcgcccgttttttaattttgtggggaacattcggccgctaattttttgggggacattcggccgcttcgcggcctcaggacgggcgctcccacccctcagaatccccaataacacggggattctgaggtcttaaccatgtctaaagtaaaatctgattgcatattcgtgatcagcggcccaaataacccctaaatacatatttttggaagatttttgtgaaaaaaaattttccactcaaaaatcatggtcacacccattgatcccgaatccaaaaatcacttttatttctataacttttttcaaaaaagtgataaaaagctaaaataaaatttataaaatagagcaaaaaattgcggattttttgagtttattatttttataaaatactttttcagaaccgagttctgaattttattctgaaaaatcgaaaatttccagaatttctggaataacttttattgtttgcaagatagaaatcccaaataaatctcataaaattctcccgattttttgctatttttcaaactttattccactaaatttgatcaaaaacgaagagagttatgaattttcgaaatttcactggattttccagggctctaattttgacgatttttcaaaaatatgtaaacaccttccaaaaattctgaaacgcaaaataaaacatatattcatgttcagcacccttaattatgccataaaaatgaattttggcaaactatgagaaaaaatattttcatgaaatgcaaaacttggggtcccccctatggatttgattttaaaaaaaacaattaattttataatttttttt

SEQ ID NO: 29872 - DNA, 492 bp, Heterodera glycines
tcgtccgcagttgagttgattgtttggttgagccgcgacgtggacgcatctctcttttttgccgaatcagcaacaggacgtgaagagagattcgcattggcaaagagctcaacacgatcctaaaacgaatttgaaaaatggatacaaaattatttggtggaaataatacattcgctgtatttggagagtcagcgaaggccttgtcacggtattcagcaatctaaaaatacaaaaattattaaaaaacaaaaattatgaaacgaccttggccattttgttcgcacctttggccaattcgagcgagatgaaacagcccaaggccttttccccaatgcatttcataatggcacccaacgcagcaaaagaggaattcctcacttcggagtcggcatcaaaaccatgctaaaaagggcacaaaaataggggggaaatgcgaaaaaattgtgactttgctcagaatggccaccaaatccttcagcaaacccttgggaa

SEQ ID NO: 29873 - DNA, 1562 bp, Heterodera glycines
  misc_feature (21)..(21): n is a, c, g, or t
  misc_feature (1504)..(1504): n is a, c, g, or t
  misc_feature (1513)..(1513): n is a, c, g, or t
atcagatttgaaattaaaacncaagattttaggctgtaattttttggtttttcaaggatccaaggcgggcacaatgcatgcccaatgtgtcgccagcaattattggcagagacagaggcacaaaatggtcaattcgaagaagcatttacgccattttaatccgtttttgttgagatttagagcatcaaatgcatggcattgcctcaggcgccgaaatgggaaattcttcaaatgatccgtcagtgattgtccaaatggaggatgagcaccaatcagaaacatcagacgaagaagaagaagctgatcaaaacgctgaaaacactcaaatggcaaatatggtctaaatttggagtcagccaaatttacaaaagaaatttttaaaagaattttattgaaatatttttttattattcgtcctgataaaaaacggaataaaaaatgttttttgaatgttggcgcttaaatttattaatcaaacaaaaataaattcacacaaataaaaaatgtaattcatgtttttttcatatgtttacatatgtaaatgtaattttataattatcggaaataaaaatcaatccatttaattcaaataaatgacttaaaaattgctgctttcttagaatataaatctgaattaaatcgtcaatttattatttattttgacaaaataattgtaattattaattatataaaaagtttaatgcatcgcaattttgtgtttcttttgctgtcattttgcgtaaaaacagccaaatttgactcaataaaaggcgcaaattgtgataaccaacaacaacagaatggcaacaattcaatttttgaaaagctttggcaaatgtacggcaaaggtgagttagggaatgccaacaaaatattatgatgataatgaaatatttacaatgtttatttcttaatatttttaattatttctacaatttgaatttttaaaatgtccaatatcaaaaggcaaaaatccaaaaaaaaaacatttaacattttaaaaagatcaacaaatgcaattgaccaacataatatgtgaagcggataaaatgtattgcattttggaggcaattaaaacggaagtaaaaattaatttattataattcatataaattttaatttctcaattaaagaaaccaatttgttgtaatttggtaaaaaatgatgaatacaattttatcaaaaagcgtatcacattaattaatcacagtgatccgccgttgagccaagtgatggacactttaattgttacactaatgagaattaaaaaggcaatggaatcgggtaaaaagcaaataatatttttattttaataaaaaaaactcctattattttgataatttttaatataactttaatttaaagttaaaataattttttattataaaaaaaacaaatttaaattaaaaattatttttttacataaatataattaatttcctcatataaaatttaggaaattttggcgattctctgattaaaatggtcaaactccgtttgaaanttgcactanaatttgctgcaaaacgtcatggaaataaatttgatgaacaaaataattt

SEQ ID NO: 29874 - DNA, 1178 bp, Heterodera glycines
  misc_feature (95)..(95): n is a, c, g, or t
acaggcacggcagcgtacggagtgtgcacagcggtgacaacggcgggaattctgtcgctgctgatcgctgttgccggcagttccatttttggacncattcgaagcagaagtcgtaaaaatggagaaaaggacaaagttgaagagacagatgacgaagaaatgaaacacaggaagcaacattttactgcacgattttgtgaaattaataaattcgcaactctagccaaaacgataaaaaaaaaagaattgttgcttaaagttgcctcagacgccagggatgatcacagggtaagggacaaaaatcgaggttgaatcggcaaattttctaagatttttttggttttttaaacagaaaagggaatcgaggtattaaaaaccggaccaggaaaaaacgtcgccagccgaaacgtttcgccggacgaatttttgcaacacaaattttttctttctcaactaaattaaacattcttggtattgttcgaaagcatttgaaaaactctattaacctgcaaattttcaagaagttttattcatgtacaaaaaaaacaaggcaaaaaaagttcgaaagattagattttgagttcattctggccataacttttttaacttaacgaaaatttatgaaattttgcaaataaataataaacacatagagctatcgaacaacaccaaagaatgcttaatttgattgacaatgaacaaagttatggtgcaaaaagtcttccggcgacgcttcggccgacgacgttttaggatgcatccataaaaacgcattggttcaaaaaataagtcgattcaaagaatcctccccttatatacacaccatttcaattttacctttcagttccaataagatttgcatgtgtggctaagtggcttttgtaagatggtaaagagacaaagggttgaggttcgagtccgtgtgcaacatgagtatttttatttattttttgtccaaaaaaattaaaaaatgacgatttgtgaaattcatttttgaaggtatttccaatcaaattgggtaattttggtatcattcgaaagctcatggagagctgaaactttttctaagaaatgttaaacagttggacgtgttagaaaaaagataaaggcgttttaaaatttgtcttttgattaacttttgaatttgagcacagataacagataataactagagattg

SEQ ID NO: 29875 - DNA, 685 bp, Heterodera glycines
tcttttgccatatagtcaaaaacttaatatgtttgcttaaaaaatattgaaaaattggtaatttttataaggaaaaacggatattctgacaacaatgagcaaagtttaaaaaaatattcttttttgaaaaacatcgtgacaatctagcaaagtgccggggctctaattattacgaatggagtgttcaaagcgaatgaatggggccatactttggtgcaataaaataatggatgaatgggagttacaaactgttggcagacgctgattggctgaatttttgcagttcggagacacgtgcgccgtgcgagtagagaacggaccactatgggtcaactccactgtgcagagaaagtctagtactatctcgtttactctttttctttgtaatttctctcactttggcgtactattttatcagcagtttaggacttgagttataatgtaatgaaaatttgaaactcccactacttttttctgagatgtcaaattgcctagcatccgctttgaaaaatattctccttttcaaaatctttttttagatattaaatttgttcggtttgattgggaatgaagcgagttatggcagatcaaaaaaaaaatacaaaaaaggtgtttccagtgtatattttgaaatagcgcgcaaaaatttacgccaaatgcgctatttggcgattccagcaatttt

SEQ ID NO: 29876 - DNA, 874 bp, Heterodera glycines
aaaatttttaattcctttttaaacaggccaaaaagtttaggcttaacttttttttcagaaacttatcagaagcgcaccaaactttgcagggatactgaaaggaagagaaataacttttaaagttttttagaaattctgagtttttcactgtttattattttttgcaaaattaattcataaatattttttcagaaagtgctctgaaacgcatcaaatttatgtacaagttaaataaggctctctgatgcttttactatcaaaaagggagatgaataaaatttttaattgctttttaaacatgccaaaaagtttaggcttaaattaaaaagattttcttcggttctagctctttcaataatcaataaaatcgtaccaaattttataggcatactccccggtacaggactaacttaacctgaaaaaatgacaattgtaattggttttaaatttttttagaaattctgagtttttaactgtttatttattttttgaaaaattaattcataaatattttttcagaaaatgctctaaagcgcaccaaattttatttacaagtcaattttagcactctgatgctttagtatcaaaaaggaagatggagaaaaaaattttttaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaaaatttttcaaattttttgtgaaatatttgtcgtgctctgaagggcggggggggggggggcgt

SEQ ID NO: 29877 - DNA, 1534 bp, Heterodera glycines
  misc_feature (1523)..(1523): n is a, c, g, or t
aacgaattttatgtggttgggagaagtgcaggacaatatcgaaccaaaattgaggggacatttggtcgaaatgttcgatgtgtgagtggaaaagagggaattggtaaagacagaagagggacggacatttggcaaaagagaggacatttggccaaagggacggacatttggcaaaagagaggacatttggccaaagggacgaacatttggaaaaagagaggacatttggccaaagggacggacatttggccaaatggcattttgaaagggattatttgaaaagataaagggcattttgccaaatagatatttaaaatggagggggatttaggaaatgggagggactcgaatagtccttaaaaatcaaaattaaggggagacctaaaaacagtgcaggacaacagtcggatgcgagtgctgaccagcgtaacggagctgagcaacgacggattccacgaatggatttacgggaagaacacttacttcgacgacgacgaagagtttggcgaacaaatcagcgaaattgtgtggcccatcagagaatttcaccaaagttttgaaagattttttttcgtttaaattttgacaattaaatttagtggcgatgcatttggacattaggccaaaaagttttgtttatgtgagggtaaaaaggggaaaagagctgctaaaactgacaaactttggcaattccgaaatgataccgaagggaacagcgaagaatggcacaaacggacggaaaagggccaatttggccaaggagccgaagggatttcacaaattcacggccgaatatgcgagtccggaattacacgtgatggacgaggagacgggggtaattaaagcgaaaatcaagtggcaaaaagcgaccgaatttcaggcgaaagtctcgccaaaatcggacatgtgggcattagggattatgctcattgaattgctaatcctgcaaaatccatcattttatcacctgagggaagaagaagagaaacgcgacaaattggaagtgagcggacaaaaggccaaaacggcacaaaagtcaactccattaaggcggatgttcggaaacggttgatggaaattggcgcactgtacaaagggtttactgtagacaatcgaagtgggcacattgtgccaattgaattcgaagaatatcaatggccatacgcattttgggatgcgctgtacgatattctgcgcatttggagacattttccgcgaacggcgcttctgattacggtaagtgggcgggaagggggaagggtacggtaaatggaaaggtgaattaagcattttgtaattagcattaataaaatacagaatttgttggagacaaatttgccgagacgaatgacggcgaagggagtgattgactttttggacgaaaaatgccatccgccggaagtggaggagcagctgaacagtggcgaaattcggctgttcaaccgagtcaatgcggacgaattcgtcgaaaaaatagaagagaaaatcaaggcaagcgcaaattagcaaaattgaaggaccanaatttatgctt

SEQ ID NO: 29878 - DNA, 1953 bp, Heterodera glycines
  misc_feature (1949)..(1949): n is a, c, g, or t
tgtcgaatttggtgtcaattagggaattttgactgggatgttggggtgggagggaatgggaaggaatcgaatgggaagggaattaacgatttccaaagcaacggtgagacgaccaaatccgaatactgagttttatttgtaccagaaaagagagccgagccaaccaaagacacaactccaacaatccttcactttattttcttaatcaaaagcgggaaaaaggggaagcatcaacaaaaattcataagtgaagcaacaacgaagaagcgtaaaccggcgatcatcaaagggggcggggcagcaacgccaagcatcaacgaggggaaaagcatgagaaaaaaagaaacgggggggggagcgatcttatcaaagttcacataagggcaaatttgaacgttgtcactgggaggggggatcaaagggaaatggaacacgggaagaaccgacggggtaaaggacgggcgcaacaggcaatgagatggggctagggaaaaagaaaagttttggcgaaggggagggaataggtgcaacggtgggaataggggtctgacacgaaggagtaaacgccgggtggaatcgaaactaaattttagctcaacgcgacactccgcgcggcgcttcgacggggcggggaagtaaatcggatcgaatttaatgggatcggttttgctgacatcggcactgcgacggatttccatctaactcttcgacgtgggaccggaagatgttcgacacggccaacatcggtgatgcgcactcgtgaagaaagccgagcacaagccgatgaatttgggaatcgaatgggcattgagctaggaacacgacccgaaaaccccgataccaccttaatacgacgaggaggagacatgctggattgatttggtgacgggccgcgcacttttggatgatcaatttttgacggaaggacactttcgagctggccaattgtaacgacgaattcggtgtcggaaatttttaaaatgggggatggagaatttggacaagacgagtaatcagtgccattttctgattgattgttgtcgttgctattgtccgacgatttgggtggcagtgaagattccaatgtgggggatttagatactgggatagatgtaggagggacagggggctcaataaccgttggcattgagttaggcgacggatttggtccacaaattaatgcgaaatttaaatggttatgaatacggtttatagtagttatggacaatttcggggcaatggccttaggcatgggggagcagtaacaccttaattacgaaggggcggattagtgcggtggacgagttcctgcacagtgtttcggatttctcccaattcgatggtggatagaaggggctgggcgggacgaagaaattgaaaaatacggcgcccacgacacaatgcagtgattccgaaaagacacagaattgcaccaaaaatgcctacaatagtccaaatgacatggaaggaattttcttgaggttgtggatgataaagattgagagacaagtcgaggccaatgatgtttcccattgaagaatgatatggctggctatagtgaagggcttttataggcgaaatataatggtgtaagggcggcgaaaagcgatgtttggaaggttatcgcttaacaatcttgaggataagccgtgggaaacaagtaacggtcgcttcaccgctaacagtcgcttcagcgcccagttgcttcagcgccttcccgccggacgatgaatgtgataaccatgaaaagtttaatgtaaaattatggaggataatggaacgacgcgattggaaacaaacaatctttggtcacatttgtcggggtgtttaagtttatggtaattgacagtttttaatggcctttgctgttggtggttggttggcccaagtccattgtattttttgggtttaatgtataatgggcttggtgggtggaacttttgcccaanttaa

SEQ ID NO: 29879 - DNA, 1541 bp, Heterodera glycines
catttgttgatcccgggaaaaaggcatttttttttatttcctttaaaaagatcattattaaaaaaataaataaatttcctaaaaaaatttcttttcatgcaatatttacaaagaatttgtcgctatatggaaagtcaacacttttgaattttatcaaaaagtaaaggggaggggggggggggcctttttttttgcaaaattttttgtgataaaaaccatgaaaattatgttatccggggttttagaggttgctgatcacgaatctggcatctaatttgagatcatggggcccaaaaaaaaccccccccccccaaaaatggtgactttccatatagcgccaagaattttctaataaattgcataaggttgccaaaaattatagttcatatcggcacaatcgaaccaattgcgaatagaattttcaaaaaatttatatcaaaggttccaaatttaaccatttgtaatttgaaaaaagttgtcaaattattgtagaataaaaaaaggtatctcgactactcttttcgtaccgccgagaatagttaaatttttcaaccatttttggacaaaaactgttaaaaagttttgtttaaaattgtctcaaaaatatttatgtatttaaatcaaaaacaatttactaataaatgagcaaattttctttatgcaatttttttaaaaaatgggaaaaaaatggattggaataaatggagattaaatgaatatttctgctgctgttggtttacttatattcaatgggagagggcataatgaaaatttacggcaaaattttgacctaaaattggagggattataaattgaatgatttggtaagatgaaaaactttaatccgaattttgaatttagcaaaatgatgaccccaattaaatcgtaataaaaatattaatccataatttaagcaaacagaaaaattttgaaataatgcctgctaacgtaatttttgataatgaccgaaaagttcttttacaacgagagtctcgtctcggattcagacaaaaatttcttgggtttttgtttctcttcatttcaatttattattttatttgacccaaattttatttaaaataatatgtacctttttttaatttttatttaattttcaattttttttttttttttgcaatttaatccctatggcccaaaagttggctctcatttttctggtttttgttagactatgaggaattaaagtttgcaaaaaaatatctcaaaaaatggcagaaatttcctcaaaaacccttttaaaatgatctgaagcttttaccaaactctgaagggatactaaaactaaaataggtaattagtccttcagaattctcatctgagccccacaaaaacccaaaagtctctggactagaagatcggtagtctcaagcagcactaaaataggccaatagatacaatatttactaatttttatttattttttgataaattcataaaaaattcccatttttaaacattcataaaaatcgtttgttttattgtgaaccccaccaattttttgttcgttttttgaatattaa

SEQ ID NO: 29880 - DNA, 1011 bp, Heterodera glycines
cgtactccaaaagtcgttctgatcaccgacgcactgcctttgttgatcaacaaaattcgttggttgtgctgatcactgctgtgccgattgctgtcccgtcactgatcaccggcgtccaatgtctcacgcagtcgaacaccaaatccgcagaaatcgccgaagcgggagaggacaccgtcgatgtgcctaacaatttaaaatcatattaatgtgtctttcaattaaccaaatttgctgaaaatgtgatcaatttattttatcagattttagaatgcccacagcatactgtaagtgtctaacatgaacgactaagaaggaaattccaagactgtgcttaaattgccaagttaaacaaggaaaaactcaaaatttttgctcccctgagttcaaaaaagcaacttttttttttttttgcttttggaagggtttacccttcattttaagtgtccaattccccagcattaaattcaaaacccaccgaaatactgagtcaagtattccgcccttcggacttccttcagaattcgctttgaaaccgccgaagcacagagccgatgcctgttgccaaaatgccgaaggactgacgcctaaaaaaaaacaccctttgaaaattaatttgccatttgcttccccccaatttcatagtttcactaaaatgggccaagtcccaattaccgtcccaattagcggtcattcaccctttaaacatactgttgccgaagcacagagccgatgcctgttgccaaaatgccgaaggactgacgcctaaaaaaacaccctttgaaaattaatttgccatttgcttccccccaatttcatagtttcactaaaatgggccaagtcccaattaccgtcccaattagcggtcattcaccctttaaacatactgttgctggtgtgcccgtcgaatgtccaccagcaagtccgtccgattttgtctgttgctgctgatgccactttttcgtcggtggagagtgaagaaaattgctgaattaattgctttttgctaaa

SEQ ID NO: 29881 - DNA, 722 bp, Heterodera glycines
  misc_feature (717)..(717): n is a, c, g, or t
agagtagagcgggaccgggaattttgagcaaaaccgggacttgccggggcctgagaagccgggaacgggacctcgatttttgtccgggaccggaaccgggaccaaccgggaaattttaaaaattcaaaaaatttaaaaaaatttaaatttatttcaagtaaaaatgatacaaattaattttttattttgctatttatttaataaaatccaaaagttaaagctaagttaaattaattaaaattttcaaatcgaatttacttcaattaatcatttttggaccaaatgatcgaatattaatagaaattcagattgctttttacaacactttttcggcacattttttccaaaaaaacttttagagaggaaagaagggggtccggcggtgccgataggcgccgccgggggaaattttgaaaatttgagtgtaatttgttaacagattttaacaaaaaaggctggtttttgggattactaggctcaatttgtatggattttcatttaaaaaatgataaaatacaattaaaaaaaattaagaatcatattttgtcgataggaaagccatgagtatacaaaaaaaaattcaaaatattttaatttctgtggagggattgaaccaggggaaagaagaagggcaaagtcaaggagactagccactaagccatttgaacaattggcatcgtttcgttgaaagatatatttatgattatttcttaattntttcc

SEQ ID NO: 29882 - DNA, 1452 bp, Heterodera glycines
cctaaaaacggttttcgggttttttaattttatgattttttaacgaattttcccagaaaaacggagaccacttccaaaacatagtttttcgagctctatcgactggtatttttttcggaaaaatttcgattttttcccggaaatagaaaaaaattttggcctgagcgggacatttgagtcccgggcctataactcggcaggagttaagtttatcgaaaaattgtcttagaacatttttgtagagcttttgaagctctatcgaatggtgtaggataggtcgagaaaatttcaaaaattttcgagctaggccccctagaaattttcggaaattttttttcggacgaaaatggtggtgaaaaatatttttctggggtaaaataaggtgctgagtacgaatataatgtctattttaagtttcataatttttggaattttttaaaaattctttattttttggcaattttttggcccacgggattttggcctaatatttgaaaattcataacaaatcaaagggttgatcaattttacaggtataaagtcttaaaaatagagaaaaatcaggagaattttatggactttatttggaatttctatctaaaaaaggaaaaaagttattccagaatttctggaaaaattcgaattttcagaaaaaaattcataactcggttctgaaaagatattctggaaaaataaaatactacaaaaatccgcagttttttcctctattatataatttttatttggcatttttatcacttttttaaaaaaagatacaaaaataaaagtgattttgggattcgggaccaaaggggggtgaccaggatttttgagttgaaaaatttttttaccaaaaatcttccaaaaacatgtctttaggggttatttgggccgctgatcacgaatacgtgatcagattttacttttgacatcgttaagacctcagaatccctgtgtgattggggattctgagtcatcttctgggggggggggggcggcaggttcgagtccggacggtgtaacattatttttctgtgcatttttacgttattttcaatgattttaattaatttaaaatattttgttgagttaataaataaaaaattatatttaaattaattttttttttgatgaatacattttataagtttaaattaattatttttttaattgatggaatttcatgtattttttttaattaaatttgttaaaaaatattttcattttaatttaatgaatttactaatcactgttgtaccacttttaatcaaatttgtactacttctaatcactgttgtacctcttctatttactgttgtgcctctctaataactgctgtacctcttctaatcactgttgtacctcttctaatcactgttgtaccttttctaatcgcttttgtacctcttctaatcactgttgtaccccttctaatcacaattgaacctcttc

SEQ ID NO: 29883 - DNA, 1528 bp, Heterodera glycines
  misc_feature (26)..(26): n is a, c, g, or t
  misc_feature (73)..(73): n is a, c, g, or t
ggggggggtaaaatgccaactcagcngatgggagaatggaaagtgacttatggagagagaaagccaacgaganaggcacttcacaacaaatcattgccattcgatacggcgcacgcaacgacacatcacaatgaattcacatgattaaggccaagaggaatcagtggcagaaggaactccatccaatcactaattcgaatgaattgacagctcatttttgtccaacaaaaacagagaccatgcgggggggggggcttttggcttttactttctctcgctaatggttgaaaaaagaccttggcgcagcggacgactgaattcaaaaagtcggcaggagtaaagagaaacaaaaatagggaaaaatggcaaagactcgaaaaaaggaaaatgccatataatcatgggactttgcccattgtgattcggaatgattaaacacatcaaaaattaattgattcttaaaaatgagtcgaatgataaaagccttttgaaacaaattaaattttgaaaaaatacttgttttgtcataatgtctggaatgaatgtaattaacagggttgccagatgaaaattttcaaaagcctcatttggcaggcaaaaaagcctcattttgggtcaaaaagcctcatttttataaaatttattcaaaacacgtataaaatgttcaaatgttatatttttgattgtccatgatcgatttgagtaattttttgttttaagtagagtgcgccgggatcgggccgggaattcccggtcctcagaggtcccggattttgaaaagctcaggtcccggtcccggtagggcaaccgggaaccgggaaaaattaaataaaaacaaaataataaaataattttatattattttcactttaaaaaaaaattaaaatttgaattttttaaaatttttttgaatttttgaaatttcccggttggtcccgcggttcccgggctcaaaatcgcaaaattcgtcacttttttggacaaaattttcccagcggcgcctatcggcacctccggaccccctccgttccccaaaagttttatggaaaaaccgtcacaaaaaaagtggagtgaaaatcaaaaaaaaaaaaaaggtcgtcctccggagggggggggggggggactacacctcccccaaagccgaaatcctgggaccgtccctgtttgaggccccatctttttttgtttctcctatgggggcgtactattaaaaagccacaatagaagtcgacctgctctatccaatgataccaaattatgtatgttttccgagttacagttcgggtggttcctttgtgagactattttcggttcgtctcagcatgtcatttggcatgtttgcctcaattttaatttattttcaaagaaaaagagtaccaatataagaaaattaagccatttttttaattttcgcccttatttcgcgatttctcgtccctaaaaatccgcccttttgtgattaacgacccgccagaaaaagttctcggggggaaaatgttgcaaaaaaagagcggggtaaaaatcggga

SEQ ID NO: 29884 - DNA, 1022 bp, Heterodera glycines
ttaggcataccgaaattatttatgaaacagaatttgcaattattaaattatttattgattttaatttttgaatatttgtaagagcttgaaaaaaatgataattttgttggttcgtggtaatcggcgatgtttgctctttttatttaatttacataaatgctgcataattttataattttattattaatttaataaacttatttcttctttttgcaatttaatttcatttgattcttatcatttatatttttgaataagatttatttatttttattttttcttgatagtttacttcattctgtttaatgctttgtttgcgggaaaatatgttatatttaaatggttttaaatataaaaaatttgtattataaatttattcgtagagtagtccggtttcatttcgaacctccttgccctttttgtgtcaaatcttcaaaaattgttgatgattgtttttgtctttataattaaaaataatatctatttatttatttaaagcgatatctatattattattttattttttatttctttcatgtgtaaaacaagtcattcatacttcaagcaggttttttccagaaatattcttttatgactattaaatactcaattttttttaactttgaaaacggtcgaagttttacaatttttaaattcctctttatgtatattctttcatttagaatttttaagattcataactctaaattttttataagaacaatgatcatgaatattttcaagggaatttccggtgtcaattattacgaatatgacattaatttctgccaaccctcggaattcattaaccaaatccataaaagtttccagtccttggcttgaattgagttagtgaccgggaatggtcaaattccttatttgttcatatttgcgttgacccaccactgtttcgactttaattaaaatttttaatttttcccattaaaagtaagaatttaaataatcatttttggcaattttaagaacatttatatttttgagtaaatttttcttttaatttt

SEQ ID NO: 29885 - DNA, 1373 bp, Heterodera glycines
ccccccccccccctcccccctcctcgcccatcgttgtcccatttttcctacacaaaacccaccgatgccttcttgttctttgttgtcggcccatccccccccccctgcccccggcgttcggttcggcacccaaagtggtgacctgcccgagcgccggcggggggtgagtggtgggtggtggcgtcttttctccgtgccctcctcccccgccggtccgttgcctattcgttgccgacgccacggggggggggggggggaaggacggcggtgcccccattatctgctcgttgaatagttgtgcttggcttggctttgggccgaaggtcacaccccattcacattcattgaccattcgccgaattttttcttccccgtcgtgtcccctagggggaaaacgacgggggcggcggcggccgggggtggcatttgagggccctatcgccgcccgccgtccaacgaaaatgtgaacgacccccgaggcgacggcgtcggcgaatttacgagtgctggtgggtgaccaataccgagaattttttttttgaatgtttgttcgttctttggttgttccatgtttggtcaataaaacaaagaatagagagattttttgagagggatttgggtgggaaatttgaatttggtggattcgggattataaaagaggattaaagcaataataataatttttactttttggtattaaattaagcattataatttgaatagtgtaaaatttttgggctatttgactattttgaaagtaaaaaaaaagagaaatgaaaaaaatgaaaattgtaattattagggcttccttttttaggcacaaaaaatcgcgaaataggcacctaaaaaggcataaaaaaatcgcaaaataggcacaaaaatcctcaaataggcactaaaataggcaaataaaattttttattaacgctttttaggtaacaaaacacgttaaaacttaaatatttcaattgtaaatgaaattataaaatattttaaagtttttttcaaatatgaacaattttttaaaccaaaaaatttttattaagaaaaaatatttaattttgggaacaaatttttgaaaaattttttcaattcttaatggtgtatttcctgaaattttttttgggtcatttcttaggggtgtgtttttcgtttttattgcatttttgttaaggattttttcgaaaatccttaaataggcactttaggcacaaaaaccccgaaataggcaaaaataggcattataaaagtcatcgtagaacacctcaaaccaagcggaaaacgcgtttttcgtgcttatctatgcgtatcaagtgcgcaaaaattttaggcatttgcctaaaaaaggaagccctagtaattatcacataaat

SEQ ID NO: 29886 - DNA, 1563 bp, Heterodera glycines
aatatagatataatgcttcagtaacccataaaaatctataaatatacgggacaagcaatacagaaaattaaaaaattgtaatataaactaaaaatggaaactaatcaagcaaataaaaattaatacttgttggtgcgtaagttcatacgttttacagcaaatatgattaagggagacaaaccaaaaaaagaatgaatttttttaaaaacagacgagaaatttttgagttttcggttatttttcgttttcggtttttaaccgaaaccgaccgaccgaaataatcaaaaaccaaacaaccgatcgactttttttattgtgatttgttaacagattttgtccaaaaatgagcaattttttgccagtagccaagatctcgaagtgggatccgggattttgcgtgattttatttatttttttttaaattttatggacataatgccaaatattttggataaattattaataaatttacttaaaattaacttattttcaatcggaaatttcattcaaaatttgtaaaattttcccggcggcgcctattagcacggccgaatggcctccacattattatctcttttaagaatttgacccaaaatagcaaaattgtcaattttcgcaaactctgttaacaaatcgtattaattttcaaagaattttaacggcgggaaccccctccctctatttctagttttttaaaaaaatttcgcctcaaaaaagcgggtttgaaaagcaaaaatagtaaatttatggtgctatgaagttagtcaaaaaccatcataatgggcgttagtcaaaaaaccataaaatgaaaatatttttttatataactttgctcaaaagcaactaaatttttaatttttaaatcattagataggcctaacaagggaaccacccgaactgtaagtcggaaaatgcatatgtgttatataccattcgatagagcagggtcgacttctagtgtggatttttaatcttacggatgcatatgacgaagcaaaaagttacgggccctcaaaaatcggaatttttccctttaggcggggatggcgccatgcaatgatcagtgtgcacaggagcgtgggttcgagtccgcggcacgtaaactatttttttattattgtaaattaaatcaattctttaagttttaataaagttatgcctaaaaatgttaaaaaactttgtttttttagcttctcagtgcgcactgctcaagctcaactacgacaagaagacaccgaaaaaaatagaagaggtgagaatcgaaagggaaaatggcgagacagcacgacactcactcaaccagcagcaacccctagggcggaaaagaaaaaaatagcaacaactaacagaaaaccaaagagagagagagtgcgcgagagagagaaaggagagaggcagaaaagtgagaggaaagattagagagagatagagaaagaaacaaaagagaggtgttgaaaggaaaggagtgggagggagagatagtgcatacacagacgttaaatgtgggcactatgggtacgcgccagtgtcagacaaaattgctcataacgccaaatagcgcat

SEQ ID NO: 29887 - DNA, 985 bp, Heterodera glycines
ttttcgaagtttgaaaatttatttagtgaactgacacattatttgcggactcacgaaaaattaaataaaaataaaaatggaggaaaattgaaaattaaaaaataaataaatgccgcagtgaatttttagtcataaagccattgggaaaacaatggtcccaaaatggcagcggaggcttaaaaatgaactactcacccacggtttgggcgggcacattttttttatgccatcaaaattgggggccgaggagaagcaattcagcaaattgagaaggctcataaaattgtacgaaaaatggaatacaataataaagcaaaggaataaaaattttgcaattacaaaatacaaaaaaaataaattatatttaaacgaatttttttttttttgaatttcttcataatttttttttaaacgttaaaatttattttcataagaaattaatactgctaaaattatatttctatcgaaaaaattaataaatagagataataatttaaatttaatttattcgaaattttatgaatatattatttaacttaattttaattaatcattaattaagttgcattttacaaaaaaaaaatctcaaattacgtaatgttacaattttgggaaaaaagaatgacgcgcttggagatgaagagataaattggataatcggataaaaaagactcggaagaacgaactcccactaattacttaatccattccgttgcactaatatggtaaaagaattgcacagaaaaatataataaaagatgaaaaaaacttgaaaaaatagaatatataatttaataagctaaaaagtgattttttattgaagtatttaagtaaaaattgaaaaaataaaaataatttagtttaaaattaaaaaatgcaatgattcttaatttgagaaattgtaaaacagagttttgccccggctgttttgacgggaaagaaaaatttacagcaaattctgggaaatttttcaaaaaaaaaaaaa

SEQ ID NO: 29888 - DNA, 807 bp, Heterodera glycines
tatccagagggagaggagggatatcaggagaagggggggggatacccaaccccattcattcactcaaaatgtcgaaaaaagagcgttcaaatattttaaaaaaacatatcactgatcaatgccgacacataaattgacatggagtgaattgaacacggaaaaaccaaagtgaagtgaatgggttgaaaagtggagatgagagataacgaaggaagaggagagcagcagacagaaggagggacaaaaatatagttaaatgaaatgggagagacggcgaggggaagaaagaggaaaagatggaaaagggaaaggggaaaagggagggagggaaatgatgcgcaagacaaaagtcagagggcacgatttggggggagaagaggtgggcaaataaaagcggagtggcggtgtgttggggaatgggcaggggtaggaaaagccacaacggcggtgcggcttttcggtaaataaggagcagcaaagtggcgagcgaatgagtggacataaagaaagttttgtggccaaagaaagggtctctctctctctctttccgccggtggccaaccgatcgatcgctttgcttttcctttgcccaaaacactcatcggctgaccaccaattgcataattacattttcttttggtaattagataattattattttattagagggggcatttgtttcgacttgcaattcggcgctcatcgcttcgcgctgtccgtccgtccaattcgattccaaaagttccctcattcattcgcccgtcactcagtggcggcagagttcggcgggtccatcccatcccatca

SEQ ID NO: 29889 - DNA, 895 bp, Heterodera glycines
ttttgagaatgatgaaattacaacgacgccggggggaagggtaaagaaaaaagaaggaatttagcaattttaaagggcccgggggacgacggggaaacgggggggggcgggggaagggcttttccccctccaccctctcccgggggcaatgaaaagacgacgacgaaatattcatgaaaaagcttttggggatggataaggggggaaatgcaaaagtcaggtgggcacccgaaaaggtgcaaagtgagtgccaaaaatgggatgttgctcttgtgaatagcaagaagcaatgaatgaatttggaaaatgatttaaaatggatttataaacggaaaatggcaaaaaagcgggcaattaattgggagaaatgacatttaaattttaaaacaaaaatttaaatataggggattttgaaaatcaatttcaacttggaaccaaactgtaaaaccaacggcaataaatggaaaaattcgaaaaaagcatcatttttttatactcactgagccaagcggaattcttagataggtttaaatgatgcaaaataaattcaaaaaattttttggattcatggaactattgaaatttgagttcgcgtttgaaaatcctctcagaaaaaaatcccctcgaggcttttggtttcgtggtggaagcaacttacagaatgaatgttttaagccacgccattggccacgggaacgttccttcactcaactttacgcattcattcattcattcattcatttggtgataatctttcatttgcttttgggggaccgttttcccatcattggccccggggcaatgaatgtgagcggtgaggtgggcaaaacgaatgagaattttgttgcggtgggggagcgcaaacaatgggacgggggcgggggggggggggagg

SEQ ID NO: 29890 - DNA, 866 bp, Heterodera glycines
attctggccgcaattctatcgactgatataataacgatgcagtcgcggcgttggtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaactctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttcgataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgt

SEQ ID NO: 29891 - DNA, 1383 bp, Heterodera glycines
  misc_feature (67)..(67): n is a, c, g, or t
  misc_feature (91)..(91): n is a, c, g, or t
tttttcaacaatttgtattcacttaaaaaattaaaaacaaaaaattactattcattttcaattatanaatataattaccatgctgatgganacagtggtcattagtacacagaagccaaatggttttaccaatgagaaaatattaaataaaattaaattttttttgtcctttttaggtccaaccactgcaaaatccaccatcattcatagtaatgaataaaatcatttttataaatttcctttgtatgcagaatttttaatttgttatgtattttttagtttcattcaatacaaccaccaccgaaagagttgggacaaaatcaagtaaagaattttcttaattttattttatgaaaattttcatttacttttaaatctgaaaatgggacttcaaaatcaggtaactgtacgtacataaagcagacccgtgcatcagcaggccttacaacgcgttcatagttttggcccgagccaaatgagttcgggccggtcagggctctttagaagcgggcttttgcctaaaatctcgaggctaaaatttcaaaaataaatcaaatcaatcagagccaactattactgtgacccttttctgtacacccattaccgtatagaaaccacgcgaatacgaatcaatcagcaaaaataaacgtggaccattctttttagacagtccaattgtccccactttcttttcgccgatgactctttttgtttggtcgtttgtttttggtaaattggttttaccttcttttaattctttattttgaattttcagctcattttattgtggtgccgcttttctaggccactcttacggcacagtttggacgaatttgccaaattgacgaacatttttgtgtgtaaagaagaaatataagacagaaaaatgatgaattatttattcctaattaaaattttaattattgtaatttcaaattgcatttttaatgttcatattttcgaattttgaataaagctcggcaaaaccaataaaatagtttatgaaaaaagccatttgtggttttaggtttggctaatcttgaaggaaagaagttgcaacattcgctagtctttgagagttttatgtaacaatttaataactgtcaaattaacatgaaaattcactatttaaactcggaaaattgcgttcttcgcccattccttcgacattcattcctttcgtttttctctttttcccttcaattcttcttaaatcgccttcctttgtcgcttttccaatattttttttaactaataaattttattacatataaatttttgtgaaaaatttttgaaaatttattgggattgttaactgatgttgccaaaaataaatttatttggagcgaatttttaaagaaaattaatgattttaattaaatg

SEQ ID NO: 29892 - DNA, 1374 bp, Heterodera glycines
  misc_feature (15)..(15): n is a, c, g, or t
  misc_feature (47)..(47): n is a, c, g, or t
ggtagatattatttnaaatttgaaaaatgacaaatgccaaaaataantgcaggtgagaaagaaggtggtgcgcaaggtggtgcgcaaaagcagcaacaaatcggacagtccggaaaagaacggaagtccggcaccggaagagccgccccaatcgccgacagtgaaggcgacgacgacgacaaatggcacagtgccaacggctggtgccaaaacaacggttggcaacaacactcagtctggcactggcgctaaaagtgtgtcggcaattattgccggaaggatggcgtcattgtttaataattgtgccgggaatggagtagaaggagcagctaatggcgagaacggcactggcacgaacagaaacgatgccgcgccggcaacgacgggggatgggggtggagcagcaatacatgagatcagtgtggcacggtttggcggcgacgaaccgacggcacaatccgatgaagaagcggctggcaataattccacgagaaaagaagcggctagcgatgccaaaaagggggaatcaactggcataaatgccaagagagaagaagcggctggcaataatgccaagagagaagaagcggctggcaataatgccaagagggaagaagcggcaaagaataatgccaagagggaagaagcggctggcaataatgccaagaaggaagaagcggctaagaataatgccaagagggaagaagcggctaagaataatgccatgagggaagaatcgtttgacactgcttgcaaacaaagcaatggtcctgacgtgacagagtccggaactaatcgctcggcttctgaaacggtgccgaaatccggcacggctgttgagataaagccggcaaaagccggtcagttggagtcggaaccaaaaactgatcacactgttgatgattcgccgccaattgttggcagccggcgagttggagcagtgtccaaaacatctaccgaagcacccaatgaatcagcagtgcctgaacattcgtcggcgatcaaagaacggcgcagccaatcactggacgggcatgaattggcgaatggcacgaccaacggagtcggcactttgcgcatgacggagtcgtcgtcagaagacaatggacgggtaagaaaatgaaatttttagaaaattaagttttaaactaaggcttgaccaactgtctaaatttaattgggtttgaccaagacccaagggcgtagccagacccttggctttgggggggctgaagtcaaaaattcgattttaggggtgtatttttttttttttcagtagatttttaggggtgtatttttgtttttttgaaatcccgaattagggggcgtatttaacaaaatttttcgccgttttcgccaaaatttactattttt

SEQ ID NO: 29893 - DNA, 906 bp, Heterodera glycines
gaagtgtcccccggacgccggacgattgagtacgaaaagcgtccgttagtgaaaggcaaaaagcgaaggaaataaaggcgagagaatgcattgccgaggttaattcagagatatgaaattctcttaattaaggacaattaaagggatggctaatttaattgggccgagtgattggacttctcttgaacagaaaaaatgggaaaaataatggtgggtggcgcattctcgcgacaattcatacgcattcctcgcaccgaatggggcggggtgattaatcaccccccccccccccctcttcaacagtccctccctcccttcccaccgatcaatttgcgcccatttgaagatgatcgattaaaaggaaaaagcgaattttaatttgtttattaattaacaagaaaaaagcagtgaatgggaggaaagacaaaagtggaggagaaaacattcagcttttttggaaaattgcgctttggagacgaaaggaacccgtttatagagaagggacagaataaaaagtattgaaattctgtacaatttatggtaaattgttcaggggaaaggcaagggacagataagaccaaaaagagaagaaagaataaagtgaaatcgaacgcaaaaatggaagggtggcacaaatggagggcatcgacgaaatgacgaaattccgttagtttttccaattgtcagggggttgaccaacatcaaccagcaaatggaagtacaaaggtcgaactgtgacctaaaaaagacagaaaaaatattccctcacaaatcattggacaaatgaaacatcccccccccgccaatgtccacagaaagtgccgtctcacattgagaattttccatcggttctcttcgtttacgccgtctctgtccatgcgattgtccgcttttgcaagcaatttg

SEQ ID NO: 29894 - DNA, 1482 bp, Heterodera glycines
gtgtgcgctttgcgagccgaaattggccaactgaagcagcggaatgccaagcagtgcccgcagttggagaggcaaattgacgacttgaaaaaggtggggcaaaaaacaaataatcgttctcatgcattcttgttcaattaaagggcctcaacttttttatggttttttatgctttactcttggcgataaactaatatttgacaatattaatgttttcaaaaaggtattttgaatttgaccgctgtttactgaataaatttttttattcaccccacccctaaaattaagcaaaaagttttttctcgaaataatcgccctccggcgtcattactttatgatgctattgtatgtgtattcccatctaataaggaaaaattgtttgttctcggggcactgccctttcattctcccctccctctgcttggtggtgacgactctgctttttccagtcgcccattagcgtttttcggtccgtttgttcgctcccccccccccccccctttgctcctcatttacacataaacgcaaaaggaaaaaagcatggaatgaaacgacaaatgtttgtgggaatgcaaaaacacctcttttttttctcccatttattatcaataatttctttggtatattaatttttttgtttcaagaacgatcaaaataaagaaattttgcttggttcttaaaaaatgtcccttcaccttccacagaaatgtgaacagttggcgcagtgcacgcagtgtgaacagtacaagaaggagcgggacaagaagacagaagcactcctcgacaaaatcaaggagtccttcgacacgaagaagcagaagaaacaaatggagaacgaactgaacgaacagcgccaaaagtgtgcggacctcggcaaacagaaggacctgctgacatgcgaagtgtgttcactgcgcgaagagttggagcgggagaagaaggccaacgcacacttcgacgacgacctcaaagagttcaaacggcgtcgcttggccatggacgacgagctgaagcagttcaaacgtcgagagaaggacattggagccgagttggagcagtgcaaggaacagaaccagcaacttgtcgcggcagcagaggaacgcgaaagccgaattatggagctggaaagggtaaaaaattgtttttttaaattggatcataacacattatttttttttaaatccctaggattttacttttgttctaaattgcagaatatatgctcaaaggatgtggggggggggcagtttcacatgtggaacggaggtaaatcgctaattttgcgaaaaaagcacggataaagatgaggaattttgcgatttttttttttgcaaaattatttgcgacattgtaaagcaattcttaaggttttccaattgcaaagaagtacacaaaaatgctagtttttaatctagaactaaagcaaaatcctagggattgttagaaaactagctgtacttctttgcaatgggaaaaccttaa

SEQ ID NO: 29895 - DNA, 1858 bp, Heterodera glycines
ttgtattttcaaaagaatcaagtccattttgaatttgtattttagggatgtgccagctggaaatggtactacccttaccactacgcgccgtttgcctccgattttgaactgatcgccgatttccaacccgacttcaacatgcccacgaaaccgttcaagccattggagcagttaatgggtgtgtttcctgctgctagcaggtgtgttgatatgttttgttttgttccccgactggcacttttataattattcatttgcagagctcatattcctgacgggtggcgttggctgatgaccgactcaagttcgccgataattgatttttacccggaaacttttgaaattgatctgaacgggaagaaatatgcttggcaaggcgtcgctctgcttccatttgtcgaggaaaaacgtcttttggatgcacttgactcggttttacaattttttttcaaaaaacaaaaaatattttaggtgtacgccactctcacaaccgatgaaattgcgcggaatgccaccggaccagaccgtctttttgtcggcaataaacacaacttgttttcgctcgtttatgaggtgcactcccaaaagacgacaattccgataaaagatgaactaacaaatgatgacacaaaagaaacaagcgaagggacgcgagaaactgaaggagaagccgaggaaactcaacaggcggaaaatggtaaattaaattttgactaccaatcatttgccatataaaattgttttttaattaaaaataggtgaaagcgaacaaatagcgaaagccgaagaaacgacggcacaagaggaacaagcgaacgaagaagctatctcaaaacctgaacaggcaccgaaacagggtaagccatttaaggcatttcctctttaaatatcgagatttagaattcgagactgaaattgaatttgtcgatgacgaagaaaagaaatgggtgcacatcgacgcagtcaaagcgtatgggatgtctggcgaagtgtcttatgacgtcgaagcactcgcttttggtgaggcgcatcggtcgctgttcagaaattcgttggagtttggcgacatcaaagtgagttgtttttacaaatagcctatgtttcaataaattgcatctcttcaggagaatacctgcattatggttcggtttttatcatttacaatgttcgatttatattttttgtgcacaggttgagttccgagatccccaattcccaatgcacttcatcttcaaagccaacaggctggacggcatcaaggaattgcctcgtgtgctcaaaccgaacgattgggaccaacgacggcacggctccttccaaccccaaatcggattcaggttcatcgtcaaattgttgtctcgtgagacaatgagcacttgacatttacagtcgtgacatcccacgtgcaaatctctccatggcgggccatcgtacgctcaaccaccacataaacgacaaccgtcgcagttgtccggcctctcttttctcagtgcaaacatcgccaccagcgcacacacttccatggcacatgagcacaaactcaccacaacaacaacatcaaatgcagtaccaacatcagcaacaatggcagcagggtcaattttacaacgggcaacagcagcagcagcccgtgccgttgttcagttttgggcagatggcaatgcccccgcctccgccgctcccaccgcaaaattggattactagtcacccgccaccacaaatccagtctcacgtgccgtacgggcagcccccacctctaatatcacagccacggaatactcagcatcaccatcgcagaaacgacaacaacagaacttacaataggaaataattttcatcaaccgctgaatagcggtca

SEQ ID NO: 29896 - DNA, 1110 bp, Heterodera glycines
  misc_feature (34)..(34): n is a, c, g, or t
  misc_feature (91)..(91): n is a, c, g, or t
gagaatctgattctgacgttcgtttcgtcccatntagaatcccgaattcgaacaaaaattcctaaattcaatgttcaacaaaattcacatntacacaataaaatttcaagccaatgatcgaatcccattgttgtttaatgccaaaaaaatcgaacaaggaggctattatcgacagtatttaacttaattgcccgttctttttttacttttttaaaatttcagtcccgaaattattagtcaaaggcctgagggaatcactaccaaaagtgacgtgtggtccttcgccgtcgttctatgggaaattttctcgcgtgaaataccttacaacggtagagaacgaatatccatcccttctgttgttaatgggtttccgtgttttaggccttacggaatttaaaatttattcgataatttcccaacacggagttcgtctggttattcccgagacatgtccttctcaactcaataatattatccaaaactgttggcgcacggaacctgccgatagaccggacatgcgatacggttcgccacggtcttaggctatgtaaaagcgcatttttcagtgcttgccgttctgcaacagataggcaatgatgccgaattgcaacgcgaagttgcgcagtttttggtctttcgcaaggacgaatggcgggaaatgattcgcgagcagaccttcgcattggaagtaggcatctgagattgcttcgacatgaaatagggcataatttatccaggaactgaagttggatttggcccgacagatggaggatttacgaaggcgggaggccattgtccgaaagcgggagaacagccatcgtaattttctccatttggtaaacatcgctcttctaattaggtttattgcattcgtgagacttttaggtggacgtcatgaacgtggaggacgtttgcgaatggaacgaggattgtgtttgcgaatgggtgagcaaatgatcagcaaatttcagcccattttgagcttttgttttaaggtgcaaaacattgcggcaagtgccatggaagacttcagcgaggcgattgtcgatcagctcatttcgtgtattcttcagtatgaaatccatgggtgtcgtctgtttaaaaatcacc

SEQ ID NO: 29897 - DNA, 981 bp, Heterodera glycines
tttttgttttcggggcagtccccccgaacccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttg

SEQ ID NO: 29898 - DNA, 1627 bp, Heterodera glycines
  misc_feature (1496)..(1496): n is a, c, g, or t
  misc_feature (1526)..(1526): n is a, c, g, or t
  misc_feature (1531)..(1531): n is a, c, g, or t
  misc_feature (1561)..(1561): n is a, c, g, or t
ctctataagtctacaaaatttaaaaaaatttcgttaagtttcaaaaaaattatggctagaggaactcaaaaaaccttggttttcgagcattttttgagcatctttggccctaactcttttgaaacttaatgaaattttttgaaattttgtagactaatagagaacacttaggactatcgaataatatcaagaattaaaaattttgttacttttcagctaagttataaataatttttcatcaaatcataatgatggttttttaaataaaacatagcaccttctaatataatttctctaatttagattgcgaaatgttatttattttttcaatttttctcatttatatacatttaaacgcttcgaacggatgtggcactgaactcggaatatgggaaaatgttagtaaaagtggtgccgaatttttaaaaaacattaacattgaagcaaaagtattggcacgccaattgtgccaacttgacgaagtcatcttgaaaattgcagaaaccccagcggaaaaggcatttttaattcgtttaaaaaattttaattaaaatttcaatttcagaaaatggtacaaaatcagttgcaaaatgatccggcacttttatacagtttggaaaaattatttttcatttatcaaatgctgaagagcttaaaaattggtacgtttcgggcttaatggaatttaatcgaaaaccgcacctaatattatgttcattataattaattacttgctgattctttctaagattggcaacaaattattgcaatatttttgaataatttaattcaacttttttttcaaaattttcgggactaatttttttttttgactttttgttgccaattaatttttttcaattttcgatggaaaggtggaggtaaaagagttttggggtcaaaatcttaggatcaagcatatattattaataaaatctacttaaaaaactatttttagatgccaatcgtcataaaaactatttgaccgcctcattagaacattctatgaccttaatggccaaccgttttggcattccgttcaacgaaatttcgaatgttgttgagccaagaaaaagtgcatttatgcttaaagaaatcacaaatttgttaaatgatcaatttgaaaatgagaggactggaaatgagcatgaaaaagaagaaaatgggcaggacggatatcggaaaaaccaaaaatggacatttcgccaactcagcaacaattcgaacaatttgtttgggaaatggtttaattcatttcataaaggtaaaggggtaattaagaaaaaaatttgttagatggcttaacaatgtaaacatatacaaaattgcatttttatgggtttaaaaaagaaaatggttatttttcgctaaatccaaaaatcattaccccttcggagaatggcaaatttggcttttgcgcgccaatatatttttgaagcatacccaaatgttttttttaaaattaaatatacattttctacctagaaatgcagcgnccgtcgtcgtcgaaaaaagcgcagagattntttcngcattaatgggtattttaaatttatgttgngatttagtatgcttttgtcatggattgtcagaaatcgttactttttgttgctcttggcattctgac

SEQ ID NO: 29899 - DNA, 1726 bp, Heterodera glycines
  misc_feature (1603)..(1604): n is a, c, g, or t
aaaaaaaattaacaaaacaaaagggtcccccctatggtttttgataaaattcaaaatctatcactttatacctagcgccaaatttgcttaataggcccaaataattgtcatattcgtgatcagcgacctttaaaacacccgggtacttggtttcaggactttttaaacaaaaaaaaatttgaccaaaaaaaagttgaaaaaattttcaaaatagtgctccttttaaatagcgccgatttgtgtctttttcagtttagccaccctttctttgatctatttattgtccctaatttgtgcagcacatttttattcaaattcgctatgatcaaacccacttttaatcttttgtaggcaatttggatattttcatgcaaatttctcgactcgtggacctaaatttttgaaagtaaaataataaataataattttgtttaataattagttaaaaattgtatgcatttaaaatgacaaaatatgtgcataaaatatgcactaatatatttgaaaattaccaaaagtcgaccttaagggtgcatttttcggttttttgcctttttcctttcaaatttaccaaaaaataccaaaataagctctaaaattcaacttaatttaaatgcataaaaaattaaataaaaaaattaattattaattcttataaaattaaaatgccattaaatgagtgcccactttgactacgcaattcgtccgcttgtgcttcaaaatcactgcgttccccgccgaatttacgtttgaccctccggggccccaccccctcacatgtttttcttcgcattcttccggaattatctcgggcaatttgtaccctttgagacgtttttttgcgacagaagtgctggagaatctcacaaaaatgcgaattgaaaacatttaaaacaaaaaaaggaaataaattaaaattgaaaaaggaaaataaataaaaataaaaagacggataattaacaattttaattttgattcaataaaatatcattggcattgcgttgattaattaattcaaaagttaaacaaaccccaaataaattgggagtagtggtgacttggcgattattctttgatacattttgtacaataatttttccgttggcatttgcccatttcgctttcatttctcatttattttgccattctttctccatttctttttccgattcgcttagtctcttttttcttcttcttctggcgttttgtccgttgtgccataaatttgaaatcgccgtcctttccgacctcctttcaatggctctcttttcccttctgtttcttccaatttcgttatcatttcgctgtccgtcgttgtgtaattgttgtactcgtagtaaaatatggccaaaagtgccaaaatggcactgaccaccaccattacgacggcatagaaaaggaattcgaccgcggcgtttgggaaagcgatcaaagtgatcagcaaaatgatagtgtcgccaattgcggtggtcatcagcctaaaaggtaacaaagaattgaattgcaaaatgaaattaaaccgaccaaagcgcttggaccaaagatttcatcgacggaggggcctaaagaaaaagagaacggaaattcaaaaagggacaaatgnngagaagtgcctgggaataggcgaactcgtagcccgtgatggagaagagcacttccgcagcagtgagcaccataatctgagggatttgccacagaatggacagcgaattgtcgggcaccgcgt

SEQ ID NO: 29900 - DNA, 1176 bp, Heterodera glycines
  misc_feature (8)..(8): n is a, c, g, or t
  misc_feature (25)..(25): n is a, c, g, or t
  misc_feature (72)..(72): n is a, c, g, or t
  misc_feature (132)..(132): n is a, c, g, or t
  misc_feature (139)..(139): n is a, c, g, or t
aatagatntagtccaaaaaagaccnaaatttttgatgtaaatgttagaattatgattgaattcccatagatnaaaggaataattttgaaaaattataaaataaaatattgcttggaggggaactgatccaancgataanatgaagaaataacacacagattcacaccacacctttgaccacgcatatgagtaaataaattaagcaaaattaagactttggatataattcgcttcaaaaattatcatttaaaatctaaatttctctctgaatccaaaaaataagactaaaataaggacaaagagcttaaataaggacaaatcttacaaataaggacaaatggtaaccctgatttagactatggagaatctaggaaaaataaataaatttacttatttttgccattcctaataattacaaataataacgaggcaaggcaatcttccactttttttattaactgcttcacaatgtttttacattttaacaatcaccgctaactttatgaaagtttgtctcaatgacaaaaaaaactgattgttaaaaaatcaaatcaataaaagaaaataataattaaaaaattagaatacaaataacaacagagaggaattacacagtaattgttggaagtaatacatacagagaaaattgaaaatggaaagggcaggggatgggaagaccgaacgtgaaaatagagacaattaagcagagagagagagaacgcgagaggaaaaactgaaaacggattaaaaactgaccaaaaccaaaaaacaacaacacgtaaaaacaatatttacttttgtaaggatgggtaaataaatgtgtggacgcgctacacgattttgcaagacattcaccagcagaatgacggggggggggattgagttgggctttgaacagtaattaaaccgaaatttaaatgtcgattttttattttcgatttttaattttttgaagttatgaaagaaagattcaattgattgtaaattagcataaaaattacaaatatcagaaaaaataaaatgccataagagtaataaaatgaaaaattgtttaaatttcactggaaaaattagtggtttttgctgagaaaaaaagataaaataatgataaaataatgataaaataaatgaaaaatacaatgaagtgtgtgaatttaggaaatgaattgaagaaca

SEQ ID NO: 29901 - DNA, 1480 bp, Heterodera glycines
agtaagaatggaaggttattatcggattccgctccttaaaatcattaaaaccttactcgaaaataaataaatttttaaaaacatagggatcgacacacttttgtctcgcacacatttgttattgtttcacagaaaatgaagcagtaacaatccaatataataatggatcattaaataaaagggaatttcgcatatatcgcaattttaaattattctttatcacacagcagagcgcagagacatcatcaatcattcataatacttagaaaagaatttatggaaggcgccaaaacgattgagcatgtcatcgaaaaaaattaaaagtttttggcaaattaatacaaaaaaattttgaaatttataaaacgaaaaaaaaattcttaaaagtctatcgatctttccgttttttaagcactggtaagaatggggtctgagtgaaaaattagtgaagaaaattggagtcaaagggaaaaataaaaaataataattaatatattctttaaaagtaacattgcccaagtgtgcaaatggcctagtggctagtcttcttgactttcccttcttctttcccctggttcaatccctctacagaaattagattaggtattttcaatttttttttttttttgtatactcgtgggtttcctataaagaaaatatgattcctcatagttttttttaaattgatacatattttatcattttttaaatgaaaatcctaccaattgagcttaataatcgcaaaaaccaacctttttttgttgaagatttctcatttattagaatttttaaattgcacccaaatttttaaaatttccccggcggcgcctatcggcaccgccggaccccttctttcccaaaagttttttgaaaaagcgctccgaaaaaaagtgatgtgaaaatcaaatctgaatttctattaatattcgatgatttagacagcatgtgcgcacggacgtgttggtgttggtggtgaaagtggagctggtgttactgagaccaaattataccaataaaagtcgaaaacatttttgatttctttctttgttatttttaatttatgcgaaaatgttttttatatttttcatatattattgtacaattcaatttttcttgctctttttttctaaggagttggtgtcctgccacaaaaaaagaagattttctagagtcaaaatgcgcttatctcgaatcaaagctcggtttttgcaaaaagttttaggtcgcacgaatactaatgagtttcatgcttttttctgtttattcatgatgtcagagcaattccaaaacaaacgattagcaaaattcaaacgcaattcactttttttattgaaagaaaaattaatttaaaatgaacaaaaatttattttggtatgtataataaatattaaacaaattatatataactaattaaacaagcaaacaaccatacggatccccataatggtgcggagccattctttaaaaatcaagacctgca

SEQ ID NO: 29902 - DNA, 1186 bp, Heterodera glycines
  misc_feature (73)..(73): n is a, c, g, or t
  misc_feature (1154)..(1155): n is a, c, g, or t
  misc_feature (1158)..(1158): n is a, c, g, or t
atgttaaagcaattttcgattcaattggccaaagtggcgatttggagtgccaaacaatcgacaatttgtttgnatgaataattcatggagggggagcttcgacagtgtttctctcctcgcaacccccgcatttttccaattccgtaaattttcagtggcaaaaagtggacaaaaaaaaaaaccaaagaatattttccttagataatttaattttatttaatattcgaatttctcttctcaattggtgcaccgatggaatttattgaaaaggacgacgaacagagccttcttcggtcagttcagaaaaagaatatcccctcaataaataattggcgaaagccccccaaggatttcatttgctttttaatggcaattaatggtaaaaaaggaaaaggctctttccgtactcttctaatgaccccacggggactctttaattggaggatttttgaactgctgaaagttcgtttgacaatttacaatgaaacaaaaaacaaagagagaattgagtctaaagattgtctctaaaccaaaacgctattggacatgccaattctgttcagaactcgcttttggcttgtggtcgttgccggcggtgccgcctccgcctttggcattgttgccaatgcgatgctcacgcgtctgttcctcactcggcctgcgttccgccactcgcccttctttttcctcggcttcgtcgctttgtttgacactcttttggattccgtttacattttccttttggtcagttagcaaatgccatttttaatatttgaaaattaatttaaatatggaaaaagaaattattatcacgtttttatggcacaaagaattaaagctaatgctaatgaatgcttaaaattattaaagttttgttttcgttgttttaaataatatttgtgagaataaagtaagcattttttaaataccgtattgataaagaagaaattttgatttttgtatattaatttaacgctattttgtcatctcataaatagcgcttttttcgaattaaatttgaaaaaaagaaagtttttttgcggtgacacacacacttcggtttataaattacgcactcacttatcgtttttacattcatttttttatcctttttttgatcttttttttctctcccgtttaagctgatattgttnngtnataaacattgaatttctctacatcgatt

SEQ ID NO: 29903 - DNA, 948 bp, Heterodera glycines
tcgattagaatacctgcactgccaacacttgagaaacggtgaaagctgtttgatctgttcatggcgcataaaattgtttatcggccgaacagatctgaaactattttctatttttaatccatcaacacgctttaacatccccttttatagatttaacacaaaatacaaactgggcaaaaaattcattccctttgctgggagggtaacaaaattgtggaatcaactagataaagaactaataaaaacaaattctttaaatcaatttaaaataaaacttaaagttcactagggtaatatgtaagaccgggaaagctagaatgtaacaaatttctaagtgatttggtatttcgacctcatttgactttgacctcaatttatttattatttattttcacatatttttgtctttttttaattcctgtgattatccatatattttgtcacttactctacgacacatttactggaatagtcgtcagagtaagtggttttcgcccttctgatgacttttttattttttatgaataaacaattaagatttatgactattgaaaagcagaaattcaaaaatttcaactcaaaagcaccgcttacgttcgtttttctcattttgctggttttcctgattgtagtaacgagccatttgattcagcaaattgtcagaaaaaatcactgtaaaaattcacatttgtaaatattaaaatgggttgtctaattttgtgtatgaatggatggattaaaaacaaattaaaagatcgatttccgacaggaatataggccaaatactgtacaaagttcataaatatactgtggaaaaaaggaaccggaaaagaaattacaaaattttcccctgaggcgctattaccatttatattataaaatttgttaagaaataaggcagaaaatttccaaaattttcgcacggtagcgcctgtcggcacacttgac

SEQ ID NO: 29904 - DNA, 1299 bp, Heterodera glycines
actttgttatttgaaatgggaatttattacttgacaattttaaatattttattaattaaaaatttttccggtgtttttaaatttaatgcaattaattcaaatatttcactccgatatttaattttgaaaatctaattttttcaattttttaggttgttgaggaccgaattcgcattaatgaggcgaatggtggcatccgaaaggacggactaatgcacagcgaaggatcactgtacaaaggcaaaattatggcatttttggactttttgctgacactgcgcgaggagcaaaagttgagcacggagcaagtgagggagcaggtggacgcgttcatgttcggaggtgagaagaattagcagcaaaaatgccgtaaaagattgggtcggaaatgccaaaacttaataatgcatcatagtgaggacttggaaatttcccgaaaaagaatattgggcaaatcgccaaaaaatgtgatcatgtcaacaaaaaatcttttttattgaatttttttgttgttaaagaatttattttacatgaaaattcaaaaaatgccaaaataaatataattcagatcacaaattatattaaatgcaaggtcattaaaaaattcaaattccgaatttgggcttcaattttaagaagaaaaacttatgaaattgccgttctcaaattcgatactttggacaatttcagggcacgacacaatcgctcatggcatgatgtggtcaatttatacatagcaattaatctaaaatatataacaatttttaatgaattaaaaaaaaagaaatttcttcgattaaaatttaaaattcgaattcatttaaaaaaaaatatttatttgcgtcatttacatgcctgcccacaaaatatttccatctataatgccaggtttctgtggtcaatggcatgccatcccgatttccaagacaaattgcgtgccgaaattgctgaccattttggagtagcaactcagggggaaactgagctggaattgaccgcctctgatgtgaacaaattgccatacttggaccggtgccttcgcgagactatgcgcatgtttccggtgattaatttttatgccaataattagtgccatggttttctgtaaaattttgtttccaatttctctcccgaatggcacataaatttataatgaatctgatcttgctgatgactttttaaggtgttccccgtgttggagcgtgagcttcaggccgacttgcgcatcggtgacaaaactttgccccgcggggcgaccgtcgccattccgccactgatcattcaccacaacgaaaaagt

SEQ ID NO: 29905 - DNA, 1197 bp, Heterodera glycines
ttgatactgaatcataaaaataaaatatcattagcagaggtataatggctttcattacaaatgggcatacaattaatatctatggaaaagaatttctgaaaattcgagtttaatatattcgattcatccattaatttagcagttattttaaaagtcgaccaataaaaaaaacgtacgtttgttgttgtacatacttaaagaaaagggataagttcataaaaaaaaattagatgtgtcataattaaagtcaaaaaactcagaggagctgatagattgatgatagtaaattagggaaggatggggacaaattggacaatcaccattatcattagcaattagcattcgttgtgctttctctctctctctcccttgctccctccctcgctctatactcttctagtagtgtgtctctatctctgatgtgtatatcgatctgagtcgctgaatctttgacatttggggtgggttgatcgaatcgtcgagttgacgaatcgaggggaggcggttgaagctttcttatttgtaaatttccgaattatgatcgcttggcgaaatgaatgaatttgggttagtttgcgaattttaattggcaaagtgaatacttagcgaaataaaattgctttacattcaaattaaatgattagacccgcccctctcctccagcagattcttcagactcgagtttttcttggttaaatttttacttcagcagtataaaagaaaattgccgaaaaaatcattttaaatacaaaaaataaatatcagttttcaatcttcaaaaatgtttaaaagagctaaccatgagaaagaattgaaactgagaaagaaggaacagaagcaaagagattaaccactaagccaacaattaacttttcaataatttttcattcctccaactttgctcaaaaatttgatccagaaccccatgcttaccagtgtacttttggacccggacctaccgggtcgggtaccgggtttgcaacagggttgcgcaaatcacccgaaaccctacattttctcgacccgaaacgcgacccgatatttttctcgacccgcggcaaccctggtatgcaatagagagactctaaaatttatattgtctatgagtgaaattattgggccaaataaaaacagacccgagtttatcttgttcttttagtgttttaaaaaagcacatttttgctgtcggttgtagaa

SEQ ID NO: 29906 - DNA, 945 bp, Heterodera glycines
acattaccaaaatcatacaaaacagcattatttatttttttattttttaatatcaactaacaaattaaatatttttatacaatttaaaactaattgtacagagaaaaaacaaaaataagaaggacgtttgaattgaatttgaaaccttttgtgacgatagatacgtaaatatttattgaacacaataaaatatttaataggataattttcaatgaaaatataatttatgcgaaatgctacaagaaaaaatcacgatttacaaaaaacaatatttattccacattatattttataattgtcaagaattttcaaaaaataatatttattgtaaagaataaatctaaaataaaaggtttatgatatcgaagtgtaactacaatgtatagatacttcaattatcgattgatttccaccccaaacctattggcttcttttggggcgagagagtgcaccgtctaacctctccagcgacgagagagtgcaccgtctaacttctctcgcctgcagagcccgtgcctatgggctgctcggtcccggagatggacgagatcgcgacatctctgaatgaacagctgacaccatatcgctgcccattggcactgatggccaagacaacaaagcattaataatggctctgatggctacaccgacacgcattatgccaactcatgacgcgctaactgttaacataactacaatttgacgaaattatagtatgtgtggctgaccgtgacgttatgtcggcaattgtgccacactttccagtctacagaaattttggcttcaatttctctcttcttaaaaaattccaccagttttttgcatgtttttgcagtgccttttcactttcttcgcaaatgttctgaatgccattgtccaaaagttggccctttttcaatgctcacaatgtttatcaactcccaaatatattttcacccgaatcat

SEQ ID NO: 29907 - DNA, 861 bp, Heterodera glycines
  misc_feature (80)..(80): n is a, c, g, or t
  misc_feature (839)..(839): n is a, c, g, or t
ctttgcttttataatctgttttaatggaaataaatttcatttaattataatgtgatctaataaattaactttacattttnaattagatgcattatacgcattttaaacttcatgatttttaggtacctaaaaatggaagccctaataatcgaagtctgtgcgagtaaatttataaaaattcaaatttgcgaccaccaaaaaagaaaaattaattgcaaaaagaattataaaataaatgagttttattattttgtgaatttgaaattagaagatgagagccaaccgaatattataacatcaatttggaggcatcagagacaggcatttaaactcagttaaactcagacaaaaataattaaagtaactaaaaatcaaagagtaattattaaaataaaataaaaacaattcatgagaaaattatttatattaaaaaattatactgaaagagaattatttgtcatttttagcaaattttttaactaaaaaatgacaattttgatctttgtggtcaaagtataaaactaaaaataattgattaatgttgactataatattggacacttaaaataaaagattgataaatgtttaaaaataattaggaaaatatatatatacttttttgaaaagaggaactgaaagacgaacagaaagagtaataaatagataatttggtttaaaattttttaaagaattgttaagttccagaattttttttgttggtgattgattccaagatcttgatagttttatgtttatttacacatttttttaaattattaacttttcttataacaacatttgctttattcgatttgatggaattttatttatttaacaanttattattggaaattaattgaa

SEQ ID NO: 29908 - DNA, 1439 bp, Heterodera glycines
tataattttgacactttaaccccttaattgattacatttttgtgcttcatatactgcgccttttttctaatgccaatcaaaacttcccttttccttatgcttttgcttaggcttcaatgaccgaatccaccggttctttgtgctcctccaatttcgcctcggctgcccaacaaaatgttgtcccaccagcaacagcagcatcagcagtcgatgttcatcaacaacaacaacaacaacaacagccgatgctgcagaccaattctttccacgaccggcgccgtctgaacactttggccgagaaacggtcctttctcgtccgaatggtaagtgccgccgggatggcacggaattccgatttccgaaaattttttgcttctcggaatgccatcccttgtaagtgcgccgggagcggccctttgatgtttgcccgagttatcacagctaattagcattcatttgctaatcactcctttctctttcattaatcactaattatttttattttctcttttttcttttcattcctccgctattttcttatcattaattgacttttcccatgatgtttctcatctgttcacaggtcagtgacccgaagtgttacaatccgaaaattgtgcaccatttgaacatgcgcacgcacaaccaaacatcacaagacttattcagggacagaacattgaggtgtgcagcaggggaggaggacaaagtgacaaatgacaaatgggacaaatgacaaatgggaccaaaatgacaaattggaacaaatgaataagaaaactcaaaaatgggcatcggttgtgatttcgttagatttttggcaattttgtcttgctcctttcccccccccccccccccaaataggcatgcaattgaacaaagcagccgtgccatcggtggactgtgtgtcgcaactgctgccgcccaatcggcgccgtcgtcgtcctctaccgccccgctcaacagtgccaaccatcacttccatttgccaagtgccagggcggcacagtttcgaagcggaaaatgtttgtgcccattcaaaaggaatgccaatgatgtttcctcagatttgtacatgagcatcgatcagcaggggtcggacgacgattaaacggcgaacaaacaattaacggatgaattttggttttcgtctcggcgtattcaaaggaaaaaggtccgcaaaaactattacaaccgtattagaccaggaattgtgtttctggataattaccgttaattacccaccgcaagtatcattttattagccatgtatccattcatcattattatcattttgttccatcggtgcgtcgttcgttttgtttgttttttgaataatttctcccttttttggcatagtgtaacaaataaaaatgatgctgatgatgttaatagataaagatattgtacatatgtaaatgtgcatgtgtgtgctgtgt

SEQ ID NO: 29909 - DNA, 1021 bp, Heterodera glycines
ggcaaataggacagtcgtttaaaatgccaatgccaaacattaattcccgagtcgcgtcaaatcccatgccaaattgtttcccgtgccattgtcaccccccccccccctcccgcaggtgtccagctgtgtactgcgtggccatcagctgagcggcttcgactgctgtcgcatggttcagccatggctggcaacgcccagggccggcatttgttggcccttcgtcgtcaattcgtccgcctctttacaaagtccgttggacaacgcgcggggcatccaaatcacttttcaggtggtgacaatatcggccaagtgatcggagtttcagacaataaactgatcaaaatgattggaacccaatcagagaataaattaaagtgatcattttccaatttgaaataagcgtaatctgatcatggactgatcgaaatttgggcaataaaacgatcatttagccgaatgtgattagggattgaaataaaatgcatttaattcattgaaaataatcgccgaataactccgatcggactttaactacaacagattagaacaaatattaaagttaagccaaaaactgatcagatgaaccaatgcgttaaaaagtatcggaccataactacccaaaaatataatttattagcaattatttttctctaaattacccccccccccccccgccccgcagatttcgcgcaattcgttccgctcgggtgccctctccgtacatcccggcctctccgtccatttggtttccccgcatttgcccatcggtccccgtctccgcgttgccacaagtctcgactcggcggccaacgcccatgcgctggccgacaaacgctcgctccgcttggacattcgcaaggaaattgtcgcggacgccgccgcctcgccctttttcccgagcagcgggtgaatttgcaatttcaaagcggattaactttatttcttgatttgaaaatttaaaaaaagaaaatttaaaaacgggagcgaattattgaggagggaatctgttaaaaagcaagca

SEQ ID NO: 29910 - DNA, 1475 bp, Heterodera glycines
cagaagagaaggctaaaaaggatgccgaggataaagctaagaaagacgcagaagagaaggctaaaaaggatgccgaggctaaagccaagaaagaagcagaagagaaggctaaaaaggatgccgaagctaaagccaagaaagacgcagaagagaaggctaaaaaggatgccgaggataaaaaagccaagaaagacgcagaagagaaggctaaaaaggatgccgaggctaaagccaagaaagacgcagaagagaaggctaaaaaggatgccgaggctaaagccaataaagacgcagaagagaaggctaaaaaggatgccgaggataaagctaagaaagacgcagaagagaaggctaaaaaggatgccgaggctaaagccaagaaagacacagaagagaaggctcagaaggatgccgaggctaaagccaagaaagacgcagaagagaaggctaatgccgaggctaaagccaagaaagacgcagaagagaaggctaaaaaggatgccgaggctaaagccaagaaagacgcagaagagaaggctaaaaaggatgccgaggctaaagccaagaaagacgcagaagcaaagaaaaaggaggaagaaatgaagaagcaaaaggctaagcccgaagaaaagcctgaggcacctgccgaaggcgtggccgtagtgccggaagcgaagaaggcggaagagacaaaggaaaagctgaagcaggaagagaaaccagtggaagtgccaccatctccagcagaaaagaagagaaaagaggctgaggagaagaaggctcagaaggatgccgaggctaaagccaagaaagacgcagaagagaaggctaaaaaggatgccgaggctaaagccaagaaagacgcagaagagaaggctaaaaaggatgccgaggctaaagccaataaagacgcagaagcaaagaaaaaggaggaagaaatgaagcaaaaggctaagcccgaagaaaagcctgaggcacctgccgaaggcgtggccgtagtgccggaagcgaagaaggcggaagagacaaaggaaaagctgaaacaggaagagaaaccaatggaagtgccacaatctccagcagaaaagaagagaaaagaggctgaggagaagaaggatcagaaggatgccgaggctaaagccaagaaagacgcagaagagaaggctcagaaggatgccgaggctaaagccaagaaagacgcagaagagaaggctaaaaaggatgccgaggctaaagccaagaaagacgcagaagagaaggctaaaaaggatgccgagactaaagcgaagaaagacgcagaagagaaggctaaaaaggatgccgaggctgaagccaagcaagacgcagaagcaaagaaaaatgagcaagaaatgaagaagcaaaaggctaagcccgaagaaaagcctgaggcacctgccgagggcgtagccgtagtgccggaagcgaagaagcggaagagacaaaggaaaagctga

SEQ ID NO: 29911 - DNA, 1007 bp, Heterodera glycines
agatagccatttttgggcaagatttttttcgttagcatttcaaatatcgtgtgagtgttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggaaaatgttggtaccaagtttgcggtcaaatccccaagagaaaaaagagacagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagcccagactagagaaggcaaatgttggtacca

SEQ ID NO: 29912 - DNA, 1095 bp, Heterodera glycines
  misc_feature (27)..(27): n is a, c, g, or t
  misc_feature (30)..(30): n is a, c, g, or t
  misc_feature (101)..(101): n is a, c, g, or t
aacacctgcgacccgttccttctgtcntcnttcgtgcgcggccctctcttcttcgtcttcgtcctcctccgacttctgcccattctctgttttctcttttnggtcgctgctccccaaaatgctttgagcatttcgctggccaaatgcattcttcgcgttaagcccaccatcagatacaaaaagaagtgattagaaaagataatgaaggccaaaagcaaaataattaaaaatgaaaagcccaaaaattatttagcgccaaaagcactccttcaaagagtttgccatcgtattactcgcacaattcgccgacaaagacaacctttggcgtcaaagagaatgtgccaatctcttccccgttgccttgcggcacacaaattccaccaaagactccgccgttgggttacatggatcacagaataaagtgggcacaaaatgatcgaaatttgtttggctaattaacttggtgccatttccctccagctataacaatgccgcctttttcgccgtctccggcgccaacgcaaattatgtgcagggcccaattgccagcgcgaccaatttgggcggcggaaggagttcacgcagctcagagatttccattaacaaattcggcggggaaaatttggcgacggtcgaccaaattaagcggcaaatgtcattttcccatctgtaggagaattaattgaccagatggacagcaaattattcactaattcaggggcagtacgcacacaacgaacagtttggtatccgaagtttaagccaatgacacaccaaaggaacgccaattgctttttgtccgttccctcaacatttttgaagcctttcttctcttaaatccttaccattctgccaaaaccaattcattaattaattacccctcttttacattccaagtcttttatttgttctttaatggtaattttcatctctgctgatcattggtcaatttaaattcaattagccattttaaaagtgcgtttttcctccccctcccccttcccattattttttgcccattttttcatttttgtttgttttgtcattttatttatgagattaaatatttgtacaaaatggcaaaagtgcacaaaa

SEQ ID NO: 29913 - DNA, 1398 bp, Heterodera glycines
tgctgtccctccgcttctcttaccgcctccactcgcctttctctccaatgagtcattgcgcgacaaaattcccgaggtgctcggatgtgccaatgctttgtgggtgtgccgttgcggctgatgcgtcgtttggcgtcgttgtccgtcaatggaagggtttgtgctgtgtccgtaacgtgaaaatgaatgacaccgggcgatgggcaacgctttgccgtggtttccggaggagaagggcgagtggggctgggaggagagggggtgctgatgttggagcagatggcgcgagaatgaacctggcaattttctctgttgaggttcaatttgccaatttatttctcttttctctttctctattttccattgtctctcatttgtctgtttctattttcgcatttataacaaatgacaaagaatggagaaaagtgagtgataacaacacacaaatattaagctgagatcacacacatagacagaagatgtaattgaggggatggaaatttgtaattattaattataaccaaattgtaaaatgatagaaaggataggaaggatgaaagaaataaaatacgtaatttgaaaaaggatgagaaagatggagaaagagtgggaggggggaggactggtgaattgttgaataagcaccaaaggtgtccggaaacagttaaattttgagatcagttaacggcagatcagactcagagaccggacggaccaatgaattcgcattttgcaaatgccccaaatttggcgaattatggcaccgatgaaaaaagagaaagaatgggggaaagaaaaacatctgctaatcggaaatacaaattgatctaatcgaaaggaatgataaaatgatatccccataatttatttgtcattcgttgagtagcgaccgattatcagctgatcattcgcttgtataaatgaatcacaaatatgtattagccttaaatataataattaacttttgagacgaattcccgtggagaacaaataaaaggaaaaggaaaaagaaagaatgtttattttggagaaaatggcacggggaaatgcaatgcagcgaattgagaagccacaattaaaatgagacgtgagatgaagcaaaagggcaaaacaaaatgagagggacgaagaaggaattgaaattggattttgatgagtctaacgacccctcgggcaaaatgaaaaaagcgataattaattggaaaatgaggaggtttaaacaaaacaaatgaaattttttctaaaagacgcggacggatgggcgggcggatgaggccgagtgaatggatttgacatgggattggaaattgggcagaaaggaaggggcgggggggggggagaaaccatctcttacattattgtgttgaggcggacgaggggggaggggcggaaggggag

SEQ ID NO: 29914 - DNA, 1271 bp, Heterodera glycines
ttcgggggaccgtgccgggtgccgcggggtaagcacctgttggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaattttttggataaaaattatttaaatgaactgactagataatatttaaaataggctatttctcttcccttcagtatccctgcaaagtttggtgcgcttctgatcaggttctgaaaaaaaagtaaagctaaactttttggcctgtttaaaaggaataaaaatttttaaaaatttattcatctcccttttttgtagaaagagcatcagagtggctaaactaccatgttaataaaatttgggtgcgtttcagaacccctttctgaaaaaaaatttaaaaattaattttgcaaaaaataaataaaa

SEQ ID NO: 29915 - DNA, 1104 bp, Heterodera glycines
gggcgaatattgaaaaattcatatctagcctaagggttgaccaattttgagcaaataaagctttaaaaatagagaaaaatcaggagaattttatgggatttatttaggttttctaacattaatatgaaaaaagttattccagaaattctggaaattttagatttttcagaaaaaaattcgtaactgccttctgaaaagctatttgagaaaagtaaaatactacaaaaatccgcaatttttttctctataatataaattttattttacatttttatcacatttttaaaaaaagatataaaaataaaagtgattttgagattcgggaccaaaggggggagcacatgatttttgagtggaaaattttttctcacaaaaatcttccaaaaatatgtctttaggggttatttgggccgctgatcacgaatacgtgatcagattttacttttgacatcgtcaagacctcagaatccctgtgtgattggggattctgagggggggggagggggcaggttcgaatccggacggtgtacattatttttctgtgcatttttacgttatttacagtgattttaattaatttaaaatattttgttgagttaataaataaaaaattatatttaaattaattttttttgatgaataaattttataagtttaaattaattatttttttaattgatagaatttcattatttttttaattaaatttgttaaaaaatattttcattttaatttaatgaatttactaatcactgttgtatcaatttatatttaaagatttgttgtaaattaataataaaagaatttatgtaaataataataattatcttttaataaagaatttcatattttttttaattgaatttataaaaattaatttcatattaatttaaatattcaattattgtacatttcaaaattctctttttaattaataaaaggaataattaatttattttttaaaatttataataaattgcattcaatttttgtacctcttctaatcaatcacagttgtacctcttctaatcacttttgtacctcttctaacaattttgtacctcttctgatcacagttgtacctcttttaatcaccagttgtac

SEQ ID NO: 29916 - DNA, 987 bp, Heterodera glycines
  misc_feature (917)..(917): n is a, c, g, or t
tttccgacaaaagaacaattttcgttaaaaattttgaattctttctcaaaaaattatttaaattatttattttcattctaattgcatttttatttaaatcatattacaaaaatctcattaatctctctcttgccgctttttaaataatttttttttgactattttttgattgattaattttatatttttttattttacaattgctgtcgacaattcaactattttccgcgtgtgcatttccttttcatttgcttgatagccaagtgcggaaagccctgaatacacaacgccaacgattttgccatttagcaaaagcgaattatcatcggccaatgaaaagctaaaaaaattattgttaaacaaaaaatttgtttataaaaaatcaatagcgctagaatttgtttttctctaatttagcatttaaattgaataaatatatttaattaatgttgatttttatattttttgcagattttaaaacctcaaaaatattcgtttattttttaaatttattttacttctcatatccttccaacagcggaacatattcaacgcgcaatttccccccagacaatcgctccaattcgtcctcaatgttgcgcaattcgtatttgtatttgttccattttgccgacaaaattacgaacaaagcgtcggaattgccaaaagattcccttaaattctcaaaatggaactgcgaaatttggaaatcacttaaaatattcaaagagcaataataatttttttagaaaaatgaaaataaactatcatttggctttggtttttcccaattattcaattaaaaaacccaaaaatgtgccctcaaaaatgatttttacatcgtttttatccatcctttcttcatttttaccatgccatgaacagtgagttgatcagattcgtatcgccctcatttntgtggtgcgtttgtcgggtccctgccaatgcgttttaaaagtcgctgaatgcaattcggtggtccgtcga

SEQ ID NO: 29917 - DNA, 1370 bp, Heterodera glycines
tttcgtttcgcactttcgatgattgactgatcacaaaatgcgctgccatttttctcttccaaaaatttcagaatttcgttcattttttccaacgatttattcgtctcattttcattggcacccttttcattttcaattcttgtcaacataatttcgatgacaaaagtgttgaactcttcacaaagtcccaaaattattcctcgaattttgggcatttcgtccagctgtttttcgctgttgcctttaagtccaaactgatcggtgcccttactcagctgtttacagaagccaatggcacggtgtgccgggagtgcaattcgccggttgaataccatttcaattgtatgtatcggctttccccaggcatggatgtgcgggtacggtactaaatttgcagccattaccgtgcctggggattttggcataaaattccattattctttcggccatttatttatttttcgaaggatttttttagacaaactgttattcaaatatttaatttgctcgcattaaattgttccccagattaaggctaattttttttggcataattatggaaaaatccttctcaaaattgggataaatggtcaatttatgtaattacccaatttataaaattggagaatattttgctcaaaatttgccaattctttttccaaattaattagttcgccgacgtcaactgttgatgagttttctgagaattaataaatagagaaagaataaaatagtttatatgcgttttgtttttcaagaaaaacacctcatttccaagaataaatgtcaaatttcttggtgtttaaggggcaacagaaatttggacagtaaagcgagggaaaggtgggaaaatagtgctcaggtgctcaggccggccgttgagaaaagcggtccgtccgtaccagggctgcggtgccgataagcgccgcctaggaaaaattttcagaaattttaacgaattttgttaaaaatagccaaattttttaggcatttcatcttttccccttcgctagcctcccgcccccttttatgtatgttaataatactacaaatttccaagaataagtcagatgaaatcgaaatatgggtagcagccttttaataaaaaagaaaaaaaaattcattttataaaaaataatcttacaagaaatcgtctcgaaaaataatccaatagtcaaattacggatcaaaattgcggataagtcccaaaaatccgcaacccgcaatccgcaattacgggggtccaaaaaccccgcaatttccgtaatccgcaattgcgtccagccctgtttccaacccaaaccaattgcccatccctctgaagggtaaaagacgtatgaatttagataatggaaaaaggcggacagatt

SEQ ID NO: 29918 - DNA, 979 bp, Heterodera glycines
tatggggtctaatgagcgggcactttggcaccttaactccacgtttggttcatcccacatcgccagttctgcttaccaaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcagcccaacgtacagcaacaaacgggtgaatgcagacaagagacgccagctctgtccgtttccacctcatcggttca

SEQ ID NO: 29919 - DNA, 1958 bp, Heterodera glycines
ttaccgtatttgctctttttatatgccagtctccattaatctgccggtctccaattatataccccctttgaactaggttgaaaaataatctcccagtctccatttatgtgccgggggggataaatagaattttttaataatttatttggccggcttcttcgtgatcgtttcgtccatctttaaccgtttcagttgccctaaactcgcgcaaaaaagcccagaaggctgtttctatgcctcaaaacataaaaaattacaaaaaaaaacttcattttgatcacgttaaaaatttcgacattttgaccgacttgtcgacattttgtcccactactcccaaacattgttagacctgtcaaaacattgtttaacccatttaaaaacaaatatcaagctctacgcactcaattacccccaaaatcccccacttactgcgaaaagccgacttttttgaccaaatttttagacaaatgaccaactcaactttgggctagggactcaaattttttaaaagaatcgcctcaaaatgctctaaccaaaaaccacctcgcccattacccacggcaacttaaaagccgctacgggcgcaaaaaaaagatgcaactctaaaaaaattcggaaaaattccctttttgaccagtttttcggacaaatgacctacttaactttgagctaggggtccaaaatttttttttaaatgtgactaggtgagctctacaataatatacaatagcgcctgagctaacatttcgctaaagcacacccgcccgagtctaactttttgagaccccttcctggccaggggctaaaggggggtccaccccttcaacttagtgctggcgcacaatttttttttttaaagaccaaaacgattccatattttcttaacttttcattaaaaattccaattttttatgcataccggaagcaagaaaattacatatttttgccattttggggtcattttcagaagttctttaacaaaaaattcaatagaaaaaattttttttttgacgagatgacattttttggcgacatgttcaacatattcaaaaaattttccactaaataaatcaaccgaaaaataatctcccagtctccattagtctgccagtctccaattatatacccccttctgagaaggtgaaaaataatataccatggtatataaaaagagcaaatacggtatttcatgaaaaagtgttgggtggagaactaggtaagttggaaagtgaaaatcgaaaattttagttttcgaatttgttcgaattcggacccaaggttctgaattggtcgaaatggatgcccgattcctgatcaacgaccccgaattgctgcctgctgtaaatcggacatttgcgttccgaactttagcatagagcccggaaatttcaaatttacggatcctgttgcaggattggaattcaaaaatttttgcaggaccggatccggccggattaatcctgcaaatcctgcaatcaggattgcgtactgggatcctgcaaaatcctgcgcaggatccggtcctgctccgggctctactttagcagcccaagcaaaatcggaatagcagccagcggaacgccaaattatcattctttttcaaatcaaatcctgtaaattttaataaccaataaattctgtaataaaaaaggagtgattgggcgccgcttatacaaagtttgataaagaatttgttccactttcgtaattaaatgagaatgcgtggcttatgggttaaatttcaaaagccgcttttcgcaaagaaatcgatgaaacggtcatcgatttggacatttttgaatggccattagcgcagccgagctgaggatcgatctgttgaagtgtatgcagcagctcttctgtttcattaccaaccacattgcgatactctgatcattcccgattttaaagccaccaattttttttgtctaatttttagaatttataaaaattattta

SEQ ID NO: 29920 - DNA, 1370 bp, Heterodera glycines
gaagaggtacaaatttgataaaagaggtacaaaagtgattagaagaggtgcaacagtgattagaagaggtgcaacagagattgaagaggtgcaacagtgattagaataggtgcaacagagattgaagaggtacaaatttgatgaagaggtacaaaagtgataaagaggtacaaaagtgattagaagaggtgcaacagtgattagaagaggtgcaacagagattgaagaggtgcaacagtgattaaagaggtacaatcatggtttaaaatgaaataaataagaaaaatgtattattggatgtattataaatttatcaaattaaaaaaatccttttacttattaaaaataaagttagaaatttataataaagaatatttattgaaattgaaaggaattaatttctcgaaaattcaaattaaataaaacatttattcatcagaaataatttaaaataattaataaaacaaaattaaattaaataaaaaattaaataatttaaattaaaacatttgttcaccaaaataatttaatttaaattaaaatttaaattaaaaatttttatttattattaataatacaaaacaaattaattaaaaaatgtaaaagtaatcaaaaaatgcacagaaaaataatgtacaccgcccggatccgaacctgcccccccccctcagaacatgtcccagaatccccaatcacacagggattctgaggtcttaacgatgtcaaaagtaaaatctgatcacgtattcgtgatcagcggcccaaataacccctaaagacatatttttggaagatttttgtgagaaaaatttttccactcaaaaatcctggtcacccccctttggtcccgaaccccaaaatcacttttatttttgtatctttttttaaaaatatgataaaaatgtgaaacaaaatttatttggtagagcaaaaaattgcgcatttttgtattattttactcttccctaatgacttttcagaaccgaggtataaatttttttctgaaaaatcgaaaatttccagaaattctggaataactttttttcttttgaagctagaaatcccaaataaatcccataaaattctcctcatttttctccatttttaatgctttattcattcaaaattggtcaaaccttaggccagatatgaattttcaaattttagcccaaattcccgatggccaaaaaattggaaaatattttcgaaattttaaaaaattccaaaaattttgaaacgaaaaataaacatcatattcgtgctcagcacctcaaaataccccagaaaaatatttttgacctcctttttcaacccaaaaaaaattttttgaaaaattttctaggggggcctagctcaaaaaattttgaaaa

SEQ ID NO: 29921 - DNA, 1087 bp, Heterodera glycines
ttaatagatattcagaaaaatggctatctcttttttgagaattttctatgcaacaaacgctctcgaacatgaaacgaagtgcggtgcgccatggccattttatttttcaaataatttttatatttaatagatattccagaaaaatggctatctctttttttgagaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaagctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaagctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaatatctatgcaacaaacgctctcgaacatgaaacgaagtgcg

SEQ ID NO: 29922 - DNA, 1125 bp, Heterodera glycines
  misc_feature (1071)..(1071): n is a, c, g, or t
aaatggcgattgtgcacagccctccgtctctacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtaaattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaaagagatagacatttttctgggatagagtataaatttaaaaattccctcaaaaataaaaggtctattgcgcaccgccctccctatcatgctcgagagcatttgtatgtgtataanatttatcaaaaaaagagatagccatttttctgggatacctctaatataaaaatc

SEQ ID NO: 29923 - DNA, 1248 bp, Heterodera glycines
tttattatttatttaggaatcagaatgccaaaacttccccccacttaaaatttattggggattttcccttgataaaatcgaaaagccgatctcgagttaaaaactagacagctaaaaaataaactgtgattcgatagagggggtcaaactatgggcctatgcaaaatttgaacatagggaaaaatttttcaactgggcaaagttttttctttttcactcattttgacgcactatttccatgtctctaacatataagataacacatggttcatttttttgccaataaacaatttttttaatttttatttaactttgaaatattcttcagaattttcccttcaaaatgagcacaaaatggttttatttggtctattattgacaaagttataagctaaaaaaaattcataaaatcaagggtaaaataaaatgtttaccttttattgtttgtatttgttcttttggcgttctgtttttattatttttttatttatttgctttaaaaaaatgaaatttatacacaaacacaaagaggatttgaacctgagacccactttttggtgactaactcacagaccactaagacgaaaaaaccaacttaattgtacttggagcccaaaattgactcgccgtgagtattaatgagttcctgtttgattccgcgtatttagccagttttaaactaaaaatgcaaagttcaaaataattcaggtccggggttcgaaattggtcgaaatagatgccggattcgtgatcagcgatcccgaaaaccctaggaaacttgcgcttgcatgtgttttgaaaaaaaaaaatttcaaaaaaggtgggtaccatcgacagtattaccaaaacgaaaaattcacccctaagaatcgaatcgaaatgtatataattttgttgttcccctttcattcttttatgtgaggttttcggttgttcttcgatgcctcttcacattccgttttaaaataacatccagcggatggttgtgctgttgactcccgttgcaactcgcgctgtttggcactgtcggtgttctgtcggcatttttatgatctttggaatatgtctgctgttgccgggcacactccgccgtgtcttggcgaaaaactcgatattttacccttaagttcccctccatgggttggtcattgttctgccatttcatttgtgtttggttcctttcttcattaattgcttggtcaatgagttggactttctcttttctctcggcgcccaatggcgccccat

SEQ ID NO: 29924 - DNA, 514 bp, Heterodera glycines
ctggcagttttaacaaacgcgctggcagttttaacaacgcgctggcagttttaacaaacgcgctggcagttttaacaaacgcgcatgggtggcagttttaacaaacgcgcatgggtggcagttttaacaaacgcgctggcagttttaacaaacgcgctggcagttttgacaaacgcgcatgggtggcagttttaacaaacgcgctggcagttttaacaaacgcgctggcagttttaacaaacgcgctggcagttttaacaaacgcgctggcagttttaacaaacgcgctggcagttttaacaaacgcgtatgggtggcagttttaacaaacgcgcatgggtggcagttttaacaaacgcgctggcagttttaacaaacgcgctaacagttttaacaaacgcgcattggtggcagttttaacagacgcgcattggtggcagttttaacaaacgcgcattggtggcagttttaacaaacgcgctggcagttttaacaaacgcgtatgggtggcagt

SEQ ID NO: 29925 - DNA, 1353 bp, Heterodera glycines
aatccggaattccggaatttagaaaaaaaaagttttcccgaaattaaatttttaaaatatataactatttttgagggactttgtggtatttaaataattaaatggaatttttaaatagattttttgtacgaaagattagttttttaaatcaaaacataaaatcctgtttttttttttgagttttcatattttttctaattttagaaagggtgaaaaatacagtttggaaaaagggcatgccgaacttttgttccaattcaaatggtccaataatgatgatggttcagcagaggagaaattcgtgttggacttgaccccaacacagttaaaagatggcaaattggagttcacaattgacagcaaaggcattgagctgaagaggacttggtaaatgatgaaaaaaataataaaagaataattaataatttgaaaataaattaataaaattatatacattaataatgataggattttttttatttaaatatttatttttttgatttaatttctgacatttattcgtaaattatttaattaaatattcggctttttcataaatatcatttaccataccgattaattaatattattatgaataaatcattgtccaattgaatagagacggacgataaattaaattatattttttataacaaatttttatttcgtataatatttattagattcaattaagattaatgaattaatatagatagattaaaaaattttcccaccaattataacattaaaatggcgcaatttaagaaagtgacatattttaaattttatcaaaaaataaaaacaaaaggggcccttttggtttacaaaatttctttaatgtatagtatattcatgaaaatttatgcaccgagcgtttttggggtccattccgatttcctaacttaaatttgaacaaaaaactataaatcataaatcgaaaaattcaaattttcggtttttgttcaaattcggcttagggattaggaattggtcaaaatagaagtctgattcgggatcagagcaacccctaaaaccgcggagagcaaatttttattactaaaattttttgaaaaacaaaaagccacccactttactttttgacaaaattcaaaatctatcattttttaaatagcgccaaaattttaaccaatttgaaaaattcatttttaatataatattttccataacaaattattatttcgtattattatcgatttaatatagagaacaaatttttccaccatttatttaaaaatctgtcactttttaaatagcacccaaagttgtatcaattttaaaatttgaaaaattccattttttatttgtttttagggtaaaaccaacaaacgtctg

SEQ ID NO: 29926 - DNA, 1396 bp, Heterodera glycines
ccctttcctaatttttgccgttcaaaaatttcacaccctttttatggacgacgcttcacactgttgaccgatcatacgccgctcatcgccatttttggttcgaagaatgggatcccaatctacgcggcgtctcgacttcaaagatgggctctcattttggctaattatgattttgaaataaaatatatctcaacgaattgttttgggcaggtagacgttctctcgcggcttgcggcaaaacaacgcgagacagtagaggcggaagaacgagttattgtcagcctcgacaaaatttcacttccaatttcggataactcagcgctcgatgaatccgaaatggccgctgtcgactacatcttcatggccaacatcgaccagctgccagtcaccgcgaatgaagtcgccgaacacactcaattggacacaacgcttaggaaagttttgacttttgccgtaatggatggcccaagaaatcgcctagtgatttgtctgcctttttcactcataggcacaaactttccgaagtgaatggttgcctccttttcggggaacgcgtcgtcattccgggagctttgcgtcagcgaattttgtccgctcttcatttcacacaccctggaatcgtgcgcatgagggcattggcacaacaacatgtctactggccccgcatggaccttgacattgaacgttgggttcgccactgcgttgattgcgcgatggcagcaaaagcaccaccaaaaacaacactctctccatggcctcgaacaaacaaagtctataagcgcattcacatggactttgcaggcccatgttctgatggcaatctctatctcatcatcgtggacgcattcagtaaatggcccgagacttttcaagtgaaaagcacttctgcggacaatgtcatcgttcaactcgagtggctcttttcgcgatacggttttccacgtgaaatcgttaccgacaatgggtcaccctttcattcaaaagatttttctcatttttgcaggattaaagggatcaagcaaagatttagtccgccgaatcacccacagagcaatgggcaagccgagcgttttgttgacatttttaaaaggcaaatgaaaaagtgttcacacggagacaaaaagtggatcaccaattccccgttcgcctaccgcaacacaccaaatgccgcactgaaaggtcaaacaccagctgaactttttcttggccgctctcctcgaacacaactgtcactgctcaagcctgacatttcttgctcaaatcgcaatcaaaatgactacacaaacaacatgtcgaagcaattcgatcgcaaacatggtgctcgccaccgaacatttgcaattggtgacgatgtgctcatcatcaactaccgtaacaacaaaaagtcttggataca

SEQ ID NO: 29927 - DNA, 1163 bp, Heterodera glycines
  misc_feature (21)..(21): n is a, c, g, or t
  misc_feature (660)..(660): n is a, c, g, or t
cgctgacgccacacaaactcntggaaagtaagtagtcctttttccaatccctgtttcctgctccacatcatcaagagtcccatatttacggccccacagataagacagttcaaaaatacgtttaggagacagtttgaaacctaagtcaataatgcccaatgcctttaagcctaataaaccttcaaaatatgtgccgacaagaaaaccggttgacttgcgacaattctttgtcgtacagcgccatacaccgtaacggcgatcgccaattgccctaatcgatgtgtttccgccgcatcgtggacacgttcgacgtgcgtggagaagacccatattttcgagccactgatcaaactcattgtcctccattgctaatttttcgtgcagttttttcaacgaaaatccacggagttcttctagcgcagccatttaatgtgacaaaggaaattgggcgaaaaagtcaaaaaaaaatttttattgaaaattagaaatttaaaaaatgttcgaattcgggttcggggttcgaaattgggcggaatggatgtcagaatcgtgatcagcgacctcgaaaacacctagaaacttgttttgaacgaattttaaattttgaaaatttccgccaaaaaatggggggctaccatcttaactattacccggcatatntcagtaaaggtctatcaaaaattaaaaagaaaaaataacaaaaaaaagaaaaaaaatatttgcaagaaccttcattttgtcgatgatttttcatcaaggtccataaaaaatcatttcagccgcgggtttgaaccccagcccccgtctcatacataggacccctagggattaataattaaatttcaaaaaatcataaaaaactaagtattgacttctcaatagatcaatagctcattcaaagctctttttaagctctacaacatctgtgtatgacagggctcccatccgtccttgaatggcaaggacgtccttgaaattgggccctctttcttgaaaataaaaaatgtccttgtatgcaaggacgtccttgaaaatgagcatttggaaaagttttaaaaaaatcaaagaaatttgagaaatctttgtaattttcaacaatattttgattaaatcgcaaattttggacatttttggacaaaaatctgtaaacaactcgcattaaa

SEQ ID NO: 29928 - DNA, 726 bp, Heterodera glycines
cagcatttttagggcaaggtggggggtggtttctctgtctttctagccggagtaaaatagaaaaatgaatggaattttttcttagcttttgcccttaaattactagattttaaaaaccgaaaagaaatttgtaggaattctattttacgaaatgcccattgcaggaactgcctgccacgagacgcatctccctcatcccattttcattcactctttcccccccccccaaccaatttgcataattctctcctcccctcttctccctctcatcccatctcccaaaaatccaaccacttcgtggtgcgcccacaccgccagcttcacataatccttagcattccgaaatcgatcattcagatcattaataaaagccattagttgaccgcgaaccaatgggcccggcaccatctcaaaaccgccgattattgttcccggcgtcacttcaaagccgccgacgaacatctgaccctcctcgcggatcttgcccgcctctgcttggttttgaccccacagaaatttatggttgaacatcctgagcaccttcaaaaaatccgacagcgtaaaaagacaccgataaatcctttccctcacatttgccatcattttattcccctcttttcactgggtcaacggcagtgaatagcaattcgtataaatttcttttatatttttcaattaagatagacttttttaattgaaatcaatgaatttgtttttcactaaaaa

SEQ ID NO: 29929 - DNA, 1409 bp, Heterodera glycines
acgaattaaatcggaagaaaacactgtcaactaattaatttaattcaataccctaaatttttttggtgtctttattttcattccgtaattaatgtccataagtccctcgaataattaactaattgtccgttgtttttcagtccttttcttcgtggaatttttgcgcgcaattggctcgcatttgtctatttgttcaccaaatttctgtatttaatcgccaacattgttcaggtgagaacactcattttggcattttcacactgaaaatgccatcaattaattgcttgttaatataaaattcgtttagttcaaattcatcagcatgtttttgggtgtcgacaaattgcccaattggggatggacggtgagtgttcgcaattgatggcatttgaaactaattaatgggaacgcatttttggatttattctgtttcccattaactttgaattactctctaaataacctaaatgttgttttgagttattttcgaattttagatcctaaaaatcccgtccctaatcatcataagtcctttgaatctttgttccgtgtggggcataatttaaaaaatattttttaaatttaatttttaatatttattttttgttttgattttagtcccgtgaaatttttgttttttatgggaaatatttgtcaaaatgcttttcttaaagatgctgaacagcttcctaactcatggctcttcttgggagcacagtgggcactttcctcgcgtcactctttgcgacctgaaggtaaaatttcctaatttgagcaccattactaataaatttccgaattattctgagtgccaattaacttcatttttccgaatatttaataaatgggaattaatttaccaaaagttatcaactaataagattttttcgaaccgttcagatccgtcaaccaaacgaacgctttcacgagttcactgtccaatgtgtgctggtggcgaattttgtcagttaaatgcacttgaaatatgggtcaatttagtctggtagttttaagtctgctggaatgcctcaaaacgatcttttttttaattttaaggccgtaactgtttgtaaatttacaaattataaattaatgggcatgtttcgaggtagaaacattaataaaaaaaattgatgccctcgaatcggactaaaattgccatactgaactggcatgaatataaatgtgagggacccacgcgtttcggcgctcccgtttcggcgctcccgtttcggcgccagctcgtttttccacttaagcttttttctttggcatctaaatctaacaatctttgtatcattcgaaagctcttaacatgctctattagccttataaaaaacgaaaagtttttcaagcctgtaaaaattttaaagagaaaaaacttcaaaaatttcgacttttcgcaattt

SEQ ID NO: 29930 - DNA, 925 bp, Heterodera glycines
gggcattttggatgggatatggccggattggacacccaaagcaaaaaaaaaaagagcattttggatgggatatggcacggattggacacccaaagcaaaaaaaaagggcatttcggatgggatatggcacggattggacacccaaagcaaaaaaaaaggcattttgagaaggggggactgaaattggatgataatagtcaatctacattctcatccaaacttagcagaccggtcaacttctggcctcgtttggcataccgttgtacgagccgtatgagctgtaccagcgccttcaaagcgcacttcagcagcactctttgcccacagcaatgccccaaaagtatggcaatttaattatttgtcaaatcatcatttatccgtggcattaaattatggccatagtcagagacagacattcctctccctccccttcttcccccattcttcctcaattcatccctcctcccctccctactcccgtattcttcttcaattcactccccctccctccccatttcctccccccggggttttttctctggcagccgatgtctccgtctgcagacaaacggactctttggtcacaaatcccttcccccattaatgatgagatgattacgctgctgctgatgatgatggataagatgtctcctgagatttgtttcgatggtcctttgggggagtgattaatttgtatttgtggaggaatttgccttttttttgttgaccaactgacagccgaacagcccaaaacattcagtcgctgttttattgccagtcgccccacacaaattttcggatggattcgccgttttagtggggcaccattcaaaaaaactaatgggacataaagcgaaggaaagggaaatgaatgtcgagagtcgagacttttggtcgaaggagacgaaggaccaaacaaccaaag

SEQ ID NO: 29931 - DNA, 660 bp, Heterodera glycines
  misc_feature (624)..(624): n is a, c, g, or t
  misc_feature (649)..(649): n is a, c, g, or t
tcgacgaaaagcaatgtgtcagggaattatttaaatgatctaaaaatggtaaaagcggacaatgaaaggcattcgcgacaattacaaatggcaaaaaatgtgcaaaagttagactcactaaatggaagaaaatcaaagggaattgaaataaaagagccgacacaaaaagtgccaaaagtggagaaaaatgacgagggaattgaggcgaagggcaaggaaattgtggaagaaaaaacgaagaaaacgaagccgaaaaagaaaaaaggggatggaaaaagtcgaaagtcgaaggacacttctgttgataaacataaagcagaaggggaaggaatggacgaaatttgggctaagataaaatcagatcaaaaacaggaggaggaggaggaggaggggaaaggaacggacaaaaaggacggaaaggaagaagtattggaagaggaggaggaggggagtggatcggcaatgttgcgcgaactcagacaaaaaaggggaaaactgaagaaggtatcgccgaaaaagccaaacaaaaatgagcaaacgatcaccgaaccgatcattttggaagagaaaaaggagcaaaaaacggagaataaaattggcaaaacggaaagccaaacattgaanagcgacgagaaagcaaccgacggancaaaaactgct

SEQ ID NO: 29932 - DNA, 1478 bp, Heterodera glycines
gacagtccctctcataattgaattcagactcgaggcgcctccctcacaattcatttgacgacccattgtcatccgaacgcaaagcggaaacactgagagcaatttgtcttggagaagggcgagagtcttctgctcgttctgttcgctggcggggagagcattcattacgaaaacgccttaagggattagcaaatttgaaggcaccaacacaaatatcgtggattgattggcaaaccctgtggtcgaagtgcgcttttggcatttccgagcattttcaaagcgatgaatggcgaggctgggcacggaatgtgaggggacgagtcgcacgcgtccaaaatgatcgcgtcgaagcgattgcctcaatttccagcgaattttttcaaaatttaatagtgaattatcggcggagttttggggtgcaccgacgtggctacaaaaaggtcataggactgacttttaacgccagaaaaatcaaagatatgacgtcaatgttaggcttatatcggatttaatacacggcttgggatggtggcgaattctccgcttttctgtgggtcacttttctgcagttcttctaccactcaccccttttgacgtgatcggaaattgcggccgctccgtctccgaccaccgttctccgcgtctgatcgtccgaaacttcgaaccattgtttggccaattcgaccacaactgagtcactctcgtagacagtgatgttgagctgaacaaagcaagttccccaaaattcctcccaattccgtcgttggcaccgatggaattttgaggtgaaggaatgcgtccaacgacccaccgccgagtccgacgatcgcaacgtcccccaatctctggccatcggtgggcgaaaggccaagcgaagccaccgaaaaaggcagcactgccattgccgccacatattcgttgagcaaagtgccgtggtcaacgtgccataaacgcgtgtccgagtcatcgaccgttgcgtctaaaaatgcaaaaagcagcggggaaacgcttctcctttctgggttaaaatggcactttgcggacgaatgagcggaacctctgattcgaaactgtcggagagtccgtcgaaaaacatcgcacgacgggcggaattgctaaattcatcaaatgttcagccgatggcggctgctaaccttctcctggaaattatgtccaccaccgtgcggcaattgcctccgttgccgcacattcgcgcgacttcgacgaagcgaaaattggactcgttggaagggacatcagcgaaagaacggtcgaccattggccatgggatgagcagaaggacagcctaaagagcagaaggaggagagagtgggcacaacgaaagcgaaggaataaagagaattattagagctatcgaatgatactaagattttcggtaatagtaaagtttaccccccccctttttcgaaaacctttttttgttttcaaaagtcatgaaaacatgtttccatgggttt

SEQ ID NO: 29933 - DNA, 998 bp, Heterodera glycines
ctcattagcccgcctcattactagaggttaagctttacggtgtatgatcggactcatgttagccatcccccgccttaattcaagaaaaagtttaaagtattgaaaaatatttagtgaaattaacgcctgcttcatcaatgttcagaacattttttcgagactttatttgaaaaactcattgcaaaagcaacttgggactcatttattcgacaaaatttcccagagacattacgccagtgagactcaaattaccaaactcattgcaaaagcaaacgggactcatttttatgttcccaaatatcccgcactgttttttgctgctgctgctgttgctcatttggcgccgttgccgccggctgaacagctggtggttgcgcgactgcaactgagtctcgtctgtctccgcccgtgtccagcacagtgccggtgccaatgtcaatggacaccggcgttcgcttcggcacttcctgctggtgctgaaccggaccggtatgcgtgagggctggcggcggtgggagcagcgtttggcgttgtgcaaccgggactttttgaaaatttttcaaaaatacttagtacaaatttttttttgtaccctggatgggctggtggtgacgtgtcagtatgggcgcctgttggacctcggcgctcagctggggttcgtcctcaacagccggaatgtcacgcggacaataatccacctacgatgatgtatgtgtgcccgtaattgtgcaaaaatgttatacggtagtgtgagacaaaaatgggggaggaacaccgaatggatttgggataaattagcacgaaaagtggtggacaattcaacgcaaggataattgggtactgaaaaatttttttgtcccaagttggaatttttaattttcatgaaattttccagcgctcattcggatttcggacctttataattatgtataaaattttgaatggctaagcattttttttatttagccaccaggctttgctgctgttatgtctcggca

SEQ ID NO: 29934 - DNA, 1016 bp, Heterodera glycines
  misc_feature (918)..(918): n is a, c, g, or t
aaaggaatcgggagcacataaattgtctaagtaacttcttattctggtggtctcgaaaaattaaattctttgaattttcggaataatttccgatttggggcactactccaatttttgtgctcataattgcaaaggtaaaatgaagagtaaggagtataaatgagattacaaaaggaatcgggagcacataaattgtctaagtaactttttattctggtgtctcgaaaaattaaattctttgaattttcggaataatttccgatttggggcacttctccaatttttgtgctcataattgcaaagggaaaatgaagaatacggagtataaatgagattacaaaaggaatcgggagcacataaattgtctaagtaactttttattctggtgtctcgaaaaattaaattctttgaattttgggaataatttccgatttggggcacttctccaatttttgtgctcataattgcaaagggaaaatgaagaatacggagtataaatgagattacaaaaggaatcgggagcacataaattgtctaagtaactttttattctggtggtcccgaaaaattaaattctttgaattttgggaataatttccgatttggggcacttctccaatttatgtgctcataattgcaaagggacaatgaagaataaggagtataaatgagattacaaaaggaatcgggagcacataaattgtctaagtaactttttattctggtgtctcgaaaaattaaattctttgaattttcggaataatttccgatttggggcacttctccaatttttgtgctcataattgcaaagggaaaatgaagaatacggagtataaatgagattacaaaaggaatcgggagcacataaattgtctaagtaactttttattctggtgtctcgaaaaattaaattctttngattttgggaataatttttcgattggggcacttctccaatttttgtgctcataattgcaaagggaaaatgaagaatacggagtataaatgagattaca

SEQ ID NO: 29935 - DNA, 958 bp, Heterodera glycines
taagcttttttcttcttttttatttttattttctaagaaaaagaatttatttttgttaaaatttatctgctaacattcattacatacaggaccagaaactcaaaatttctgggctcaaaaaagaaacacatattgataaacagtaaaaaatttttttctaaattttagacatgggtaattccggtttcaatgcctcaggcgtttactgtgtacttccaaactcagattttcggggccggagaatccgattcctataccttcaaaatgatgaaatcatttcttaacaaaaatttagggcgtttcggaaaattaagaatttccatgtgtttccggggttactgaatattcatttgtcgaaacgtcaaacgaatccaaacgaacccgtgaagccaaaaatttgtgcattgccaaaatttaaaaatgcaaaaagcaaaaagaagcacacgagcacaagcagcagcacatgatgaaacggcattttgtacgagtcgaggatttgaagaaagtattaattttaatacttaaaacaatgaattaatattgaaaataaataattatttggctttctttgcttggctttaattcgggtttgtgtatttgaattttgcttcttgctttcctcctttttgagggttctgctgtgctgaaaactgccggtaaaatttatttattttttcaaatacacaaatcgtagaaatagcgcaaatgggagccctcaatagaatgtgttttcactcaaattgggccatgattgctcttgagagacgcaaaattttcctaatttgtttgttattcagcaacctttttgaggtggttattttctccaatatatttactgttttaggatggtccttaccaaaacaaagacctaattaatgtgtcaaagtgtccgttggtgatgaaagtgctaccgacttttactaattagtattttcccaataggaaaagtgattgattt

SEQ ID NO: 29936 - DNA, 930 bp, Heterodera glycines
ctttaattctgcgttggatttttgctccccataattgctttagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacagacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggaagtccccccgaaccgatgcg

SEQ ID NO: 29937 - DNA, 977 bp, Heterodera glycines
  misc_feature (906)..(907): n is a, c, g, or t
  misc_feature (915)..(915): n is a, c, g, or t
gcagtgggcaagcgcagagagtcgcttatatacacaccctttgagacgtaaaatatatcataaaaaaagagatagtgattttttttggattagaccggacaaataaaaattaccagctattttaaatgcagtgggcaagcacagcgagtcgcttaaatgcacaccctttgacacgtaaaatattccaaaaaaaagagatagtgattttttctggattaggccggagaaataaaaattaccagctatttgaaatgcagtgggcaagcacagcgagtcgcttaaatgccccccctttgacacgtaaaatattccaaaaaaaaaagagatagtgattttttttggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccacctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaatattaccagctatttgaaatgcagtgggcaacttcatgggagacnncttaaatncacaccataaaaaacataccacgtgggggaaaagagatagtgatttttctaattagaccgga

SEQ ID NO: 29938 - DNA, 891 bp, Heterodera glycines
aaattttttccattacggcaagagttgcgggaatgtgaattaattctcagaaaaatggatatttctttttaggacattttctatctcgtaaccccgatgttaatccgttccacagagactcttcaaaatttttcattaccgcaagagctgcggaaattgtgaattaattctcagaaaaatggctatctctttttaggacaattttctatctcgtcacctcgatgctaatccgtaccgcagagcctcttcaatattctttccattaccctaagagctgcggaaattgcgaattaattatcagaaaaatcgctatctctttttaggacaattgtctatctcctaaccctgatgctaatccgttccgcagaccctctccaaaactttttccattaccgcaagagttccggtaatcgtgaacttattctcagaaacacgactatctcttctagcgacaatcttctatcttgtaccgctgatgctcatccttaccgccgagcatatacagaatccatccatccctaaacggctatagggatggtacccatccctataccaacggctatagggatggtaccatccctataccaacggctatagggatggtacccatccctatatcaacggctatagggatggtacccatccccttctcgggccaaggacctgccccagcgggggattgtggttaacctgccaagaacctgccccagcgggggattgtgttcaccggccaaggacctgccccagcgggggatcatgtgtccattcaacaaaagtgttatgcacaatatgatgttaatgcttaacagtataattttttgatgatgtgcatattagggcacttccggtttccattgcagcataatgcaatgtgtcagcttctggaaagaa

SEQ ID NO: 29939 - DNA, 1145 bp, Heterodera glycines
ccattaaattgacaaaacacaattaagctatagattaaatcaggttttgatcaaaagtctggaaaagcataaacccttggctctaaaatataacattccgtaataacgtgcacatattcgattattgcttaaagaattgaattgtgatcatggttcagaaatattttttaaattttttttttactctgtccatctttgtttgcgattttgatcgaaaccggttgatcatcatcttgataaaacacgattaaattgtgtcggtatcatttttaatctacggtttctttcgattttcacggtatattaaaaagttacagctaattactgggttcgatttttctaggcaattgttttttttcaattttatttattattttttaatttaatttcagcagcaaagcaacttcaattctcgccaaaactccatccacagcactcaaagagcgcgtgtttgcattgaacgaggtgctaaatcattcaactttttgaattttttttgtttgtgtattaaaaattctgtagcttgcgaatcaattcctgtatactagtgactggtgtactgtatccacttttttaatttgtcaccttcattttggttatttgtatatattcaattagcatttttatttaccatagttatttttaaaaaaatactatatcttgttaattaattatttttttcctaaaatttcgcattttgaattttttttttcttgtcgggtttggtccaaattaacacaatgttattcaatttaccatctttgtgctagcttattgtttcggtttttgcaaaatgttatgccattcatctttttttgctattaagccgtaatttcaaagcaatttatccactgattagctttctgtattcacttttctatgccataaattttgcacaatttcttaggtttggccatcgcttcattcagcagccaaaaagcggcaagaaaaattggaccgggtgaagcgagcggcggacgaacttgtggaagcggaacaaagcgtcaaaagcgaactgaacaaattgcgcgaagaaacaaaattggtgaggaaaagcggcggggaggggggggggggggggcggagaagaagcaaggcttaaagcacacgttgggataaacaacaaaaagcaaacacaaaggggt

SEQ ID NO: 29940 - DNA, 1119 bp, Heterodera glycines
cagtcccccttgaaccgattcgcccagatttatggggagaccgaatccttcgggaatagctccgctatagtctgtactttaattctgcgttggatttttgctccccataaatgtttgagtaccccaaacggacacttgaaaaaatcgatttttttgttttcggggcagtccccctgaaccgatgcgcccagatttatggggagaccgaatccttccggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatatttgctccccataattgtttgagtaccccaaacggacacttgaaaaaatcgatctttttgtcttgggagtagtccccccggagccgatgcgcccagatttatggggagaccgaatacttccggaatagcttccctatagcctgtactttaatcgtgcgtgggatatttgctccccataaattgtttgagtaaccccaaaagga

SEQ ID NO: 29941 - DNA, 1136 bp, Heterodera glycines
cgctttctctttctgttcctcttccgctttatgttcctcttgcactttccctttcactttctcttccactttctgttcctcttccactgtccctttcactttctcttccactttctgttccgctttctctttctgttcctcttccactttgtgttcctcttccagtttctctttcactttctgtttctcttccactttctgatcctcttccactttctcttccactttctgttcctcttccactttctcttccactttctgttcctcttccactttctcttccactttctgttccattttctattcctcttccactttctgttcctcttccactttctcttccactttctgttcctcttccactttctcttccactttctgttcctcttccactttctcttccactttctgttccattttctattcctcttccactttctgttcctcttccactttctcttccactttctgttcctcttccactttctcttccactttctgttcctcttccactttctcttccactttctcttccactttcactttctcttccactttctgttcctcttccactttctcttccactttctgttcctcttccactttctcttccactttcactttctcttccactttctgttcctcttccactttctgttcctcttccactttctcttccactttctgttcctcttccactttctcttccattttctgttccactttctatttctcttccactttctgttcctcttccactttccctttcactttcttttcctcttccactttctgatcctcttccactttctcttccactttctgttcctcttccactttctcttccactttctcttccactttcactttctcttccactttctgttcctcttccactttctctttcactttctcttccactttctgttcctcttccactttctcttccactttctcttccactttctgttcctcttccactttctcttccattttctgttccactttctatttctcttccactttctgttcctcttccactttccctttcactttcttttcctcttccactttctgatcctcttccactttcacagccactttctgttcctcttccacttttcttcccaatttct

SEQ ID NO: 29942 - DNA, 1639 bp, Heterodera glycines
aaagttgacggcatcaagccaagtgtcccatctccactagatgggtttgggaaccagaggaactgtaggtaacttctttctgtagaaagcaacacgtgacggtgctttgcgaaacaccattttggtagaagaaattaattcgtcgacgtctttaaactgattgcggatctcttcagcgattcgatgcagtccatgagcgaggcaagtaaaatgcaccatgttgggatagaaaacacgcagattccgagccgccttcttcatgtattcagcgctgtccgtcaccataaaaagaagccgatttttctttgctcctgtagatagcaaatccgctaaaataaataaaatcaaaacattaatatgtctaacacacccaaaccctcatccacaaaacgagcaaccgtttgatgatcaacttttgggtcaccattttcgtccaacagtggcttcaccgaaatcagatgcggcgcgttccaacgttcattcagaagtccaataagcaaattagccatacagcgtccatttctgtctgtcctttcatcaaccgaacaccaaacgaatccattttcgccaatgtcgtccttgctttttgacaaaacctaaaggaaaaaaattggtcaatcaaaaaatttcaaattttaccccttcaaaacaatttttcacataattgcttctgagggtttcatggtgtaggatggatcttccacaatatttctccaaaaaagccttgaatgaaggattattgaccttaaataaagttaaattgttaaaaaatgaatatatgtattcactttaaaaagaggaatattcgctgaaagcagcattgaacacaattcagcagcaaatttatcaacaacaaacggttgactgatcaatggttgcttttgttttgacgacaaaaaacgatcacaatttttgatatgttttgctgtttgattgtgttgctccaaatggcccatttttttgcattttaccttcaaatataaatttaaagtattaatttccaaatgcatattccttaaaacctctatttgacatgcttgacaataaattatctttgaatcagttgtgtaaacatcgttcatgtaattggaaacccattttttgaaaagaaatgcgcgggacgaaggttcttttggcatgtttaacactaaaattgaatattaatcactaaagaattctaaacaaatttttaaaattaattaaacaattccggattttattttccgagatttctttattctatgcaaagattttcgtttttattgcatttttgttaacaaattttgggcaaaacgccaaaataggcaaaaataggctctttcaaaattttttaggctttttaggcgctaaaaataaaagcctagaaaataggcactaataacttgaaaagtagcttaacaaccgccgaaaaaaacatgtttttcgtgcatttcagaccatagggagctcaggaaaaaaataggcttttgcctaaaaatatcatccctagtgctaacatattttatgtgacaaaacgccaaaatatgtgtttttatgtttttataagtcgctctaaatcaaaaattgttcggagataatgctatttttgggcttctctcgccataactaagccgcaaaaaaaatatgtaaaaacataaaa

SEQ ID NO: 29943 - DNA, 1050 bp, Heterodera glycines
taattggacaactacgtgtcaatgagcacagtcgccgttgcccagttgtgaaacagaaaaatgggaatatcagatggggtgcgtcccatcctaaaaattcctcttttcgtctaaccatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggcttctttttgtgcactattttcgtttttaaaattggatccggattttttggcttttttaaataaattgtgaaaaattcaaaacaataaacttttttattgcgctacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggctcctttttgtgcactattttcgtttttaaaattggatccggattttttggcttttttaaataaattgtgaaaaattcaaaacaaaaaacttttttattgcgctacaaatgcttttaagccccgccgtgaggcgggacagttccaaaatttgcaccacattttactgtggaaagtccaagtaccttaattggacaactacgcgtcaatgaacacagtcgcctctgacctcttatggagcagaaaagggtgaatatcagatggggtgcgtcccatcctaaaaattcctcttttcgtctaaccatccctccctttttgtgcactatttcgtttcaacattttatcaa

SEQ ID NO: 29944 - DNA, 1096 bp, Heterodera glycines
tcatttggggtaaaaaaaaaatcaaattgccaatgggccataagtttggcattttttgccaaacgaatcagcaattcccctcaaggcatagaaaggaaatgtctaatttgaaagtatcgtttcttcttaaaaaggagaagtacccaaatggtgttggacgataggacgggtttcaggatgaattctggtttttccagattaaaataaacataattttctggaaattaaaaaaaattcatagacatatgataaaaatcatagataaaagcctagattttggtttttccgattcttgaacagagcataaaactatcatagaattttcctttgtcggtatcatcaaacttttttgggaggggaaggggtggcataatcgaaaagtgccgtttcttatttgtgcatacatataaaagaagtgacaaatcggcaccagcaaggccagtgcagtgagttcagtcgcctgttgttggacatggacccgcaggacacgcaccaatttttgctagccgtacgtacatcaattaaattttggaaaattaaaatttttggcacctcacccctccccatttactttaggcactcaaagtgggcctggtggagttgaagcattggttcttgaccacctcgttggacatgcggcacatggacatggagctgttccggcacaaccatgcgcattttgtgggcttggacccggtggtgcgtaaaaccatctacccgaattatttcgagagttccggttcttgagtcgatgattctcgagagcaggcccgccaggaaaattttttttttgctcttttggcccaaaattgtccatagtaaattgtctaaatttttgttttagccttttaaaattttgccattttgagaccaaattttggcgaaaaaaaatcaaagaaaaattgtgaactgttaggcaccaccggtgaaaatttctgtggcaggaggcgtggggcgattgcccccctggttacgggtttgctcgagagtcttgaattttcagtccaaaaattgcaaatttatttcttctgaattagtacataaaatcaccgccaattatttaaggacacacacttgctgtcttcatcattttctg

SEQ ID NO: 29945 - DNA, 1133 bp, Heterodera glycines
tcggcactattaccgagatgcaaatcaagacgctattcaaatgtcagatgcggattctccgacccttacaacccctaatacgagatgctttccagaaaaaaagatttcaaaaattttatttttcgagagggggggggggactaccatcggtactattaccaagctttcctttttcaattttaatcagtttcatccatttctctgcatgtcaaaaagtaaagttgaactcatacaatttggtgaattaattaatatatgtattaagaaaaaaaattaaaaaacttttcccatcatttaaaaagtaacaaatttttagagtgaaatctcggctttttttttattaaatttaattttaaccagctaattaggcaaagaaataattaattaattaattgcttcccccgttatttttgtattttaattggtgcccacagatgaagccccttggtaccccaaccaaggcgggggttctgaagcgccgccacagggagtccgtgcggggccacccgaactttttttaaaatttgttttaaaacaatttaaatttttataattacttatattaattaattttttggtactcattgcgtgatatcgcagcgcgattcggatgctaagctaataattggaactacgcacgaatgcagggcatttgacgacaaattaacacatatattttgtgtctgcatattatgctgtttgtctgcccgtcttttccgggatcaggtggtaacggttggcattatgaatccttcgcgaaggccttgataacgataactgcatgttttcatgagctaggcaatgacaataatttcataacatagcatgaagcttcggataacatttttttctgtgattgaattatctgataaattatgtaattaaggtctgactgatttttaatgatatttattttcaatgaatttcccttacggtaccagaaatatgtgcttggcgaaaatagacagtagagaaagagaagaattgtgtgacaatcatgagcaattaataatttgcgaaattcatataccatagaagtgcctagtgtgttacttaaaaacagccacccccccccacccgtcttataagaaaactacttgataaatttttgaacacattaaaaattttttttt

SEQ ID NO: 29946 - DNA, 1565 bp, Heterodera glycines
aatttaatttttaattaattaattatttttaaataatcattttatttatacatttttattaatagtcatcgcgtattgggcatcagtgaaggcattgaacatgtgggttttaaaaaattcaatgtttattctaaaaaaagaatttgtatttttttgccaaaaaatttttttttaaaaaaaatccaaaagaaattttttttacaaaattttcattttgaaaaatccaatttccgaaaatttttactaaaaattttcatttgaatttaatgggtctgtctttttttgaaaaatattttctttaaaaattctcgtaaatttttttttgttttttcaaaatctttttgaaaatttattccgaaaggaatttttatgaaaattttatttttattttttttgaaaaatcatcgtttctctcttcaaaaatttaaaaaatttctgcaaaggtcggttctcttcgacaagacatggcgctgtacttgctgatctgctggatcatctgctacttttgcatttttaaaggcgtcaaatggacgggaaaagtaaaaaaaaaaaaaaaatttcaaagaaaatttcttgaaatttttaggcccctaaattttgttcctccctcggccaaccttttaaaaaaaattttgatcgatttcccatttccacctctttttcttgtccaaaatccgggaatttttcttaaattttcggcccctaaattttctaagtcctccggaattttcaaaaaaataattaggccccttaatttagtcccccctcgccccttctctacacttctcatattatcctaatgcaacttgttcatttattaggcttaaagaattttgtaaaaaaatttcgcaaattttgtaaggcatcctaaaaattttcaaaaaattgtttaggcccccctaatttcctttcctctcaggttgtctatctgaccgcatcatttctctatttgatgctgttctttttgcttttgcgcggcctttcgttgcctggcgccagcctcggcctcgagtaaggcccaaattttcaaaaaaaaaatttctataaaatctatcctctaagattttatttgaaacccaacttttccaaactgctggagagcaaagtttggattgacggggtcacacaggtcgaaaatttaaaatttgattgattatctatttaaatatgtttttttaaatatgtaataaaatatttaaatacattttttaattatgaattaattatatttaaattttattttttaattggtagtaaattatatattaaataaatatatttttaatttgataatattttcgatggtaccaaaatttttaaaaattttttttttggatttcttcgaattaaaaaacgggaatttacaagttcactgtgcttaatattcattaagttcaattccgaactccgtacccgaaatttaaagccaaaattgtcgaaattctcaatttttttccaaaattcacattttgataaaaatttggattttttgcccctgaaacatacaaaacgatctgaaaagcaattaaattttatgtgatgccatcaacagtatttatgtttat

SEQ ID NO: 29947 - DNA, 1291 bp, Heterodera glycines
aagattattggatttggttggcaaagaaaaaagttatagccaaaaacttgagcctcgtacgaaaacgaccccgacccataaatatattctttgaaaaattattttgtttaaaaaaattttggttattatttttttcaaatatttacttccgttcaaattaggcctatttttttaaaattttgccactttaacaaaagtcgaaatccaaaattttcgatttgttttttattttctcttcaaaaatttatgttaggatgttgaatttgttataataatggttcactgttttgcacttattccagcagagaattaggagtaatggcctcattattttgaagaaaatttgaaaatgtaaattttacaattgccaaaataggattttaaaatgcgcaaagatgagaaaaaggccgtaaaaagtttacctattgaattttcaaaataatttcggcaaattttttggacaaactttgttttgtaaattattgactcatttcaaaaagaacacaaaaattaccagtgatgcccaagactgaaaatttttcagcactccaaatagagaaccaaaaaaagccgtgatttttcttgagatcgagatcagcagcagcacagaaggttgaattggaatgggcaaaagaatttatttattattttttttgtattcttacgaaggtgaagatttcgaaagatgcaaattattttaggggaaaatggaaatttaaaattcaaagtaaatttaattttaaatggacatatttaattatgcaaaaaagcacttttggaggaatgcatttttgcgtttccggctgagaaattaagaagtaattgtctcattattattaagaaattgtttatgtaaaatttgcatctgccaaaataggatctaaaaatgccaaaacatgataaaaaggctttgaaaagttttacctctgaattttttcaaataatttcgtcaaattttttgagcaaattcatcttgaaacgtttgactcatttcaaaaagtaataccagtgatgctcaagacaggaaatttttaaattttttcggcactcgtaacacaaaaaaaagccgagacttttccttggctgagactttttttttcaaaaaattttttaattacttaaaaatccgacaaaaaaactaactttcacaacaatgtcttttgcagttaagtgagaagctctaattttttgtaggtgagaagaagttggcggaagataaattgagaggaccaaaactcaaaaaaggcacaaattttcttttatttttcaaaactaaatcaatttaaaatat

SEQ ID NO: 29948 - DNA, 948 bp, Heterodera glycines
  misc_feature (856)..(856): n is a, c, g, or t
  misc_feature (889)..(889): n is a, c, g, or t
  misc_feature (894)..(895): n is a, c, g, or t
  misc_feature (901)..(901): n is a, c, g, or t
  misc_feature (903)..(904): n is a, c, g, or t
  misc_feature (923)..(923): n is a, c, g, or t
tttatatatatgttatattgacaaggcaactcatccttaaaaccaatttctcgggaacggctgggcacaccgggctgaaattttgcaccaaggggtagctcgagacggcgcatctgggaaaactatagaaaaaaattctcgacgcccaactgagtaccaggggcgcaaaaactgactttgctgacagtctcactgttacgaaattttttgcatttgcctttaaggcttagtgaaccccaaaagatcaatgcccaaactatgggctacaactttgccagcaaactttttttgatcagatcaaacccctgacctgtaggttaggcaacgtaagaactactttttttggacacttcagtaccagctgaatgccgcgccagggtttgctcggagcggggggtcgccagcggactttttgtagagcttttaaagctctatctatccatgtttaaaaatttcgaaaattttcaaaaattttcgagctaggcctaaaaaacgattttttggtttttgaattttatgattttttaacgaattttcccagaaaaacggagaccactttcaagcaaccgtttttcgagctctatcgattggtgacatttttagaaaattttcgatttttttccggaaatagaaaaaatttttggcctgagcgggacatttgagtcccgggcccataactcgtcgggggttggttttagcgaaaaattgccttagagcaaaattgtagagctttttaagctctatcgaacggtgtactatatgtcgaaaaattttcacaaattttcgagctaggccccctagaaatttttgaaaattttttttgggttgaagaatggagtgaaaatatttttttcgngtattttgaggtgctgagcacgatatgaccttnttgtnnttgttncnngatttttggaattttttanaaattttgaaaatttttcatttttt

SEQ ID NO: 29949 - DNA, 881 bp, Heterodera glycines
gacatttacgctcccctgacatttacgcgtcccatgacgttttacgcgtcccgtgacattttacgcgtcccgtggcattttacgcgtcccgtgacattttacgcgtcccgtgacattttacgcgtcccatgacgttttacgcgtcccgtgacattttacgcgtcccatgacattttacgcgtcccgtgacattttacgcgtcccgtgacattttacgcgtcccgtgacattttacgcgtcccgtgacattttacgcgtcccgtgacattttacgcgtcccatgacgttttacgcgtcccgtgacattttacgcgtcccgtgacattttacgcgtcccgtgacattttacgcgtcccatgacgttttacgcgtcccgtgacattttacgcgtcccatgacattttacgcgtcccatgacattttacgcgtcccgtgacattttacgcgtcccgtgacattttacgcgtcccgtgacattttacgcgtcccatgacattttacgcgtcccgtgacattttacgcgtcccgtgacattttacgcgtcccgtgacattttacgcgtcccgtgacattttacgcgtcccatgacgttttacgcgtcccgtgacattttacgcgtcccatgacgttttacgcgtcccgtgacattttacgcgtcccatgacattttacgcgtcccatgacgttttacgcgtcccgtgacattttacgcgtcccgtgacattttacgcgtcccgtgacattttacgcgtcccgtgacattttacgcgtcccatgacgttttacgcgtcccgtgacattttacgcgtcccatgacattttacgcgtcccatgacattttacgcgtcccgtgacattttacgcgtcccgtgacattttta

SEQ ID NO: 29950 - DNA, 880 bp, Heterodera glycines
ctatttgaaatgcagtggggcaagcacagcgagtcgcctcttgacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttatatgcacaccctttgacacgtaaaatattccaaaaaaagagatagtgattttttctggattaggccggagaaataaatattaccagctat

SEQ ID NO: 29951 - DNA, 903 bp, Heterodera glycines
atgtcttcgtgggcgaagaaataggaatacgaagaaaatcttttattccgaaaacatagtccgtcttcagactcggtttttttaagaggacaagagcaaggacaacataattgagtattggacacatttaaaaatgacgagggcctttttatttacaattggcaataaatcgctaaagtgtaatatcaggggttggctaatttctaattagaactcgaaagaagcgaaatttaaacaccatttttttttaaattttcgacggttcgattttggatttaagctcattatagcaaaatcgatgttactattcatgatcatagactcgaaatgctcacgacctgacatcattttgaaaggatttttacaaaccaaaacttgtaactgtcaatttaacatacgtgcataaaacttcgcaaaaaagcagtgaacttaatgtaaacacaaaccttccttagccggcagtgtgcgacggattacgtactttcgcacgtcgtcttccttgttcaggttgaacagacggcgaatctttgtggcacgctttggaccaagacgacggggcacaactctgtcggtcagtccttcgatttcctgttcacctaaagcgttaattggtttaagaccgaaaaaacaattggccgagtacaaaaaaccaaatcataaacctttcttcacaacgaccaatgccagcacggacatattcgagtcgacaatgcatccgcgaaccgactttcgcttgcgctctcccttcttgcgttggcgatagcaggaatggcctttggagaggagaaggcgcacacgcgagttggtgatcactccctgcttcataggaaagccttgcttgtcgttaccacccgaaattcggagcacatagccctaaacattgaaggatgctcatatatcaat

SEQ ID NO: 29952 - DNA, 1342 bp, Heterodera glycines
ttggctgggaaaacctggaaaaaaccgggattagtccctgtcaaaactggtacttaggtactcagttgtacgttttttcagtaccagtaccggtcccgctcagggctgggcgaagctcggcttagcactcgaagccgaaggcgaagcccaatttttattcgaagccgaagtccgaagctcgaagcccaaaaaacccgaagttttcgaagccgaagccgaagttttttcaattttttttttaattccaaaatttttttcatcacataatttcggttaaatatcaaatttaatcaattgacgcagtttctagtagagaccggaaatttcaaatttgcggatcccgctgcgggactggaactcaaaattttttgcgggacgggatcccgcggaattaatcccgcaaatcccgcatttaaaatttgcgggatcccgtgcgggattgcgggattttggaaaattcgaaaaaatttcaattaaattcaaaaaatttccaaaaatcaaaaaatgctgaaaataaatttataggggctgatgggtcgactaagatttttcgattggatccgacggtaaaaagttgatcggaaatcaaattattaacggttcataaatttgactattttttttcttttcaaaaccacttttttgcggtgcaagaaatcggaaatttttcaaaaaatgcaggattgcggactgggatcccgcaaaatcccgcgcgggatcccgtcccgcgccggtctctagtttctagagaccaaccaacccttttcgataaataaatataattaactttttgagcaatatattttgtaaatttttatacttcttagaatattcacggtttttgagtcgatttaaaaaataaaggaaattttggagctccggcggtgccgataggcgccgccggtgaaattttttaaatttttagtgcattgttaacagatttagtccaaaaatgaaaaaattttacgattttaattgtttaattttattaaatttctgtcgaaaaaaagaataattttgaaaaattagaagaaaagcaagtacttggatgggaactgatccaaaggaaacataatgaaaagagccgagagaactaccactcgaccaagcatgcgaaaaaacaaaaataagcaaacagtttaaatatatattaattttaagtttaccaaaagtcaatcactagtggtgcattttcacattgaaaactcaatctttagcggtatatttttcccgaaacttaaaatagccgaagccgaagcacgaagttcgaaactcaaaaaacccgaagttttcgaagttttcgaagccgaagccgaagtttcgcccacccctgatccgaaac

SEQ ID NO: 29953 - DNA, 1203 bp, Heterodera glycines
  misc_feature (30)..(30): n is a, c, g, or t
  misc_feature (1132)..(1132): n is a, c, g, or t
  misc_feature (1187)..(1187): n is a, c, g, or t
ttttctgctcacagtaaataggaattccanctgcattctcagaatattacgccgatactaattgttctgaaatttgtttctcggcgcgttggttgggaaaaatttggaaaattggctatctcttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaactgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaactgcattctcagaataattacgccgatactaattgttctggaatttgtttctctgcgcgtttgtttgggaaaaatttggaaaattggatatctcattttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctcgaatttgtttctctgcgcgtttgtttgggaaaaatttggaaaattggctatctctttttctgctncacagtaataggaattccaactgcattctcagaatattacgccgatactaattgntctggaatttgtttct

SEQ ID NO: 29954 - DNA, 1761 bp, Heterodera glycines
  misc_feature (1678)..(1678): n is a, c, g, or t
  misc_feature (1689)..(1689): n is a, c, g, or t
  misc_feature (1726)..(1726): n is a, c, g, or t
tattcgtcttccaataccatattttttcaacctcctaggattttttttcgacacctacccctgcacttacggtatttgatctctaaaaaggtcactataatggaatgttgttagatttatcgggtctttttcaaatcaaaaatagagttaggatgcctgtgcatgatgttcatgttaatttggtgcagttttactacactagaattttgaagctataattttggaacagactgtagagacagacatacagccaggtgcaaaagtctttgaacaaaatttttgataaacagtaactcagtttcaaattggcagaaaaatctgaaaaaattcctgcaaagctaacttcttatgctgatcaaaaaagtctttagagaacaaaattctctgccgaatttccttttgaatattgggtctacgatttatatacgcagagcaacagttcgtgaaaaataagtaccataaaaacgatcattttcgatcattttcccttgaaatacggtattaatcagtcatttttgaattgttcaactttatctctctctaactcagtgggtatatatcgtagacccaacattcaaaaggaaattcggtagagaattttgttctcattctgataggcttattaaaattttccaaaaaaatttcccagccctctaggagttttttttcgaaaatttgcccgatttcaagccattttttaatttttatatcaccatgaaggagcgtctgatcaagttggtggaaatgattattaggcgaaatgtcagtaggcgagatgtccagaagcgcattgtcatacaaccttctgagacagtaatgctgaaaaccatgcgccatgtgttcccggcattttaacaatcgggtatagcttccagaaatcatggtcatttttatttgttagacaaagaaatgccgaagtatcggctccctgaaaatgcgacaccgtcggaaaatccgacagcgataaaaagtttttcatttcaagaaaatgcgacactgagaaaatgcgacaccaaacatagatttttaaaaccgtaatgggtttggttcgagtccgctccacaacaaaatgtttttatttatttattttcttcctgaaaattcaaattggctattctgaaaattgttgatggttttgccaatgacaactcttcatctcctatgtcaattttcaccgaaaaaactcttagctgttccttatctgaagtttagtattttgactttttatttttaatttattatcgattttttgtttatacattatcaatttaattttatcattaatttaatatttatatattttcgtacctatagaaaaagccacaattcaccctctgatgaacttatgttcataaattcccaatataattaaatttgaatttaatttttatttacatatttaggtttttctatcttttttaaacttaataagcaaaaatttgatgcaaaaatttttgcaaattcctttactatttttttaaaatttattcatatttgagtttttaaaggaatcttttcttcatcattctcgtgtaactccgattatttcagccgctgtttataaaaaaatatctataaaaacaatatatttttgaaaatttataggttattttagtaattagattttcaatggaatcaagaatttaaaattaaaaaaatcaaataattcatatattanattatttttanattatcttatttttctcactatttttataatatttanatgtcgaatttgtttacatacttgtatccatactc

SEQ ID NO: 29955 - DNA, 970 bp, Heterodera glycines
caccaaattttatttacatgttagtttaggcactctgatgctttttctatcaaaaagggagatgaataaaatttttaaaaatttttaattcctttttaaacaggccaaaaagtttaggcttaactttttttttcagaaactgatcagaagcgcaccaaactttgcaggaatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacactgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaattttcaaaattctgagtctcctattattttatttttttttcaaattttgaagggcggggggggggggggggggg

SEQ ID NO: 29956 - DNA, 1204 bp, Heterodera glycines
ctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctcccaatttgatagaaaaagcatcagagtgcctaaactaacatgtaaataaaatttggtgcgtttcagaaccctttctgaaaaaaatatttataaattaattatgcaaaaaacaaataaataatgaactctcttccttaataattttcctgcaccgaaggtactcactcggccgcttcgcggcctcgtggtgtgccttccccccccatttttgactccctccctctccttttttgccattaacttactgttgctccactgaatgcgatggcaccgctcattgccgcgtgtgccgacatttcttcgttctttcggcactctttcggtgactgtccgttgcctttgtcgcttaaatactttcgctccgccgctgtgtacgattccgcctcagtgcaacacaacaaaagcacatcgttcttcgctaaaatcgtcaatccaattaaacacactttcgcggctaaggacggaaattcctgaaaaactcgaaagaatggcgtgaaaaaattaacgaaaatgcgcagtgcaattggcgaaaaaagtgacgaaggaattttacgacggcgcggcacttttgggaaataaacggggagaataatcgaattataggaggggcaaaaagagaagcgaaaacgggatgaatgagaagggtggggtgggggggggggagggcatggaatgtaagccccgaggggaggcacagggaaatggaggaaaagcattggataaagcataggaaaaaagccatatggacaagggaagggaagcgaagcaggcaaaggagtggcattggaggatttatcaaaatacaatttcacgcaaaacaatcgccaacaaaaaatcaaaggaatttttgctcgcttcatcgctcaattggccaaataagccatagaattaattagcacattctgcacaatgcgcagcagcagcatcaaaagttggagtgcgcccaactgagttagaccgtcattcaatgtattaatttttaatccaaacagacacaaaataggaatttgaaaaaggccaaaatttccaat

SEQ ID NO: 29957 - DNA, 1489 bp, Heterodera glycines
cagagcactgggcagaaatcagacacggtcacggtccacaaggaccatccgtctcctctgtttaattagacagtcggattccccgagttcgtgccagttctaaactggtcgttcagcgccaaccgaagtgcataccctggcgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaagttacaaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatacacaggctttaacatgtgcagcactgagcggtataccacagctccaacgtatggagcaccccaaaagcatggctcgtgaggcagctgccccgtaatgttgggcagcgtccacaagtcagctcgaacgacctgtgcccgtcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcct

SEQ ID NO: 29958 - DNA, 1120 bp, Heterodera glycines
ttctgtccaccaaaagtgaaaacatttcacgcagaacgtttcgcatgtccatggcttgcagcacaatggacaacgccgagtccgtcgcggtccgttgcaaatcgattggcacccgcctggattaaagtgcaaaaagccgacaaattgcctaaagggtttcgagtgtcaaaacacggctttgatcttcgaatggctaaagacactgccgtcgctcgctgcccacagcagcggcgtccgtccgtcgacgtcggcacattccaaagggactccttttcggagcagtgtgtgcagaatggcctcggcccggcccaacggcacttcctcctccactgccgtcgatgaactgaccgtggcgtaatgcagcggatatgccccgtggacatccgccaaatcaatgggcgcgccatagcgatggagagcggtcagaatgtccaactaaagtgaagttgcacgtgccgacaagacgaccatgcccaaagaaagaccaacggacttggccacaaacgacggcccaatgcgccgcggagtgtccgtcacagtccaaatggccaaggtgggcaccctgcagcagcaaaagcattctcagcccatcccccgaccaaaacctgttccatcagatattccatcacttcaaaattgcctgccattacagagacaagcaaaggagtgaagccaaattcgtcttgtgcgtccatcagtaagcgattcaaacctatttaaatggtttttgcttttttctgaaaccaactcaaaatttgttgaaaggtttccaaatcagcgcaatcagccgcataatgaagaggcacctaaagaaagagtgaaatcacaggcactattggaccaatcccaaaattcgtttattcttcgccaatcgatgatcatttgtcagtccttcccttttcattgataattttcagggttttggtcattgtccgctttttaccaattcgtccatcttttttggtctttttcatgttcaatcctaatttgtctgttttcattgatcattatttgtccatgtttttgattgtcccttctttaatgatcatttatcccttttctgatcattcgaccatgttcaatgatcatttgtcccatttgctctttttaatgagcattg

SEQ ID NO: 29959 - DNA, 1141 bp, Heterodera glycines
  misc_feature (6)..(6): n is a, c, g, or t
  misc_feature (19)..(20): n is a, c, g, or t
  misc_feature (36)..(36): n is a, c, g, or t
cgacgncatttgcgcaacnncgaacaggaaaagctntttacgtgaaaaaacaagaagcattagggctaagccatcgtcacctttaccattgccatttttcggaccaaaagtgagtcccaaccgaagaagcatcgctttctctttctcttccggcccgcgccaaaatggcgcttctccagcagtttcttccctatcgtattccattgtcgtcatcgtcttctgcgttgtctttgttatcgatggcgtcatttttacgtttccgtgttgtgtcactattttcgctgaaagcttctcgtgctgaatttgctcatcttccgtcgatgcctttgtccttcttgtactgctcgctgtcgtccgcttttcctccatttcgtcattttcttccgtaacaattggacaccgtacaaaataagcgttgtcttccgccgtcaccactcccgtgttcatctccaagtcgacaattgccacatattccttgtccctctgcacaaaatggcattcaaatgccctcccttccttccgtttttctttttaccctcacaatggcacacttttgccggtggtcgtcgtcaagtggaaggcgtagtccgactctgtttcggcctcgtccggtcacaaaacaaaggccattcgggcgcgtttttagcattccgtgaaagggctcgcgaaattggacgaacatttccatggaattggcggaacaacggacagacacttttgagggggggggggaattggcgaaagagcaaaatgccaattttggaaatcagtgccaaaatttaacgccaaattttgcatggcaaaaaacgaaacaaatttagtggcattaaaagggggcaacaaaaagacaccagaaaaggggctgctggaggaagaagacgaaagcggaggaagaagagccgtgaggtgaagcaggccaaagaagacggaagaaaaagtggaagcggaagagaacatcggccggaggagcgtggaaatgttctcttccgttagtctgatcttaggttgttcgttgcctttttgcttatttgcgttgggttttttttggcatttagtgccatcgatcagtgattgcttaaccaattccatgcgtaagttggcgtttttggactgagaaagagaagcattttccgatcgtata

SEQ ID NO: 29960 - DNA, 991 bp, Heterodera glycines
ttcttggatataagataaatttaaaaattctctgaccattaaatggcgattgcgcaccgccctccctctcacgctcgagagcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaagaagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataaagataaatttaaaattctctgtgaaattaaatggcgattgcgcaccgcacttcctatcatgctcgagagcatttgtaacgtataaaatttctcaaaa

SEQ ID NO: 29961 - DNA, 1222 bp, Heterodera glycines
aaaaaaaaaaaaaccgcccaccccggggggtgtgttgttttttttttttttttaaaaaaaaaaaacagggcgcccccccggggggtgggattttttttttgtttttaaaaaaaaaataggccccagccgggggttggggggttttttttttatttttcaaataaaaaccaggtccacccggggggttggggttttttttggattttaaaaaaaaaacaatccaaccaggggtttggagttttttttgtgtttttcaaaaaaaacagacaagccaggggtgggagttttattggttttcagaaaaaaaaaataggtgcagccagggctaggagttttcttggatattcagaaaaaacaggtccagccagggctaggagttttcttcgattttcagaaaaaaacagcccagccagggctaggagttttcttggattttcagaaaaaacaggtccagccagggcgaggagtttgcttggattttcagaaaaaacagtccagccagggctaggagttttcttgggttttcagaaaaaacagtcaagccagggctaggagttttattggattttcagaaaaaaaaataggtccagccagggctaggagttttcttggatattcagaaaaaacagtcaagccagggctaggagttttcttggattttcagaaaaaaataggtccagccagggctaggagttttcttggattttcagaaaaaacaggtccagccagggctaggagttttattggattttcagaaaaaataggcccagccagggctaggagttttcttggattttcagaaaaaacaggtccagccagggctaggagttttcttggattttcagaaaaaacagtccagccagggctaggagttttcttgggttttcagaaaaaacagtcaagccagggctaggagttttcttggatttcagaaaaaaggcccagccagggctaggagttttcttggatattcagaaaaaacaggtccagccatgggtaggagttttcttggattttcagaaaaaacagtccagccagggctaggagttttcttgggttttcagaaaaaacagtcaagccatgggtaggagttttattggattttaggaaaaaaataggtccagccagggctagggagttttcttggatattcagaaaaaacagtccagccaagggttaagagttttattggattttcagaaaaaaccagtccagccagggc

SEQ ID NO: 29962 - DNA, 1504 bp, Heterodera glycines
ttggaaaaccaatcgtctcacggcaatacaatttctttggcgtgccatcttttgtcggcgtgtgcaaccatttgtacagcacttggcgagcaccagatgcatttgagccatcagcagcacacacatccgggaacagacgtcccgaataaatccaattcaatttgtcaagatcagtgagcagcgttggcgaaatgcgacggcacaattggtccaagtggtgtgcattgtttaacatcaaattacacatatttgccgaaaagatgggccaaatttcgcgggccaacacatcccaattctgctgatgctgcagctgatgtgcgtcactttcggtgccatccgagtccacacaaaaatacacggtggtgcctttggtgtcccaaagttgcttgttggcatggagaaatgcaatgacggaatggtcaatgtacctgtgtgaacaaacacacaataccgtataatatctctaattatccctccgtctccatttatccccccgggcgataattagagacaatacggtacatacaagtttttatttaaaaaatggtaatactgtcgatggtacccccctcccctttaaaaaaaaaatttttttttcttgaactaaggttgtcttagggggtgcacttcattttcccccgtcgtttcccctccgaaaaatttttttttttaaattttcaaacctagaaatttttcctaaaaaaattcttaggaattaatccgattttgacattaatttcgatcaaattcgccccgaactcggagattcgtgaccagtgatcccgaaaacgctcggaaatatgatttcatgtcttttgaaaaaaaacataacttactcaatcatgaaacgaattcggagtttgtttggcagcgggaaggtccggcaacggaaaatccacaaaattggcatccatcggctcccgcggagattgctgcacaaaattggcaccgagcggcacagacactttcgcttttggtggttgggcttcatccttgcaaattctgatccatttccaagtcgtccactcgcttttaccatcaaaatgcgtgtccaccagcgcatcaaaacggggcgaaagcaatgcgattttgagtccgagttgagcatggtcaaaggatggcagaatgcgcgtccgcgcgttcgttacagttgcaatggataccataggagagatcggcgatcatgaaaaccattggaaccatacattcatgcctttagaaaacaaaaacattttttcagggaaggggggcttccatcggcagtattaccgaaaatgaagcgggtaatagtgaagctggtgcttcttttttttgatttttttttatattctctaaaacatgcttcttagggttttcggggtagctcatcagtagggtgcgacttttagtgacgaaaaatctcgaaatagttaactaaaatagtgagtaaaaatgccaaaatagtgagtgacaaaatagtgacaaaaagtccgaaatagtgacgaatagtgattaattttcagcc

SEQ ID NO: 29963 - DNA, 1032 bp, Heterodera glycines
  misc_feature (1001)..(1001): n is a, c, g, or t
aaatagatttttttaaatataataatttctcttttttaggaatttataatttgataagaattttattttttccaacctgtttgcctccttttaaccaattttatttattaatacaattttatttttaaaaaaaaagtgtgatttatttagaaaaaataatatgagtaaacagagatgtgtgtgaacagatgttgggaaaagctgcttttgcttgtgtgggaaagcttaatgttcagggaggggaggctgtgaaatttaagttgtgatacgaacaccgcttaaagcaaagctgtgaattctgaggatattttatccgcattttgtggctttttgaagggattggagacgaaaatttttaaatgaggataaatattttttatgaacccatttaagcactaaatttgaaattatgtctccggcggcgcctgtcgtcggcactgcttccgaagattatcaattctgttaattgatgcaaaaatttgggcacaaagatgtccaaaaatggcatttttaggcaaaatctgttacaaatgcataaaaatgccaaaaaaattcacggcacaccttccgggcgcaaatttttaaaattttacctaataatattcatagtctctagcatttttggctaaaaattattaatatatcatataaattccaaactttctcataaaatatattgaaaatgaagattttgaaattttaagtttgcatttcacactctgctgcttttaaaaatgatgaagccccaaccaacttcggcttggaaaaagaggaacaaagcggcgggcgggacaggggttaacggctgttttaaaaatagcacatttggcgatgtgctggacttatccgtgatcaaacaaaaagaagcgggctgatcagacagaggtgataaaaaaaatgatgtaaaaatttgatcagaagcagcaaaagaagaagagaaaaatgatgggagacgaaaagccatcgcaaaaaaaaatgtgcagaaaaaatgtttggcgaangaatttgtccgttaaaaaaagaatgaatgcc

SEQ ID NO: 29964 - DNA, 1250 bp, Heterodera glycines
  misc_feature (7)..(7): n is a, c, g, or t
ctcacanttttctactacatatgccataattgttttgattttttctattgaataaaaactgataatggaaatcatcaaaaacccttaaaaaaaactccgagaaacaagaccgatacagagaacctcggtttccgagactaaaaacccgagactcgagtcgagactctcgcacagccctaggatttatattccaatacaatacaatatttgtttgctagctttacattttaataaggattctcacccattgttacataataatccatttatcgcgtcatatttttatagatttacaatttatgtaaaaaataaataaaaattattaatgcttattcaacaaaatatattattgcaaataattttagcatttatttaatttttattattttgaaatttaggttagcataattaataaaatattttgtataattattatgtatttgctgtttctttttccatttcttattatgtttattatgggaagggaatgcaacgaaataaaaaatgaaaatggcaaataatatttaatttaaattattattaaattcatttttaagacacaaaaattgaaagcggaaaatatttggttaagacagctccaagagcattttttactgctgataatcatttgattgataagtggttgcaaaaatatgttaatgaatttttgtgcaacgaaaaaaatgaaattgaaaaaaatcattcaaaaattggaaattttatttttttacgaaaaagcagaaaaaatgcgaaaaactttttgtgggcaaataattgaaggaaaaggtattgaaaatgcgacagaaaaagtaggaaaaatgtcaatagaattggccaaagaattggagaatgataaaactcttaaagaaaatatacaaaatgctttgaaaaataaaaaagataaatttatttttaaattttcaaatgcaattgaattgaccgatcaattaacaaataattatactcaagaatatttggaaaaactcaaaacaactttttatttagagcttgccggctttttaaagtcatccaaaggtaattatttttaaataataatttaatttataacagaattaaatacttcaatcagcgctctcaattgtcataattaaaaaattgtatgatttaaatttcagcttcaatagaaaatttgtgccaaaagcaacaaattgcgtttgctccacgacggcatcgacgtgcagatttcgccgacaaataatacaatatttgatcaaattcgacatccaaat

SEQ ID NO: 29965 - DNA, 1678 bp, Heterodera glycines
  misc_feature (113)..(113): n is a, c, g, or t
  misc_feature (132)..(132): n is a, c, g, or t
ctcgtctctctctctttttatgctttcctctttctcacctctctatcctgtcctctcttctctcctcctctctctttctcccttctctctctctctatctctctatctccttncctctctcttatctcctcncctctctctctctttcttttcctctcttctcttctctctctctctctcttgtcctttaaattctatagttccttctttctctgtattcgtaagtatctatttatcttttttttattatttctctctctctctctctcacacacacacaccctctctctctctcccactctctttctctctctcacacactctctctctctcctctctcaatctctctctctctcacacaactctctctctctcaatctctctctttctcactttctttctctttttctttttactttcattctttcatacataatattttgattcattatttgtttaaaaaaattaagcttttctctcaaaaattttaataaaaaaaacaaaacaatataataattaaaaaatgtacaatttgaattaaagtttgtggattagaattttaatgttaaatagtagtatttaattaatttaatttgaaaaagataaaagtaaataaataaaaagaaaaaagtgatgaaaaatctcaaattttattattgcataattttcttaaatttatttacaaaaagtttttattggcattatgtttattttcgcgttaatttgaatcgatattttttgtgacggaatgacacgacccaaatagtatatttagatttgaagaaatttagagacattacacccttaatttggaaaatttatatgcatatttttcactttttatgtgcatattttgccatttttggtgcatattttatgcgcatatttttggatgccctagttatgattagaaaagtcaaactctctttttgtaaggcaatttcatcatagtgatactaaaagaaacgggtaacgggtagccaaacccgcagctgcgggtgagcccagcgagaacccggtaacattcatttagtacgggctgagggtgagttaaccgggttaagttataacattacctcgttcttttggtacgggccccgccggacgctgtgtataagattaaaaaggaacacaaaaacccacgaagacttttgtttttgttgcattctttttgcaaaaactattcatttattttacctatttatttttcagtttattttgaaatggaacaagaacaacaacaaaatgttcatcacagtgggcgcgaagtgcgtcagatgttcatcgactttttcgtcaaggaaaaggcccacaaatattaccattcctcttccgtggtatgcaacggtcgtttccgctctccttttgaccattttcagattccccacgaggatccgactctgttgttcaccaatgccgggatgaatcaatttaagcccattttccaagagactgtcgacccgaacagtgacatggccaagctgaagcgtgcggtcaacacacagaaatgcataagggcgggtgggaagcacaacgacttggacgacgtggggaaggacgtgtaccaccacacctttttcgaaatgctcggcaattggtccttcggcgataatttcaaggtcagtcgtctcctttttttgctattctgtttttaatgttttagagggaatttgtacat

SEQ ID NO: 29966 - DNA, 1377 bp, Heterodera glycines
  misc_feature (1359)..(1360): n is a, c, g, or t
ttttaaaagccatgcccggaaccgatttgataaaaatttaaattctttctcacaagtatttcaagttgagttgcacgggaccgagaccgggtcgggaattcccgggtttttcaggtcccggtcccggcgggactaaataagcactggtaagaattgaggtcctggtgagaaagagaagaaaattggcggagaaggagaaatttttaagaaaaaatttatttatttcatagcacagtcttatcttatgtgggtgtaattaaatcttctgaccttcattgtttgtctcttgggttcaattccctttttgacaaattctgttagcaaaatcactcaaaatttcgaatttttccggcggcacctatcggcaccgccggaccccccccccccaaagttcccaaattttttttgaaacagcgccacaaaaagaccgatttaaaaaatttaagagattgttaatttgtaacaaagtgcacttaaattttcaaattaaatggcctcttttcgctgaacaaaaatataattaaaaggtggataaattttaaaaactccagaatttattccagaaaatgttcagccaaccacgagaaaagtgaattaacagacaaaatttggttttaaacctaaacaagtttttgaatcagaagagtaaggacgagcgtgacattatgcctttgcatattccgttgtgtttgaattcgtttccaaattgttccattccgccaatgatagcattttgccgcaactcaccaaataaatcattgccttcattctgtctaacttcgtaaattccatttgaacaaataatacttaaaagcattactattgcaagcaaaaacatctgaatttgaaaagatttgaatgattggctaattttcaaattgctaaaaaattaccatttaatttccaaattaatttattaaacatattgcaaagacttatgaacaaaaaataataatacaaattgttcttactgatgcttttcatcaatttgttgcatttcccctcctccacccaaaaaaagaagtaaaaaacgtggcttcttgtctttcaagtaaaattccaaatttcttaaagttttcatcgaatttctgatttcgatccaaaaatccgagctgtaaagaaaatatggtgtattatttattattagggcgagcatttatattttcaaaaaatctcgaaatatttaaataatatttgagaaaaaatgtcaaaatatgtaacaaatattgatcaaaaatacctaagcaacttagagcaacaaaaattgaaaaattttcttttaaattaataaaaaacgaaaaatgtatttgtaagcgaggacaattgggtgctatttgaaaccatttttttcaaaacaannatatttaattcttaggg

SEQ ID NO: 29967 - DNA, 925 bp, Heterodera glycines
tgaaaaaacaacaaattcctgatgacaattcacaaaccatgcactcatcacatctccgcgacggactgaaattgaattttcactttaaatttggcttttttggcactgccaacccgaaatatctttgttcaaatagccacggatttcgcccagaatgaactcaatgtcactgttgcgcggcttcggagaaaacgaaacgtcgcacggcgagtccgtcgtgccggccaccgtcattctctgccatggactaaaaatgtacgacagtttatgaggacattccaacacaaaaacgcacagaaagaaaatcactcgtccgtcggtggtggacgggtccaaaaggcccgtgttggcgggactgtaatagccgggcaacacaatgtgcacgccggcggacggacgacagattggctccgtgtccggatcggccatcatacggatggagtcggtgaatggaccggtggcattcacaatgcatttggcacggatgggaaacaattcgccagtcaactgaccgttggaggggggggggggagatttgaaaaagtggctaattgaaagaaccatgtttttgacttgagcaccgcacaatttgccgttctcgtccttcagcaaatgttccaccgccacgtgattgcagcatttggcaccgtttcgtattgcggacaacactatggccaagttcatgcgcgcgtcattgtgttggcctaaaatggggtgaaattggaggggattaattggtaccaatgaaacaaaaaactcgagaaatgaatgttctactgaaagcgaaccgtcgtaataaataagcgctccctttaacgattcctttttgagcatcggaaatcgctccaacgccttttccttgtcgatgtaataagagttcttcagaatgcgctttccggacacccaatcgtacattttgatgccg

SEQ ID NO: 29968 - DNA, 1661 bp, Heterodera glycines
  misc_feature (1644)..(1644): n is a, c, g, or t
ttgttttgatttgtttaggtggcacttttttatttccttctgtcatcaaaatgcaacaaattgtcaacataaactccctcaatttcccccccccccaacttttttggcattttgtcataaaatgtttcgttgtccctttattccctcccctcgtcgttttgctgtttcgtgtgctccgtcgcgcttttccggaagaattgcatcggccgcgggttccgcacagaatggagatgattatccgtccataaaatgttttgtcctcctcgttttgattgcttccaaacattttatagtctctccacgttgaattggggtgaaaatgcgcgacaataaatccttcgctgctgggctttttttccccaaaattttgtaaaagtcgggtaaaattcgcggaagagtgcctaattagagggttctttgcgctggacagtcgagagtgacgagttaatgggtcggaaggcagtcgagattggcactttgtcgtcttctgcgggagaaggccaaatggctttcttttctggggaagggggaagccgtgggaaaatgaggctgactttggacgcaaacattgtcaactccatccatctgtccctacgtgcctcggggaaatcggcatcgaaattcgggttccctgagggctttttaccgtattcctccggttttccggcaaaacaaacattcgtttcgtttcatttttccctcgtctttttaaaacgaattccttttttcccataaactaaatttcgttcacagttaatttgttccttttttaccgtttttcttcacatttttcccatttttcggtcatttgtccataaaacaaagcgaaaaatgcgataaatcatcgcctcacaacagacaaatgcagcacaacagttgggcaaactctgttcacaatttgtggatgataagcaaacggagggggggggggggggcaccgccgccttatcattaaaataacacgccatggcaagcggacggagaaggcttagagttatcagtgcggcgggagaagcgccgactcagccatagccccgggggcattttctcacccgccggaggggccaaagtttgtttaggctttggaatttcttttgggcggagaggaaatggacgattgttgagaaaagtgttgttgatgagcgaaactgatcaggctaattaatcattggtattagctctgtacgacttttattgcttataatgttcgagagtatcaatcatttgatttgatatcgaataaaaggaaaaaagcgaaactcagaagaaataatcaggaaattaaaatgtacaattgttaaagctaaaaacttgtgaacaaatttaattaatgccaaaagaagtgatcggtggagaagggccgacgccttttttaacgcaaatgatttattttcaaaaaagttttaatttgttaaaaaatattttgatatttttgaaaatgttttcgatgggtccgtccgttcgtgcttcgtcgtcatcatcatcaaccagttcgttcatccattgcccatctctccccaattcttcatttgttggttggtcgccgccgtcgtcgtcgcatttccccccgcccattctctccgactgtcccccccgtcgccccccgggaaatgcattggcatacggtaccccaatggagtcggngggaggggggggggggg

SEQ ID NO: 29969 - DNA, 1164 bp, Heterodera glycines
aaaaaatagagaaaaatagggagaattttatgagatttatttgggatttctatcttgcaaacaataaaagttattcctgaaaaacttgaagatttcaatttttcacataaaaattaataactcactccaaacaaagtgctaaggtataaaaaaatattgataaaatccgcaatttttttctctacaagtaggaatttatttcatatttttatcgcttttttaaaaaaagttataaaaataaaactgattttggagccaaaattcaaagggatacccctttggaaatttcatggacacatttttttgctctaaaatttaaaaaaaacatattttcttacgtaatttgggtcgctgatcatgaatatgaactttattttgagttatagacattttggaattttttaaaattttttgaaattttagaattttttggcccttgaaaatttaagctacattttgaaaattcataactcccatcaaaaaggtccaattcagtccatttaaagtttaaaaaatagagaaaaatagggagaattttatgagatttatttgggatttctatcttgcaaacaataaaagttattcctgaaaaacttgaagatttcaatttttcacataaaaattaataactcactccaaacaaagtgctaaggtataaaaaaatattgataaaatccgcaattttttgctctattatataaattttatttggcatttttatcacttttttgaaaaaagttataaaaataaaagtgattttggaattcgggaccaaagggggtggacaggatttttgagtgtaaaaattttttcacccaaaatcttcaaaaaatatgtctttaaggccatttaatgacgctgatcacggatacgtgatcagttttcacttttgacatcgttaaggcctcagaatccctgcgtaaattgggattctgaggcattcaggttcgaatccggacggtgtaaatcatttttaaatttattttctgctattttttaatgctaattattaagtcaaaattatttttgttattttttaaattcaattttagaaaaattaaaataatttttctataaaataaaaatgaaaatgggtaattattaatttatttaaatttaaattaaatgaattcttcttgaattcaataaaaaataaatggattt

SEQ ID NO: 29970 - DNA, 808 bp, Heterodera glycines
  misc_feature (19)..(19): n is a, c, g, or t
aatttttataacaaatttntttgtaaaattttatttactttaatatgttgtcggcatcgtccaagcgaaaagcacaaatatttttttgtcatggcactggtgctgctgctgctgttggcactttgtttgaaagaaaaaaataaatttattaaaaccccgtgaaacaatttttgaagatttaatttgaaaattccaaattttcccggcaacgtctagatggatggcattttcgaacctccatttttgttcatttatctcttgaaattggatatttttaaccaatccatgataatcatcaaatagaaaataataatatattttttcgagataatttcattcccaccaacacttcaaatatttttatagtacttacaattagtactaaacatttttttgttaaacggaatacagtaacagcacttgtcactaccgtatttgctgcacccacagtctcttctcctcctcagtcatttgttgccgttgcagtcgtccggtcttcactacgttcactcatccgagtaggatcgggcacaaattgctcggaaattgtctacaacaacattataaatgatttaaaacaaaaaaaaacaacaaaaataataataaattgcttaataaatgtttttttggcaggggattagtcagttttgccaataggccaaatttttctgatgtcgcacatgttgctgttgaccagcagaacagttgctgctgttgttgaactgcttgaacttgatggcggaaacacagcaggggcaaccgtagagaaagtgacaccgcgttgttgttccgaatgatgacgatgttg

SEQ ID NO: 29971 - DNA, 991 bp, Heterodera glycines
  misc_feature (965)..(965): n is a, c, g, or t
  misc_feature (976)..(976): n is a, c, g, or t
agtgcatttaaattgttaaattaaagaataatttcattgttttcagtacttatttcatataatatttaataatttttgaaacatttcgtatacaaaacaatttaaagtaaatcttttttggtgattggtatttcgttttagtgaaagatgaattctatgtatttctgtctgtatttaactaaataattatttgctctattatcattagtttaagaaatccttttaaatttaattttatttttcaataaagaaataaataatcacttattattgaattacgaaatatatattttcgcaatgaatatattttttataactttgaaacactaatttttaatgttcaaaatgagaaaagctcagatttttttcagtgtgaggagtctttttattttttacaattcaaatattataaatattactaatatgaatattcaaatacttcgacatcggctttaaatttattttgttcctcctatcttttaatattattttttgttatttttgatttaaatttagatttcttatgcaataaactctgataattgtttctttctttctaatctatgacatcggtaattggttgctcaaatgttgtgttttttattatttttaataaataatttatttttgttatgttgttcatttatgtatatgaaaaaaaaaatttaatgtttattactaaaatttaattttttagtgattaataaataaatgacataaattttccattgaagaaataaggtttattaattgttataagcattgttaatattatttttcatttatcttctttgataatttttatttaaatcttatttctttttgatcttttattagaatttctaattttagtggtttttaaattttgatttgataatctgaaacgaatgttattattttccaaagtgttttttatgtgaagtgatcagtatatgctttattaagaaatagtataatgagaattntttgatttaanactcttttttttaat

SEQ ID NO: 29972 - DNA, 1003 bp, Heterodera glycines
  misc_feature (983)..(983): n is a, c, g, or t
gttgtggttagctacggtgcagcgggtgtgactttcggcactgtgactgccggtgtcggcacgccagcgataatcctcgcttgcaactcagcgttcggcacatgccaggcggcttgttgggccgcgctttttgcgccgacgccatgagcggatttgaaagaaaaccccagatgggaattatttttttggattttaatttatcaattcaccatcaattgggatgccaatttatgtaaatacaattttttttaatttgatttttaattttttgctatgctaatttatttatttgttttatgaatttgtaaagaaaaaattgaaataaaatgtaaatttaaaattaaaatggtaaagttttttgtggcattttgtgcctatatgttcttcaaatttgtatacattgaaaattcaaattttaaattgaatattttaatacgttttgatattttttatacaaaattggcatcctttctattgtactcactttatttttatattcaacacggtacactgagtacggtaattttttgccctttcattttggcaatttttaaattttcgaaaaattcaaaatttgttttccgactacattgaaatagaatatttgcttacctaattttaaatttttcgaaaaaaaattcctctgaaacttgatcaataaaaattattgaaaatttaaaaaaaaaatgttttttaaattatcatttaattaagcattaaaaatctcttccatttggtacatatttttagtagcatttgttttgatttgttttagcgccttatttgaatggatgaatgaaatgtccaacgaaaagctgacaatacagccaacgatgggtcggtttgccaatggctaatgaagcgatgccaaattgaggggacggagtcgattcagtgggaagacgaaaatttgggcgatttgaacactgtcatcttttccatttccgatctccaaagctgcattgtgtgagcaatttacatantaagcatttgattttattca

SEQ ID NO: 29973 - DNA, 1782 bp, Heterodera glycines
  misc_feature (1740)..(1740): n is a, c, g, or t
atcattgataaccatagtttttctctattagcctgcaaaatttcaaaaaatctggtcaacttcgaacaaagttgtatacgaatgagtactattattgctgccaaaacttatatgaaaattgatacttttattttaaattttgcaggcttatagtgaaaaacctgggctatcgaataaatgccatttttttaggaaaaatgcaaaaaatgccggattttacgaaacgaacaggcacagttttttgtgttaaatttgtttaatgattttaaatgggtttaattaaatttattggaagaaatatttatttattttatttatttatataaatatttccaaatttagtctcagaattgaacaactgagaacagagaaatcagtcccagaagaatggaatttgttgcggtgtcccatcaaactcaggacgtttttttaattagatgcccttaacaattattttgcaaattaatcccaaccattttcatccaatgttctcgagaatctttgtactcgagactgagtttttttcagctaaattttcgggatttattggctcgggtctcgagttctaaccctgatgtatatactgtcaactgaattgatcattaacttttcattaacattgtatgttttttaatatatttgcattttacatatatttgtttttttaatttgtatattttttaaaataaaaaatattttttaatcagaaatttgtttttaatttgtatatttaaaagattgaaaattttataatgtctatgaattgtaaaattaattgataggcaaattacaaaaatcacaagacatccattcgtcttataaatttttcaagaaaaaatcagaggtaggcaggttggtctggacggagtgcacgaagcctaattttaaaataaattgggcaaaattaatttaaatattaatttattttaaaatgaattattttacctgcgcaagtattcggcatcacgcaaaaaatcagattggaaactgttgtggcgcatggtggacagtgcagaactcagtgtgttctcgtcaataaatcgtaactttaacaaaaaaaaacttattaaaaatttttattattaggtaaataaatatattttttaattattaggtaaaaaatataaataaataaaatttaagtaaaaattaaataaataattaaatataaaatttttgtaagtttttttaatattgtttttacacattaattgatctaatgaataaaatattttttaatcagctatcataaaattaaaattattttcatttaataaattttaaaatattatctttaatttataaattttaaaatattatttctaacttaaaataaatttataaaaatttgcgttactgtagacaaaaaatttttaattaacgataataaattaaaataatttttattcaattaaattaaatttaaaattgtattgcaccagaaaaaaaattccatttttaatattttttctctgccttaccttcatcagtaattcatgtggttcaaatggacgattgtagagctcattttccagaaaattgcacacatcatcccaggtgatctgagtgaaaattttaggggttaaaaatttttgaaattttcaaaaaattgccctaacttttccatgcttttttctcctcaaaactcctaacagtgtgacaatttcgcgcaattcttcgctcatgcccaagaagcgtttggcacggccaaagtaatggagtgaagtgaaataggccttncaatgagttgatgcccaaatcacacacattgtcacaacggcg

SEQ ID NO: 29974 - DNA, 988 bp, Heterodera glycines
ttaaaatttaaaaattatttatttatttatttgccaacccaaacgaattccatttttggtgaaaaagatctgccgagtggcagaattgacgccaattccaacagtatcgccaacaccgtaggaatgtttggcattttttttaatttctccgttattccgagccaagccatcactatcatacgcagaaatgctttcatacatcagccgtttgacggtgaatccgaagaaaatgtaactgaaaaacgaaaaattaattaaaaaaagaatgacaattaataataattaacaataattttttaatatttctgatcattgaacattcaaaaaagcatttactttttcatatttttgaccgaaatttcgtaataaaaaatgttggacgagttattgtttaataaaatcgaatattcaccaaagacaaaacaccaaccttttgatgaggaaaaaaagattaggtcgtatacacaccatcccagaaatgagctcctgtaccagaaaagatttgcatgtgtggctcagtggtttttgtaagatagtaaagggacaaagggtggaggttcgagtccgttgtgcaacatgaatattttcatttatttttgtccaaaatattaaaaaatgaccatttttgggaattatttttggaggtttttaccaaccaaattgtacaatcttgacatcattcgaaagcccttgatggggagaagctttttctaagcaaatgctaagcaattggattgattaggaaaaagatatgagggttcgaaattttgtttctcgaataactttttagttaaccctttttttgcttttaaaaacccttacattttgttcgtaatttttttctctatcgacatgcaaaatttggtgtaaattgtatgagtagaaaaaaagttatatgtggcgaagtaaattcagtttttctctattaacagagataaagaaatagtacgccaaaaagagagatgtttttctctgcactctctattta

SEQ ID NO: 29975 - DNA, 1116 bp, Heterodera glycines
catcacttcggcatcgcatcagtctgagcccaagcacagtccgcctcgactgactccgagtctgcactctgtcgacgacgacgacgacaccatcgacggcacgccacccaaaagcggaaacaacggcacagggcactgatgaagccaccagtgatggcaacaacccggccattttcaaggacaaatttagcaaggagtggcgcctgctcgtcccaaccgatgtcgcacagttggaccaaatcgccgaccaacactttttgcgtcgcaaagggacgccgaaatatgacgggcgcatttacttaaggtgctgacaatgagtggtcaaccaagtacacagaatcggtttttcggaccttgcaaaattggtagtgattgaagaagttctgttttccaaaaaattctttttaatcaaagaaaattaattttttgagttttataaataaaatctaaaaatttattaatacaattgtttgtgatgttaattctttacaattttctcaaaattctatcttcctttcttttcaaagtttgtcaaaacggcggcacgacaatcgcttagaaaatggtagcatcacaccacaacaaactaaagaataaaatgaaaacaattataattggtaacaaaaaaaattattaccaaaaatcaacggccaataaaattgccattggcaccaaaaaactgaagccgatttcattgcctacaaaataataatgttgggtttgagaagattttataataagatagggcatgatattttgtacaggattttcccaatgttttgcataaagcaagggatattttctgttcgatatatactgactggtcctgtttttgtagcaaattcgagctctaataataataattacctgaactgggagtcgattcggcaatctctgaattcggcaaagaattcattaattgtttcaatagaaagatttttgtttaattgacaaaaaaaaatccccaaatttgttattattgtgtttgattctgtagaacaaagttggaatgatcattatctgttctcaatcacgggtcaatggcaactcgtacaaaaaaattttttctaagaattttcaactaaaacttataatttttagataaaaaatctaaat

SEQ ID NO: 29976 - DNA, 1304 bp, Heterodera glycines
ggggtaaaagtgcaatttcacatgtgcagtgggtgtcttttgcttaatatgaggttgagcgacttgaattgtgcaaataataacaacgattacaacaacaacaacaatcgctttagaagcagcttcactaataatagctcaacttttggcaatttcggaaacaatcgcacgaactttgacgctgggaataaccaaagcaacgcatacaacaacaacaacagcaatgaaagtggacaaatggtacataacaacaacaatgccggatggatgaattgattacctattttataacagactaataattttgctaaatagttcattgcatttaatcaccatttcatattgttctaataaatttaaatattaatccgtgtgtcttaattttttgcatcccctttggtgtttgaatatacccgtaaatgtgacaagcgcatcgccggttagcggcatgatgcattagtttctcttttgtgccgatgcagaaatgccgcacatccctttgttatttgaatttgaccccgttcgcatcggtcaccgcagcgtcggaccttggctacacagatggccacgatcccgcctcatacaaaagggcccatgggaaagtcgccctctttttttcaccattcatttaccctgcaaaccaaaaatgaattcccagcagcgccaggcagaacgtgcccaacttcgcgcaagattgaacttgcttgtcgatgaggtagatattgtggtgcaagggctcatcaacaattatcaggccgatgggttgatcaatggggtaagttttctttattttttatgctgtttttgcttttttttgaattttaatcttgattgaacaggccccgcatgagggacagctgatgggcatggaccatggacaaggtctacagcatgagcagcagcagcagcagcagccatgggaactggatccaccaatgcctgcacagcaattggaaattgggccacagctcccggatgcgtgggaactggttccctaccagccgacaccacaatgggaccaagttgcacatgtggaacaacaaccgcagcagcagcaacactaccaccaccagcaacaacaacaacaacagcagcaaggcgcgtgggatgaggaatgggaggggccgctttcgccaaatgcgcttgctcaaatccaggacgaagcggacgggctgcgtcaggatttgagtaaggattttgggtcggggtccctccataaaacaaaaattaagtgattgggagattttctcgtgtggggcagcctcagcctacgtggcccggttaccaaagatgtttgaaaaatt

SEQ ID NO: 29977 - DNA, 1410 bp, Heterodera glycines
agaaaactcctagccctggcttgactgttttttctgaaaacccaagaaaactcctagccctggctggactgttttttctgaaaatccaagaaaactcctagccctggcttgactgttttttctgaaaacccaagaaaactcctagccctggctggacttattttttttctgaaaatccaataaaactcctagccctggcttgactgttttttctgaaaacccaagaaaactcctagccctggctgggcttattttttctgaaaatccaataaaactcctagccctggctggactgttttttctgaaaacccaagaaaactcctggccctggctggactgttttttctgaaatccaagaaaactcctagccctggcttgactgttttttctgaaaacccaagaaaactcctagccctggctggactgttttttctgaaaatccaagaaaactcctagccctggcttgactgttttttctgaaaacccaagaaaactcctagccctggctggacctattttttttctgaaaatccaataaaactcctagccctggcttgactgttttttctgaaaacccaagaaaactcctagccctggctgggcctattttttctgaaaatccaataaaactcctagccctggctggacctgttttttctgaaaatcgaagaaaactcctagccctggctgggcctattttttctgaaaatccaataaaactcctagccctggctggacctgttttttctgaatatccaagaaaactcctagccctggctggacctatttttttttctgaaaatccaagaaaactcctagccctggctggacctgttttttctgaaaacccaagaaaactcctagccctggctgggcctattttttttctgaaaatccaataaaactcctagccctggcttgactgttttttctgaaaacccaagaaaactcctagccctggctgggcctattttttctgaaaatcaaaaaaaaatcctagccctggctggacctgtttttttctgaaaaacaaaaaaaactcctaaccctggctgggcctatttttttttaaaatccaaaaaaaatccaacccctggctggacctgttttttctgaataaacaaaaaaacacccagcccggcctggactttttttttttataaaaaacaaaaaaacacccacccctggctggccttttttttttcaaaaaaaaaaaaaaaaacacccacccccggggtggggtttttttttttaaaaaaaaaaaaaaccccacaccccgggggggtttttttttttttaaaaaaaaaaaaaaaaacccaacccccgggggggtttgtttttttttttataaaaaaaaaaaaaaaaaacccacaccctggtggttgttttttttttttaaaaaaaaacaaa

SEQ ID NO: 29978 - DNA, 955 bp, Heterodera glycines
actgaaatttattcaactttcccgacaaattgttgagttactattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagcttttcttgaaaagttttttcccagaatttatacagctttcccgacaaattgtttagataattattctagacgatttttttatatctcagtgcttaactattgcctttttgtatgataactggtagatattgggagtgaaaaaaagtttgtttgtgactatttacaataaaaatttatgcagcatttctaaaaaggatgtaaaaataatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcccttacattttgggtttactttattatgctggcccataaaaaaatggagtttttccggtgccaaatttttgtgaattttctttcggcccgtcataagcggattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgcccatatgcctattgcaactgaaatt

SEQ ID NO: 29979 - DNA, 1101 bp, Heterodera glycines
tccaaatatcattatcaccctctctcatagccaccgcggcacatcgttaagctttagcgtgtttcttaaattctctggagctgcgatcagcccacaaaagaggtcactaaatttgtattccaaatatcattatcaccctctctcatagccaccgcggcacatcgttaagctttagtgtgcttcttaaattctctggagctgcgatcagcccacaaaagaggtcactaatattccaaatatcattatcaccctctctcatagccaccgcggcacatcgttaagctttagcgtgcttcttaaattctctggagctgcgatcagcccacaaaagaggtcactaaatttgtattccaaatatcattatcaccctctctcatagccaccgcggcacatcgttaagctttagtgtgcttcttaaattctctggagctgcgatcagcccacaaaagaggtcactaaatttgtcttccaaatatcattatcaccctctctcatagccaccgcggcacatcgttaagctttagcgtgcttcttaaaatctctggagctgcgatcagcccacaaaagaggtcactaaatttgtattccaaatatcattatcaccctctctcatagccaccacggcacatcgttaagctttagcgtgcttcttatattctctggagctgcgatcagcccacaaaagaggtcactaaatttgtcttccaaatataattatcaccctctctcatagccaccgcggctcatcgttaaactttagcgtgcttcttaaattctctggagctgcgatcagcccacaaaagaggtcactaaatttgtattccaaatataattatcaccctctctcatagccaccgcggcacatcgttaagctttagcgtgcttcttaaaatctctggagctgcgatcagcccacaaaagaggtcactaaatttgtcttccaatatcattatcaccctctctcatagccaccgcggcacatcgttaagctttagcgtgcttcttaaattctctggagctgcgatcagcccacaaaagaggtcactaaatttgtattcaaatataattatcaccctctctcatagccaccgcggcacatcg

SEQ ID NO: 29980 - DNA, 1683 bp, Heterodera glycines
  misc_feature (40)..(40): n is a, c, g, or t
  misc_feature (46)..(46): n is a, c, g, or t
acccgccggcttttccatctgctttctaatcgaatttccncaagtntaatattgaggtaaaattttaaataattgaaaattaaaataaacaatgtaaaattaatggctattttattttcctttattacataatataattttttcatcgccacctgttgcggttgctgttgcggttgaccaactgcgacggcatttgtgccattcggcggctgcgcggaccgaaccttttgcgcagtttcgttcaatttccaacggccaactttgagcaccacgcgaccagtgcaagtctaacagaaaaacaaacaaacttttcaatttgaatgggatgtttgacaccttcaaaagggtggccacgtcctcctgcaaacagttggccacgttttggccattcacttccaaaatctgaaaaactccatttaaacaaatcccaaaattattttcctaatgatcctaatttagcaattatatttggaattttccgtagatttccctcctcccgccctgcgaatttttcataatttcctgcccctccgccctccgaatttttcataatcctcccgccttcttccgctgccagttcgtcttttgcgatcagtcttgatcttccaaatatatatttcttttcctccctcctgatcagttctaacctctcccgctgtgcctgatcagcttcgtccctgtgacccaatcaccctactcccgttccacagttctcctctctgattagcgtccccttgatcagtcgcttttttcttctctccctccccaactccgatcagcttcttctccccttcatcctttctgatcatttcctccctctctgatcaacgatcagcctcccttttttcacctgatcgccctgcatcagtcgtccgtcgttgtccgccacgccgcccttcacaatttcggaaatgtaaacgcccggctcatttttgcgcccgacgatggaaacgccgaggcctttgccactttttttggtcaattcgatggccaaaatgttgtaaatttgggccgggtccaacatgctcatctgcagattgacgtctgaaaagctgtattatctcacaaaaaggaattctttattttaaaaaatgtttgctttatttaaattaaagtttcaaaaaaaaattaaaagaaaaataaatcgaaataattaattatttaaatggaaattaatttttcaatttgccttgcctctgtaaatgagcagtcgcactttggcgggcgttcggcgcagcagtgaaatggcctgttcgtgggccgtgccgcgaagtgaagtgccattgacctgtacaaaaaattcacaacttttttcaatttttaaaatacttaaacttacaaaatatttttagcttaaatttcaaaatttaaacacttttggcgcccacctccaacacttggtcgccgggcttcagacgcgcgtcgattgcggccgccccgtccgggtacacctcgtggatcacaaccgtgccaagcacctgaaacaaagtgccatcagtgtcatcatcattcttggcacaatttttaaatagataaaagtaataaataatttttattcttttttcacctaaaaattttattctttttcatcatacattaaaaaaggggggggggggggtcggtaaaaatttctgcgaagggggataggccgccgatgaccctttttttttttgcttttcaaaa

SEQ ID NO: 29981 - DNA, 1087 bp, Heterodera glycines
aaaaaaaatcgtttttttcaagtgtccgtttggggttctcaaacaattaaggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaacccgggagtatccctgcaaagtttggtacgcttctgctcaatttagcaaaaaaatatggagtgatcgaaattttcactaaaaaaagttaaagcctacatttttttggcatatttaaaaagcaattaaaaaatttttaaaatttaataattttcctgcaccgaaggtactcactcggcctcttcgcggcctcgtgggggcct

SEQ ID NO: 29982 - DNA, 932 bp, Heterodera glycines
ctagccaattccgtctcagcaaagttcaaaaatctatctcccaccttacgcaaattttctaaaaaattttgctaaacttttcaaaaaatccactattacttgaagaaaatctgctaaaaatggctcaaaatcgcaaaattggtaattttttggacagaattcgttaacaaatcgcattaaaaaaagcaaattttttgaaattttatgcaattttcgtaacaaatggcattaaaattttcaaaaattttccctggggctcctaacggcaccatcggacccccattttatcatatttttgaaaaatggagaccaaaatggcaaaaaatagtaattttttggtgaaaaacggctaaaaaattttagatttctcggttctcgattcccgagtcgagaaatttctcgggttttttggggtctcggttctcgtatcgtttcccggggtcatttctcggttctcgtatcgtttctcggggtcatttcccggtctcggttctcggtaaaaatcatttctcgcacatccctacccaccccctccctctcatttcttaaaaaggcaaggagagtcactaaaatcataaatacaatttaaattatcttgtaaaaggcaaaacagaatttagaaaacaaagatttcttctctttcttcgccatctctttttccttcttccatttcttctcttatttctttttcttttctttcttcctccgtttctctttttccttcttccatttccatttctcttccttttccttttccttctcctccctctctttttccttcttccatttccttttctcttttttctttttccatttcatctttttcattttctttttctccgttttctcctctgggttttcctctctgtccctccactttttcccgcctctcttctgccatttttcgtgcgctttcgctacaaaaattctca

SEQ ID NO: 29983 - DNA, 879 bp, Heterodera glycines
tattagtgttttattctcgctccaacagaagccaaaagttggtgtccaattcccggtagggatttaatcgtgactttcagagataccctttttttgtcaataactatttttcgtgcgttttcaaacacactattagtgctttattcagcgctacaacagaagacaaaagttggtgtccaattcccggtagggatttaatcgtgactttcagagatagccattttttgtcaataactatttttcgtgcgttttcaaacacactattagtgctttattcagcgctacaacaaaagacaaaagttgatgtccaattcccggtagggatttaatagtgactttcagagatagccattttttgtcaagaactatttttcgtgcgttttcaaacacactattagtgctttattcacgctacaacagaagacaaaagttggtgaccaattcacggtagggatttaatcgtgactttcagagatagcaattttttgtcaataactatttttgtgcgttttcaaacacactattagtgctttattcagcgctacaacagaagacaaaagttggtgtccaattcccggtagggatttaatcgtgactttcagagatagccattttttgtcaataactatttttcgtgcgttttcaaacacactattagtgctttattcagcgctacaacagaagacaaaagttggtgtccaattcccggtagggatttaatcgtgactttcagagatagccattttttgtcaataactatttttcgtgcgttttcaaacacactattagtgctttattcagcgctacaacaaaagacaaaagttgatgtccaattcccggtagggatttaatagtgactttcagagatagccatttttt

SEQ ID NO: 29984 - DNA, 1010 bp, Heterodera glycines
tagtgcttagtgatggactagcgagtgatgtccgtaggaataaaagccaaggcgtggctgcgtcctgtccactatttccctagtgcttagtgatggactagcgagtgatgtccgtaggaataaaagccaaggcgtggctgcgtcatgtccaactattccctagtgcttagtgatggactagcgagtgatgtccgtaggaataaaagccaaggcgtggctgcgtcatgtccaactattccctagtgcttagtgatggactagcgagtggtgtccgtaggaataaaagccaaggcgtagctgcgtcccgtccaactattccctagtgcttagtgatggactagcgagtgatgtccgtaggaataaaagccaaggcgtggctgcgtcatgtccaactattccctagtgcttagtgatggactagcgagtgatgtccgtaggaataaaagccaaggcgtggctgcgtcctgtccaactattccctagtgcttagtgatggactagcgagtgatgtccgtaggaataaaagccaaggcgtggctgcgtcatgtccaactattccctagtgcttagtgatggactagcgagtgatgtccgtaggaataaaagccaaggcgtggctgcgtcatgtccaactattccctagtgcttagtgatggactagcgagtggtgtccgtaggaataaaagccaaggcgtggctgcgtcatgtccaactattccctagtgcttagtgatggactagcgagtggtgtccgtaggaataaaagccaaggcgtggctgcgtcatgtccaactattccctagtgcttagtgatggactagcgagtgatgtccgtaggaataaaagccaaggcgtggctgcgtcatgtccaactattccctagtgcttagtgatggactagcgagtgatgtccgtaggaataaaagccaaggcgtggctgcgtcatgtccaactattccctagtgcttagtgatggactagcgagtgatgtccgtaggaataaagccaag

SEQ ID NO: 29985 - DNA, 1496 bp, Heterodera glycines
tatttttttaatttcaacaaaacacaaacatgattcaaaataattccattattatcgataatatgttgccatttttcaggcaaaagatcaattccaatggaaaagtatttaaggaattagagttgataaagtaaaaatggtcattttcgcgataggtatttttgatgactgaatccaccaaaatgaaaatagatacagagtcagagaaaatgtcagtatagagcaaagttaggaccataaaatatatcagggaaaaaattttaatacctaataaatgaattattggagagccgagtctgaaagtggtctccaaaaacgacattatccgagaccatcaaataaaattgttttaaaagtgaaattctgaatttaattaagctgagaaaaagatcgaaggccgacaaaacttttgttacaccctaagtaattcatttttattttaaaaaatttgcaaatggtaatattttgttcggatgttaagccatcaattggtgggcgaagttgagacgaatgtgaaggcattgaccgaagagaagcaatggcgcatcgaattggtggacgaaaagaagcgactgaggacgaacgacgtgtacaagacggaggggcacctgcacttcatccacgttcagatcaaagggaatgaatgaatgactcaagcaattaacacgctaattagcgaatgctcatttatttggtgggaatacggctgccgaatgattttcgatgattactttacatttgcttataaagtgatttgtatcatccgacgatcattaagcccctaatcactacgaacaaaatcttcactcattttctcatttcattcttccttttgagttgaccgtccgtccgcctctccgttcacttcttttgttgcacgtccataatcacgtcgtaattttcgttgtcgtacaattccaacgcaatggtcatcgcatccttgctttggcagttctaaattgccgaatttccactaatgacccaattagctaattgttcggtgagctcaccatttgtcaataattacctgccaatacccccatttgtcactaattgcctatcttatcctatacccccatttgtcaccttatccaatgtcccgatccgtcactaattgcccaccttgtccaagtcccatttgtgcgccgtctttggcgacatgcacagccacatgtccttgtccgtcttgtagaccagcacgttcatgttgaactttttcgccgccgctatcagctcgaccgtgcccccggctttgcccgcctttattttctccgcctgtctgcgcacacttcgcacttcgtattcgtccatccacggctgcgcctgctttttgtcccattgtccgaagaaactctcaaagtattcgagcacaaccatccgagtcgccttgtgaagcatttcggtgcccgtcagtgcataagccaacgctctttaaattgaaataattagcacttttggcatcaaatggttgggccgccgacctgtacaattgtcgc

SEQ ID NO: 29986 - DNA, 1745 bp, Heterodera glycines
  misc_feature (50)..(50): n is a, c, g, or t
  misc_feature (54)..(55): n is a, c, g, or t
  misc_feature (61)..(62): n is a, c, g, or t
  misc_feature (65)..(65): n is a, c, g, or t
  misc_feature (261)..(261): n is a, c, g, or t
tctaattggaggaatatcttttctattctttaagttctcacgagggaagngtannggtgtnnggnggggggtgggggccctaaaattggagaaaaatgaaaaaaaaaagatttgaaaattagagaggaattatttgatttttttgttgatgttttaaatttgaaaaaaaagtgtgtaggaataaaagatgaattaataattttttatgtgtattaaatgttgaaggtttttgagtgtatgtaataattaaataaatatttntgtgatttatttatgtatatgtttagattgaggatgttatagagtaggtgattaatggtggtggaagtgggaaggtgggtgaaggtggtggatattgtgatggtacgaaatgggtgattgagaggtgtgtagttgaagagggtgttaaagatgaatttgtgtggtgagtggtggatgtggtaagacgagagttggtaatgtatgatacgagtcacgagcactacgggaacagacacgccagcgcacattttcgaaccgcgatttggcaacggttgtgcaaagagttggactacccaaggtgaaaagagtgttttatggaagcggggaaatggataaaaatgaaaggaatttaaacggagggactgaaatggtcgaaaaaagtggtccaaagcgacggaaggggtcaaatgcgtcccaaggaatttttaaagggcattcttttttctcatatggccaaattttacaattttggcagcatttgaaagagcctacacatttaaaagctgttgaaaagttatttttctaagcgaaaagctactacatgaatgctgcaaaagtcaggattattgcatatttttatttatacttttttacatatcggcgagtttttctgattttttgaaatcaaatagagattgctaaaggcttttgaatgatgctaaatatgtaaaatttggtattctgtggagcaagttgcgacctattaaacttgtctgggatgttgttggcaggttccgaaaaacgattggaagggaatttgggtgcaaaaatgtgacggaattgggggactaaaaacagtgccattttcagatgatccgcaggcactgcaaaagcaatggaaaagcattagggacaaatacatcaaagagaagaagcggagaaaagggggcacaacaacaatgatggtaagcatttgagaggtttttaaattttgtagaaattttactgacattttcaggaccattccgaatcgacgacaaatggcacacgaaatttcaacggtaaaatggacaaaaaatattcttaattgccgcaattggttgattttcctgccatttttcaagagaccaaaacactgacaactttcaaaaattggccaatcccctccaattacattgtttttcaatttattattttttttagtgctgggttggctggacgattacatcggcgacagcgcaaacggttggccaaaatgttcactttttgttaaaattttcaaaaaaatacattcggcagaaacaatgccaaaaaatcatttaaaaatttgcccgattccacaccctacatttaattaattgaccaattaattaactattgattaattgattttccagcggtgtcctcgcgtctgtttcactctgtgccgagcaccagcggagagtcgtcgtcggcatttttgctgacgaaatcagaactcaacaacagcacactgctcaacggcggcggtgggtcgctggtgctcaaagagatggcggcggccg

SEQ ID NO: 29987 - DNA, 875 bp, Heterodera glycines
ccgggtaaatttagtccggccggtttagtcgggcctttttagtccggccggtttagttcggcccgttttagtacgaggggtcgggttaagtacgagggtcagtttaattccggcaagctgtttttttcaaaaatagatttaatgatttttccgaaaaaaattttaaaattaataacataacatatttatcaatgtgtaacaacaacaaaaaaaatagcaagcatgaaaaattacgggcgcatttcataattgcgagaaacaccaacgagcaaatgattgatgttatcgggattaacattgacattggcatggtaattgtggtcattttggcaacattgtacggacagcagcaaccatggcctgctcgaagtccaacgatatggtttcaggtgcaaaattcggccatttttggacaattagctgaagcatccgtgtgtaaatcatttcacattttgaagtgagaaggcagtacgcaattggaaaaacctatttatcacgtctaaaaagacaccaacaaaaaacgtgaaaacataggcttttactttgcgagaatagatattataagtttttccttctttataattgacaaaaaaaacatttgtaacagttatggacaaaaacagcttgccgtactaaaccgaccctcgtactaaaccggccgtactaaaccgaccctcgtactaaaacggccgtactaaaccggccgtactaaaccggccgtactaaaccgaccccgaccgaataataaagcatttttttaaatttgcgagaatagatattataagtttttccttctttataattgacaaaaaaaacatttgtaacagttatggacaaaaacagcttgccgtactaaaccgaccctcgtactaaac

SEQ ID NO: 29988 - DNA, 735 bp, Heterodera glycines
aaaacaaaaaaatagattttttcaagtgccccgtttggggtactcaaacaatatggggagcaaaaatccaacgcagaattaaagtacagcatatagggaagctattccggaaggactcggtctccccatcaatctgggcggcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaa

SEQ ID NO: 29989 - DNA, 760 bp, Heterodera glycines
acatttgggaaggcacgtccgggaaaagggacagtgggaagcaaacagctgattttgcctttggcaaagtcggctctcgcctccctcgctcctcacaaaagttttgtcgcctccttggccgcgacaaaattggagccccgtaggggtcagttgttccttgccgaaaggacctgacctccatcaatcggccgtagccgccgatcaaaaagtcttcgcccgccaaggggtgaagaacatcggctacagtcgccgatttactttctccctaccgaaagggaggaaggctcattcggccatcagcagccgactcttcgtcctgcccaaccagtggcaagacactcggccatcagcagccgattcatttagcctaacccaacaaagggaaggctcactcggccatcgtcgccgacttatttagccgaacccatcaaagggtaggcacattcggccaccagtcgccgacttcttcgtcttgcccaaccagtggcaagactcattcgactatcatataaattatagaaacaaaaataatatttagaaaattttatttaaaacgcattttaaaagatcgaaaaaatcaataattaactcaatatgaataaaaatacatactttcactttaattcatgaaaaatagtgtcaaaaagtgcgaacatgcctgcagtttatgataaattttcgcctaaaaataaataaatgaacttatctaaatttaagtaattaaaaaaagcaaataaaagttaacactgaaacggataca

SEQ ID NO: 29990 - DNA, 1369 bp, Heterodera glycines
cccaaattttaattcataaatgagttaaaaggagacgtgtttccattgccacagttctcgcttcttccgttcgatccacaacctgcttgaagcaaggttgacacacttctggtttgtgaaggcaaaattttaaaaatttgcataaagaatacgttaatcttctttattaattgctttcggacaaaccaaaaccacaattcttccatccattttcgcgcctttgtggtggtggctacgactcatatcagttggcaaaatgctcagaatgctaagtctccgaattgaactgtcgctcattgggcataataatggctttcggcctaaacaaaaagcagcttcaattaaaagaaggcaaaacctcgtctaagaataattggtaacgtccccctacttatccactgtttttttaaatataattaaactaattttaaattattttaaacacaaattatcgtgtttagtttaaacttttccagcttcaaacccggtcccgttttcaaaaaactcaaatcctgataacgatttttcaaccccggcgtcgtgtcccaatccctttttctggtcccgtttttcctcgagagtttgatcccatgtaactctctaaaaatcgtcaacggatggggcgccgttcgctcttaatttttttgctgaacaaataaacgaatgaatgctttaatattcccaaatgataatccgctggaattgaaattcttcctcaaaatttactgcatttttaattcggaaaatatttgttttgtatttgcataaattttcaatttttcagcgattgtccttttaaattgaatatttataaggacaaatgagaaccaaaatgttcaaagaaaaaaaattattaatttgataacgttcagaaaaataaattgctttttttgcaagaattttccttttttcatttattttgtttcacattataattaatgactttttgcaatgatagaagtaaactaatttctctctccaccgatatttcaaacaataaaaataaatttttattcctcctcattaaaacacttcaaaattatataaatattagcgacatgaccattaagcacaattgtactaattaactttaaatgtttgcccatttgccacttttattggccttttggtcaatttttgcctctgcccaattgcctgtgttgcccattgtcactgatttgttgcccgttgaactgttgacaaatttaactaataatggcgaatgtgcactctcgaatgagtgcaccgggggctgtgccaatgcgtcgacaattcgtccgccattaattctcggtgaatttaaaagtttggcaatggcataccaatacttttattagacattaatttttggcaaatgtttgactctaga

SEQ ID NO: 29991 - DNA, 1413 bp, Heterodera glycines
acccaattcgtactaggcaaactcgtactgccccaacttgtactgtttttcgacaaaaaaaatcgtcataactttgttaaggtcaaccaaattaaacattttctttgtatcattcaatagcccttaaaattctctctctatccacaaagttgcaaaaaatttgatcaattttgaaaaaagttatggacgaaacaaaatttaattttttttacgatttttggtcataacttttttgaaaagcaataaagtttttttttttttgcaagtaaatgcaaaactttaagggctatcgaatgatagatatcaagaatgtttaatttggttgactttgtcaagagttatgacgattttttgtcgaaaaacagtacgagttgggtgtccgtccatccgtccgtccgtcccccccccccgggggccgtagtaaaagaagatggttatttgaccaggtcattattatttaaccatggtatttaacccggtcaaataaccaccaaccatgagaaaaacggtagcaaaagaagatggtaaattttcagctggagcaaccaaccagcaaccacctttttttaaccgccaaccatcttcttttactttatcaccaactacgctaccatgaacttagtaaaatttgcactgatttttttaataaatgggcaaaataatgtttaaagtacctagaaaattggtagaataaataaaaataataattattattatttacggattaattttttgtaaatttttttattattatttaagatatttcggcatttaattcgattaaaactttacattggttttttttggcagatttttaaaggttggtggttacgactgctaccatgggtagggagggaggggcaggacaggcgctttaccatggttacatggggttaggtaaccagtaaccaccttcttttgctgtgcgttcacgaaccacccaccaaccaagggcgtagccatttttaggggtgtatttttggttttttgaaatccctatttatggggtgtattttacaaaatttttcgccgtttttcgccaaaaattaatatttttttgccattttgtcctccatttttctatggtaaaatagggaggggtccggcagtgccgacaggcgccgccgggaaaatttttgagtattttaatgcaattttgttaagaaaattgcttaaaatttcaaaaaaatttctgagaattttttactttttgggtttcgggggggctttagccccctcatcagaggttatttaaccataaccaccttcttttacaacggctcccggacgggatcggaaaattgaggtcgttatttaaaaaatcatcattatgtgcgcggccgttaaaatacaaagccctcaaaaatcaaacaaattttgcttgataactttattagaaaagctaccaaactt

SEQ ID NO: 29992 - DNA, 1134 bp, Heterodera glycines
aacccttaattttgaaacatttatttccgattggctcaccccctgtctctcacctttcgtggtgcaattgctccgtccccctgaccaaaaccgcggtgtttttgtccgttttgtgctgacgattcacctaaacttacaattaacatgcttctcgcgttattcctttttttctgacccctgcgaaatatttcttcgtcgtttccacgtcgtcgccgcgcttttttgccgcattaacctattttttaaaaaatcgaattgtaatgcgtgtgaaataggtcggttttcctcatttttcattcattccaaacacctttatcgagagcatttttcttaatcctaaaacaaaattactcacagccgcgtccgacttaagtacacgctggggcgcttggtgcttcctcagaattgtcaccgtatttgggtccgtgtccgattccattcggcccatcttcgacattttgggcgagtcacacaatataactgtcgcttgttagctaattgaaagacaataaactttgatttaaaaaattgcaaagaaaaattattgttcgaaaacaaatattgtaacttgtcaggaagaaatagcttcagaaatatttatttgataattggaaaatgaatcaatgtgctgagattgaacggccccgctcttccctccaatttcttccgacttcgttagagactgtcgacccgcgacgccaacggaccgcagatttgcggagaattaattttggcggatggaaaagatgcaattgttttatctgggagacgaccttttgacttatgcgcacgacgtggtcacctgacaacggaaaaggaaaacgcatgttttttatattcattcgtcggcatttctcacctcgccaatatttaatcagttgcaacgatttgaatgtctcaatgatgtcatccgtgtgaatgccggagaggcgcgagagttcggctaccgaaatgttggactccacctgctctcggtcgagcaccccgatgagcacccaccaccagtaggaacggtagctgactttgcccaagtcggacaacggcttctcaggagtgccgaccacaccttcgcgttccgacagacaataacctggcgaaaattttaaaactaaaggttagtttttacattaaacg

SEQ ID NO: 29993 - DNA, 1168 bp, Heterodera glycines
cgttgaagcgggaggtgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtctatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgtttgaagcggggtgatgcgaagccatagcaaaactgtattttttaa

SEQ ID NO: 29994 - DNA, 748 bp, Heterodera glycines
cctccctctctttcacctccaataacaaattccaacggcgaatgatttgtgtgcgctgtttgtcctcgaaaagctaaagcgattaaatgagcttaaatcgcccgcttcttttacactcatcctcccaatttcctcttccattcttccttcctttctcttcctttctcttctttccctttcttctcttcccctccctccctcccccccctctctctctctttctctctctctctctctcttttctctctctcctggtcctctttatctcaactattctttcttcatcggcctcccacttccatcctatattttccacttccttcctctcttactattttttcatcttcaacaagctgatgtttctcccctacttttcttccacttccctctctcctcttccctcctctctctctcttttatcatatctctcttccactacttctttcttctctatgtgccttcttcctctcccttttcattctttccttagtctgctctccttttcctttctttgcttccccttttctcttcatttttgtaacttcctcttttttttcttccattttccgtttcctattcccttcctccccctcctcttcaattcctttcttccgcattttcctttttcttccaatttcttcccttcctttgttcgtccattccgcttccctacgcccattaacaccttttcctcccgctcctcttccattttcttctccttcaaaaactgttgtggtcacaaaccgct

SEQ ID NO: 29995 - DNA, 1477 bp, Heterodera glycines
cgctaattgacaattatcctccaggcacaggcttttttattctgttttttcgtttttttcttttgcatattttttctgtatcctcttcttccaacaaattttcctttttttcaacaaaatttattttaattcctccatttttttcgtcatctcttcaaaatttttatttgaatcattaaaatgactcatcaaatattgtcttccattctttgtacatatatgtttttaatttattcccataatacttccaaattatcagttgagaattatttggctaactctcgtccaaaagtggtcaatgcggcgcagtccgtttgtcttggcattttgtcattttttgaaccccgaatttttaatgtaaaagaaaaagaagatcttccgtcaattggaccaaaatatcaaattccttaaatttcaatttgcaaaaaatgaatttttcgtaaataaatcacactgctttttcattcacacaaatttcacagtttggcgcaaatgctcggtaagaaaaatttatttaattggccgtttaaatgctttaatgggatgtataaacaaaaaatatactgtaacatacagccagtatactgttgatgataattatgaagatgaagatgaaaacgattgagttaagttgaatcaaatttctcttttataaattttaaattggtgacgaattctttttctcattgcttttgcccataattattttaagcatttgagcacttgataaataaatgtcttcaaatgtcaatctgaaagtgaagggttcgataatgaattttaaattttctgaatttactaaaagataaataataattaattttaggagttaaataataaataatctaaatgaatttgaaatttctgaattgattgaaaaattaaattaaaagataaaaataaagaaattaattaataaagaacttaaattttataaatacactactaactaatatattgtgttgtttaggattgtacttcacccggaatttgttgttaacataaaataagccaaaaaatgattgcaagttgcgtcactttgaataaattgatatggaaaaattttaaaatttcaaataaaatttatttacacatttacttcaactttttttttgtcggtattctgtgctaacaaaatttgtaggcagacagaagagtgttcgttcagctgtaatcccatgatgccaagaaaattttgaaattttttaatatttccattgtaaccgaagaatatctttgtcatatacgctctttctgtcttgacttttttggttccatccggattgtctgattttccagctttttctgatttatcttctttttaattcctaataaattcttctaaatctctattcaaaaaattcattttattgaaaatgttaaataaatttgtttcaatgaaataataaaaaggattcggcatttaaaaataaacattgaattctcattgaattctaaaaggattactcagataata

SEQ ID NO: 29996 - DNA, 554 bp, Heterodera glycines
attttcatataaaattcattaaaaattacgaaaaactttccgacggcgcaaaccggcaccgccggcccccctaaaccatggtgccgatcggtaatttttcaaaatatgaacaccaaggccgaaaaataagattttagggtcaaaataataacatttagcaacattttttcaaatcagtaaatttttacaatttatttcatcaaaatgctatcaaattttatatttttagtctcccattatcaaataaggacaaacgaggttaaaactaagattttggtcccaaaaataagactaaaaaaacggctttttacattgtaaaaacataaatgaaaattttcaaaaccagcatttagccaacaagaatcatcatttggggtcaaaatcagcactttggaaattttagtcaaaatgaaaaaaacatgcttttttgtgatgcgctttttccaaaaaaacaggggccggcggtgccgataggcgccgccgggagaattttttgaaaatttggagtttttggtagcattttttacataaaaatggccattttaaagtttttt

SEQ ID NO: 29997 - DNA, 1082 bp, Heterodera glycines
acattctcgtcccggacatttgcggccccagccaaatctgacatttgcggcgcgacttttgcgtcccggacatttgcggcccaattttttgttgaattttgcggcccaagccaaaatcggacatttgcggcttcccccaaattcatcagcatcatttttcactatttataataacaattaacaaaaattttttattttccaatgttttctcaatgcttaacgagcttacagtttaattttccgccaattttttctaatttaatgacaaattctaagaattaaaaaaaaatcgctgaaaattttttgaaaatttttttctcagaattttcaatgaaaatttttctaggattttttcttgaaaaatttctaaatttgaaaaaaaaaattttttttatttattcccggctgtgttttggggtgcaccgtcagcgatcataaaaaccggctatataataatgaagagctgtttctattctgaatatatacccctattttcattgcacagattaccatcgaaggtgacccagttccgggccatgttggtgtgccggttccatgctgtgccgtcaagttgattgatgtgcccgaactcaactattttgccaaggatggtgcgggcgaagtgtgcatcaaggggcccaacgtatttcgtggctactacaaaatggctgaacaaacggcggaaacgctggacatcgacgggtggctgcacacgggtgacattggacgatggacagaacagggaacgctcaaaattgtggaccgcaagaagcacatcttcaagttagcccaggtgagatctaacacagggaggaaaatagggggacggccttcgaagaatccctccctccctcccgaggccccccgcacccgaaattttttaaggaaaaaagtttttccttgctggtaccaccccaccccccagacagtctcacccaaattttccaaaaaaatcgctaaatttttcaaaaagcccatcattttttgatgaaaatctgctaaaaatggctcaaaatcgcaaaatgtggtcatttttttgacgaaatctgttaaaacccgcattaaaaaatgcaaaaaatttc

SEQ ID NO: 29998 - DNA, 1441 bp, Heterodera glycines
gcagcatcgcctccccctccgccaacttccgccgttcttccgccccgttcatcttccgtgccgtcccttccgtttgtcctcctcgctcttcctcctgctcgctccacattgtttgagtcgtgttcaattccaaaaatggcgtctcctcctcaaaagtaccgccattgtctaccatcctttgctgtacatgtacagctccaactcgtccttctcctctcccattttccacttgtttcaatccaatcattggctctgtccgttcctccaccaccgaccgttgccaaaccgttgtctccaccgttgaagtcgatgcctgcacttcgttgacgatgctcaccgttttggacgcattttcctccggcaaaggcatcgccactggctgctttggcatttggttgtccggcacaatcaacacaattcgttgctgctgcttttgtgctgttccttcagtaacatccagcagaacttcggcgctttcttccttctccttcaccaattcaatgccaactccgatttctctttcttcctcttcctcctcccctctctctctctccgtttctcgtccatccctctgctcctcctccatccccagtctcttccatctctcttccaccttttcgtccgttatctctctattccatctccgtttctcttccttcccctctccgtcctccaccctctctgtttctcgtccatccctctgctcttcctccattcccactctcttccaccgctcttccttctccctttctctcccactctcttcctcatccatgggctcttcctcctcctcaatcgtctcaatttcggcattcggtgcccctttgtacagcttcgtcagcatcacttcctcctccacttccacatcgatgtccggtatttcctcctcctcctcctcttcctccgcatcttccaggatgaatgtgctttccaccatctgcagggattcgtcgattgacagttggtgttcctcctctccttcatcctcttgtcggcgttgtataatgccatttatcttcggaattccgtccaatgaaacggtggtaatgatcggaatattgcgcagcacagtgccatcattagcataattaatgccaaattggccaatatcaccaaaggattgagccatttttaaagcgtgggacggctgaatcgaagagacaaaaagtcatttaagagctttggatggattttatcaaatcaattagatgacggggtcgacgaaactcggaaaagtgatcagccaacagggccaattgagcgaatttaggggaggaaccgaaaaaggaagaaggatcgttcgaatttgtataagcacaatggcttttcaaatggaattagagaccaccaccacctgcgaaatggccaagtggtggtctatggttctcagagatcggctggtcgaatgtcgccgaagggaatgggcagaaaataaaacgga

SEQ ID NO: 29999 - DNA, 1170 bp, Heterodera glycines
  misc_feature (42)..(42): n is a, c, g, or t
tcaaaagaaaagtgcaacaaaaatggaacaaagatcatttcnaggattacatgttgaatgtggttgagggtcagactgaagaagagccaacctatgaaattaaacaggtaaaatcccatatattttattatttaaaacatttttaaattcagttggaagtgaattgtggctcagttgccggcacaagtttggaccgacgcgcggcacagctgaaccatgtgatgctgaagaaggtcggatttcatgcggcaccagaagatttgccagagaattggcccgacagagcgcaaattgagtcaataaaaatggcatggtgagaggaagcatgaagaatagttaattatataaaataattagctaatttgacataaagagcgaatttttgggattatgacagtatctctcattcagggaagcatacgataaccctgacgcgattgtgctgcttacgatgtcgccgggttcgcagaccgcgttcgatgcgcgcttttttgagactgagttggaccgactctctgatgggcgcatcaaaatggtgcgcagttccatgggcgattgtgcgaggaggtggggaatgcaattaaaatatattgctaattaattaaaatggctaattgccaaagactatggatcccgcaatgggtcagcaaatttggtttttgtgcggcacccggccagagacccgcaatatgttttttttaaattgcagaaaagagatacctaatgccaaattttcaattacaataaattttccccggcgagcgagctgttggaagtgcctgactttttgaatttccaaatccacgcgggattccgaaaatttaaatgcaaaatttgcggaattttatttaaatttgctggattttgcagaattattcccgcaaaaccggtatgaaaaccaaattgagttccaatcccgtatccggatctgcaaatctaaagttcccgtctctacaaaagatgtaagctggatgagaatttcgtactgagtttggacgggcgtgaggtggcggtggtttactcgcgctattcggtgctcggcaaagtcaacgaccgggagataatgtcgataatattgaacgcccgctttacgatcgaacgctcacgcgccatcgtaaaataattaaaaatatattgtttatttaaagttaattaaaacagattccagct

SEQ ID NO: 30000 - DNA, 908 bp, Heterodera glycines
tggccgcctttcgctcaacggcactttcagactgtctcacctggatctcacgtcgttgtacaaaaagccgcttgcggcggaataaccaagcagctgaacaagcgaggaatgagtaataggccaaattaattactcgcctcgggccaaatgtccacgccgtctttaattgtctgatgttcggcatgctgttcagcggaagacgccgactgatcagtgttctgaatcggaccaaagggcttttaattaaataaataattaattgcaacgattgactctttttcctccgatcgccccgccaataattaattaattaattaaaaggcatagaacatttaatcgaccggtgcttctgatctgttaattacctcctgctcctcttgttgctgttctcgctttgcaattgcttcgaaggtgggaaacaaatcgagcgaggaaatcacttcgttggacaccacgccttggcgcactgtgccgggcatccaagtggcgaatggaatgcgaaaaccgccctcgtaggagttggacttgccacctgaatttgatcggaactcattagcaaaagcaaaatgccaatggaacctttaagtccggcggtggaaccgccgttgttgcacaattcctggtgagggccgtggtcggacatgaacatgaccaacgtgttccggtccaacccgtacttgcgcaggtcggcgatgatctgaccgactgaccacgccatttcgttgagattgtcgccgaaaaggcctgaaaatggcacaaaataatataatttaggccaatttcgcttcgaaatgcccacccctttcggattttcctttgaaattttcgttggcgaattgcgtggaatggacgtgggggtaggaaaagtaaaagaagaaaggctttgagggacgacgcaaagcgacgcc

SEQ ID NO: 30001 - DNA, 793 bp, Heterodera glycines
  misc_feature (781)..(781): n is a, c, g, or t
ttccacgtgcatcgtaaaataatttcgcccccatttttgtatttcaatgcgacttttttgtcccggcattcgtcttcaccgactgccccccggcattctttgtccacaaagtccaatttgctgcttttgtcttctcccccactcccatcggcgctgccatcggacgattggccttcaatttaaaatttaaaaaattaaattgcattataatcaatttgatatggatggacagaagtcgaaattaaagtgactttttaatggggcataaatctttcggcacttaaacaacgacgaacaataaagtcaaaggttgctctcggacctttcgggggtgaaaatcttaggagatttcaatgtatcagtgctcatggatttgggtcgggaaagacgccatcggggagatgaggtcagggaaaaccctgaaaaaatccaaaaaataatctaataaatttttgagcgattgtttttctataataataaatcattacgtattgcgttagcactaattaccttccatcctttggtattttaatgcttttgctccacaaatcattccccgcacttttggagggaattgtgcggtgaaaagcagcagaaaaaccgcaaaaacggagcaaagcgaaaggaaattgggcaacatttaatattttattaaaaaaataattaataaaaaaataaagaaatgtttaaatatttacgtatattaaataacaaatgaattcatttttctcgacaaatttatgaacggaaataataagtaataattttgtttggatatganagaacattcata

SEQ ID NO: 30002 - DNA, 2130 bp, Heterodera glycines
tatatgagtgcatctgcaattgtatcgacagcgacctgttttgaagtcaacaatgggatagcgtcatcaccagcgctaattttgctccttttcggcctagctctatcaagatcacttttcatgttcaaatactctctctgtgcatgttttcgcgccgcgttcattgctcttttgtagctttgctgagcatcgtgaacctggttagacaaatgctcactactaatatccaaaaggctgtacaaacttttgctcaactcataggggcgtataatgtttgatgatgggactgggatggtcaccacatttccggttttccattcaagctctataaactggtcttcagtggtgcccaatgatggccatgagtgagggtatattatggtagctaggcccacatcccattccgaattaaattgtatttttcgtggtagtcgcacacggaaagagttcgtccggttcccttcaacgttcgtgttcgagggaacaacaacataaaaagaatttgacgaaatggtggacatttttttgttttatcatttttccctatatatttatatatttttatgggtgattgaactgattggaatccagctgttatgctgtttgttataacctttccacttcacatatgcatactctacaccatcctttttctttttcctcaacactttctcaatgtcatataatttttcaccatcctggtgggtgtttttgcggacgcgacatagatccgaagcataaaaacgacctttgatcagttcattatccgcatctctgattcggtatgtgacaggtgaacggccttcatccgcactgtcaaccttgaatatttcgctcgtaaaacggccaacataacccttctggaacacatgtttatgtttttcaatgcgaaccagatcccctacatggaaacgaggcagacgttttggtctactcatagctgcctcattggctaatttctctcttagcgtgtccgcattccgaaatgtaacgtcaactgggcgcatttgaattgatgaattgtatgaatggttaattccattcacaatatcctggatgacatccaaccatcgttgggtttgacgcgccgtaaaataacgaaataatcgttccttaattgttcgatttgctctttctgctataccagcatgaaattgtggggacgtgtacatgcaaaaatgcttgacattctttgaatcgaaatatgtttgcatgcgtttggcggtgaactcgaggccttggtccgttaccaacttccatggaatatatttggaatgggcaaacagcctatcaaatgcatgaaccatgtcctcactttttttactttttactggctcaacaaacaactgtctactcagagtatcaacacaaaccaacaaataacggaaccccttattttgcggggctaaacggtcaaaaactgcaagatcggcttgccaatcggtatgtagacccgaagcaagcgtaggcaaacgtttgaaccgtctaatagcttgacgatgcatagtgtagctgggctgttcagccaaatattcttccacatccctgcgcttgatcgaactgtttgttttccgcgcctcattcaacaatggaaccatgcttgtatagctgaccggcgaatttatatctttgtaaaggtggtccaaaatggttcgcttctttttttctaataccataatgatggcttaaaattgacaaaactctttatccccttttcacactttttattctctttgaaaccaattaaactcccaactccactcccaaactgataaggtctgtcggaaaccaaatttgttttaagataatcatcctggtatgccctatccaaaaaatcttttaatccaactggaaaatttttaaagcgagcgatacccgtgctgatgttctggttcaatagataggacacaatttgttcaatattacttgttttgtatgttgacggtgtttgtgaccctacctcactggttgaaacccttctcaaaatcttcccatccgcagtaacacctagggcttccgcattctttttaatatgctctaatattgcgacgagtttttggttcggtgcgtttttgctttttttagtgcttttttgagggtcttcaccctcagcggcggaacccgacctta

SEQ ID NO: 30003 - DNA, 622 bp, Heterodera glycines
ggtacgaaaacggccgcgaacgaaaacgcccccgtacgaaaccggcggtacgaaaacggccccgtacgaaaacggcggtacgaaaacggcggtacgaaaatggcggtacgaaaacggcggttcgaaaatggcggtacgaaaacgtccccggtacgaaaatggcggtacgaaaacggcggtacgaaaacggcggtacgaaaacggccccggtacgaaaacggcggtacgaaaacggcggtacgaaaatggcggtacgaaaacggcggtacgaaaatggcggtacgaaaacgtccacggtacgaaaacggcggtacgaaaacggcggtacgaaaacggcggtacgaaaacgtccccgtacgaaaacgtcccccgtacgaaaacggcggtacgaaaacggcggtacgaaaacggcggtacgaaaatggcggtacgaaaacggcggtacgaaaacggcggtacgaaaatggcggtacgaaaacgaccctgaccgcatttttgattaaataaattgtaaaaagaactgatttgaagcaattttacaaaatgttctgatttttgaccccaaaatctgattttttgagcccgatgttctaattttgaaaaatttgcgatcgcatccctg

SEQ ID NO: 30004 - DNA, 1323 bp, Heterodera glycines
  misc_feature (149)..(149): n is a, c, g, or t
ctatttttcgactcaagactctcgaatgtcacgctaattacgatgagttatcaaaggacccaacgaccttttttccatgtcgctgcaattagcggttgccgagtagtcacgtgtcagcaaattaaagaattgaattttgtttcttctanaatgacccaaacccaatttaaactttggattggtttaaggttttatgttgcaaatttgactctattacagttcgtacgatttatgccgcaaattttaggtgttcactatagacatcatacaactattcagcctcaggcctagattttcctgaacctggacccacccttgttaaactcccgatcccgctcccggaatttttttttaccggtctctaaatttttgttatgtatgtacataattcacgaaggaagaaaaacaatgtccgacgagtggggtggaaatgaaagtggatttcgaaagactgaacatgttgcgaactgatttgtgagaaaacaaaggaaagaaaatttgcttaatcgtattgtgtgaacgatgaaacgaaagggaaaaaatagcacaagggaatgagaaagaaaggaatttgtatgaccattccgccattccctgctcattcggctatttcaaatgcatagaaagaaagcattattcactaacaaagttggtgggcagacggtgagacagatatcgattgattgagcaaaagagcaattgggcacagaagaagcagtagcaagtacatacgcatatgtctgtatgtattttgaacattgttttggtgtttttagaaataaagggctaaaaattcccaggcatatgtaatcgatgcgattaaaatttttacgataaatttcatatttttaaagaacaaatacatatataaatattataacgcagcatactgcaacatcatttgctgtacaataagaaaaaacaatttcaaaaaaatgaaattgataatttatctagtcaaaaagcatcatcagcagaaaacaaaaaacaaactcattgattgatcaatgatcaattaaggtggatgcaattaattaattgtttaattaatgatctctgattacggtaatcactcgttttttcttttgcctttctctggaacaattaaatttgttagagggcaaagagtagaaaattaaacagtaaaaaaagaaagaaacaaatttaattaggtaattattagggagtccaattatatgcacatgcatatttttttcctggactgtgggaggcctgaaacgcacgaaaaacatgtttttagcgtgttttgaagcttctaggatgactttccataatgcatgttttgcatatttgtgcatattt

SEQ ID NO: 30005 - DNA, 1767 bp, Heterodera glycines
  misc_feature (10)..(12): n is a, c, g, or t
gcatgcctgnnncaggtcaattgaactgggagcaaaaagcaccgttgccaactccatcctcccatgttttggtcgaccaaaaaagggaaggcgacgactctgtcgaggcaaacgacgaattgcaaattgggcaaccgatggtggtcgaatttgcacttcaaccgaaaacgggtggcaaaaagcaacaaataatgaaataataatttaattttccaaaattaaattttaacttatcatttattattttaagaggcattcggatttctggtcaaaaattgcgtcgtgaaagatgcgttgcgcggaattgagcacgaagtgattgacagttttgggcgagtgtaaaatcccaaaaattaaattaaaatgaataattcgcaattcaaaatttccatttgcactttttgtttaagttgttccaccgatttgaacatctttggtcatttccgttatgacacttatgtaaacaattgcattcattggcatttccttcgatttccccttaatcccccccttccccccttttcagaatgacattgcccgtgcccattggcatgccttcaaactgccggatcagtccgaattggcactaaaatgcagtgtcctcatctgcaccgatttggccgatccttcggaagtgcccttcgtcgttggctgtgccgcccttccgtcggtcggtgccattctctccaacaaatgatttgtccccgtgccctttctctttctcagcctccgttctgtcccgatttggccacttcgccctccgattcggtgctcgccgacctttcccccgcttcttttgcccgtcggctgaggcgaacgaatttcgtcgtcggcggcatttttaatacgacggtggccaattggtcgtcgccggcacagcgccgagtgcgcacttccctttgtgtcggcaatgaaagtgactcaaatgatggtacacagttttgcctccgttttttggcggaagccgctgaaaatttgagcaaagggcgcggcggaggtggcaaaagcggggaaatacaatattaattttgtttcggtgtttttattcctatattagtgctattcgagacggaaacttgtgaccccgagattattttattttttaaattttaccaaaaagcaacctttaggaatttaaaaagtctcggtttcaagtcgggactcgaaaacaacactaggctttatcctttgaaaaaaactaattttttggggtaatttatccattcaatattttctatgcaaacattcatagagagtccttccttaattaagtttagttgctcaaaaatcactcattgattaaagctttttgaaaaacccccataaatcaaattgaatttattccaaaaagttaaaaaatcgaaataaataatgaaaatacttcaaattaaatttaaaataatttgcttttcagtcccttctgctgctaatcatcgctttttggctccgtcagcttttctctgctcattctctgtctttgctttgttctgttctttcgctgttaaaaattgcgcgaaatttattttctcagaaaaatcggaaaagaaacggaggacaaaaataattaaatctcattaaattatttgtttaaatattattgtgtttataatcaatcccaaattaaaacttcaaaattcgaatttcgaaaaagtgccaaaatatttattcttatttagcggtaattatgacaatgcctttgtcgtcccattaatgtgccaaatggtccctcaaagatgcaatcatttggcccatcattcactcatttat

SEQ ID NO: 30006 - DNA, 1433 bp, Heterodera glycines
gtttccctgtaccaggtctgctgatctgtgccgtgttgcactcgggggatcctttatatcccccctccccctcttctccctcccctttttctctttcatttccttttcatttattttgccttcgtccctttcaaaggtccgtcaccgttttgccactctatcaaatgtctccgctttttcttcctcctctcccttcgacggtcacttctcttctccaacaatggccaactctctgtcgccccattggtccccgcagcaaattcgacgaaatactgccgttcatcgacttaatcgaatgggatattcgcaggaagtgcctgacagggttaacggaatggcacagcgaaggtcaacgcttttgaggatgcgggagagatcgttggggtgggacggcgaaagggcgggcacggcattatgagagacaaaagggggagcagaattgctttttcattttcttaaaatatgtcgggaaatgctttctcggcactttccaaataattcccccttttttcctttttgctccgattgttcttctctttcttcttcgttcctttcttttgttggtgacccttttgcctttttctttttcctcgacaattaatttccctttcccttctcttttattacgcaattgtcctcctttttcctttttgtcctaaatttccttttttcattcattgactgacatagtttaaataaagaaaaaacgaagggaggccaagaaaagacaatggaaggaaaagaaattaaatgggagggagggaactaaaaaaggagcagcagaaagaggggggaggagaaagtgaaatgatttggaggagaggggggagagattgggaagagagtgaaacgattgggaggagaggcaggagagtgattgggcggggggggggcagcgactgctgggccattacgcttaccactcggtccgttcgttgtcctccccttgcaagttgcaacttgccagtcgatctttgggcaggttcttctcccttttgggcgtcccttcccttttgtgtcccctccctttcccttgggcattcacttcgccccctccttccgtccccccctttctgtcccccatttcgctcttccgccgtccttttcaaatgtcccctcttctgtcccttcttgccctcttcgccgtttccttagacttttgtttcgcttggcctgatggtgctccatgtctgcgcactgtttaggactctatgaaccctctggaggctgtcgaacaccaaggcggactccaactttcggtaccaatgccaaaccctccccccacctcctcctcctccctccgtccgtccttttccccctccctctcgacttgcaggagccacccttctccatcgaagtggactcacagtgttacacagcgggacggcctctctctcgtgggttcatcgcgaaatgcggaccatcgtactcat

SEQ ID NO: 30007 - DNA, 1590 bp, Heterodera glycines
  misc_feature (1477)..(1477): n is a, c, g, or t
cttatttccagaaaatctcgcatgaattctcattttcatattttttatagatttttaaatgtttggattttttttggcttaccaaaacttcatcgaacctggttctttctattctctttcaaatcgccccaaattttttttacagcttaactaggcgatattaagcttatttccagaaaatctcgcatgaattctcatttttatttttttaatagatttttaaatgtttggatttttttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaatttttaatagatttttaaatgtttggatttttttttggcttaccaaaacttcatcgaacctggttctttctattctctttcaaatcgccccaaattttttttacagcttaacaaggccctattaagcttatttccagaaaatctcgcatgaattctcatttttaaattttttatagatttttaaatgtttggattttttttggcttaccaaaacttcatcgaacctggttctttctattctctttcaaatcgccccaaatttttttttacagcttaactaggccctattaagcttatttccagaaaatctcgcatgaattctcatttaaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaaatttaattttctatgaatttttaaagttttttgaaatttttttaagtgcaaaaagtggtggtgtctgcaaaaaattttcaccgggtttaaaaaatctangaaaattagtaagcatttgtagtggtccgatacgtatccctgcaaaaatgggtgagcccctgatcaatacaaattatttatggacgatcaattttttagaaatttttatttat

SEQ ID NO: 30008 - DNA, 1330 bp, Heterodera glycines
tctagagtccgacttcctgaaactgctccaagcccaagggttcgacgtgtacgagaaatgcgtggagaatccgtccacaatgcggctgatgtccatccgagaggctgtcgagtctggcttgttcgacgtgaccagcggcgagctgatcaacccaatttccggtcggcattatcccgtgcagcgtgctgtgcaaatgcgactagtacaaacaacgccggaacgtgcacaacagttggaggacgcgttggcccaagcgcaacaacaacatgcgcacattgtgcagccgctgcagaaacggccaagcggtcaattctcgccgagcagcattagcttgggtagcggtggcggcggcggtgtgatcgccggtccagcaggcggtgccgagcacggctacagtagttactcccagcggcgctcgtcctacggtgttggcgacgggtatccatcataagcatttcatttagtttacttttctcgctggcactcaaattttagcgattggggagccgaatctcgaagccttttatacagtagccatggtgttagactaaggtagtggcaattaccgtcctttccagtatgattactgtagcggtcttgacttccatttcgaattgagtggcagcgagtaggaacaaaaaatcaaccaatccaaggataatcaatttgactcataacttaacaaagcagcgaattgatgtgtttttttacagtaattaccgtaaaaaatcatacaccgtaatcaaaaataaataaataatgattcaaattttaaattgccgagtttgatcaaaagatttcaaatttagtgcacatatattgagagtaaaattcataccgtacccattatcttaaataaatagattggtacgtgtaaaattttattgccgtacacactcattctcctattcaatcgaacccttttttgcgctacagtcaaccgatgtcgccgctgaacggtcgacactcgtggtcgtcgcgcaacatctcctggcgcggcccggataccaccgaacttcgcgcgcaccccgaaattgtcgacgtacgtcacgcatcggttgagcgaggtgccaatggcgtgccgcccggcatggacaaggatgacttccaccgcgagtttgacgagttccgccgcgacgcgtcgcctacgggcggccggccgccgatgaacacgcaacgcacgcgcacctttgtgtcgccagacggacgaacgcgcaccaccacgcactacagtcaccagcgaagcgagtactgagccgagccgagagagtgacgaaagtcatacacatcaccattatcatcaaaacatcgcctgaggccatcatcatta

SEQ ID NO: 30009 - DNA, 2232 bp, Heterodera glycines
  misc_feature (442)..(442): n is a, c, g, or t
  misc_feature (514)..(514): n is a, c, g, or t
ccctgaagacaaaaaaaagcgattttttcaagtgtccggtttggggtactcaaacaattacggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaaattttttggataaaaattatttaaatgaactgactagataatatttaaaatagggtatttctcttcctttcagtattccctgcaaagttggntgcgctcctgatcagttttctgaaaaaaaagtaaagcctaaaactttttggcctgtttaaaaaaggaattanaaattttaaaaaatttattcatctccctttttgatagaaaagcatcaaaggggctaaactaacctggaaataaaatttgggggggtttcaaaaccctttctgaaaaaaaattttaaaaataatttttgaaaaaaaaaaaaaaaaaaaaaaaaaatccaatttttcaaaaattttttttgggccagtaaccccggggcccttttcggggaaaaaaaacccttttccgggggaaatcccccccaaaattttgggccccttttctcttttttttaaaaaaatttaggggggtgtgaatttttttccaaaaaaaaaaaaaccccttttttttttttttttttttaaaaaaaaaaaaaaaaaattttttaattttaaattttttttttccccaagaaactcccccctcccttttccccccgggggggggggcccccccccccccccccccaaaaaaaaaaaaaaaaaaaaaaaaaaaaaaaaaaaaaaaaaaaaaataattaaaaaaaaaaaaaaaaaaaaaaaaaaaattttgtttttttaatcccggggggggggggggggggtggggggggggggaaaaaaaaaaagggttttttgcccgggaaaaaaaaaaaattttccaaaaaaaattaaacaaatccaaaaaaaacccctttaaagccaaaaaaaaaataccccataaagccaaaaggggtaaaatcccggggaaaaaaaaaaggaacccccgaaaaaaaggtggcaattatgaaaacacagaaaaatccggcggaggacttttaatgatttgacccccatgaagggcttttttgggaaacaaatgggctccattcaaatcccatttattttcacatttaccctcaattttgtgaacattttttaaaaaatttattcgtacaatgaggcaaataaaatttgtccttcaatttcggactcattttaagttttaggcttatatttttagtgatatcatttacctattttccctaccaccagggtttcattaaaaaattttttgttggattttcaacaattttttatattattttcccatttttgaaaaaatttcgtcccacataattttttgctaataggcattaactacgcggtacaggactaacttaacctgcaaatatttcaacccttattagttttaaaaaatttttcaaaattctgagttttttttatttatgccaaaaaaattatcaaaaaaatgttttccatttttgactttgacagtgtaattaaaacaattatccgcaatgtaaccctcatttatttgagcatattagcgttagttaattgataagttccggctcattaaactttctcattaaattttaaaatattttaaattgtaactttctcaaacaaccaaacaaaaaaacttgctgccactcattagtatgtaattaccagcgccaaaaagtgcaatggcaatggcaatttccgtttgccaatgtttcgcccttagcctttttaattaatgggaaatgctttttctcccatcccactttttggtgggcttctcgatccccccccccgctttttggtccaattttctctctctctctctctctcccctcacctctctcttccgtctctctctcttccctctgtctctttccccctctctttctcgtctccctgtctcactccctctctcttctctctctctctctctctctctctctctctctcccctcatctctctctctcctctc

SEQ ID NO: 30010 - DNA, 1437 bp, Heterodera glycines
aaacagaatcgcaatgtaggccagatggaaccaacaggtaaaggacaaatacgaaaataattaaaatttaatttatttatttaaatttaggcaaaaaatagcatttctttattgtccgaattcgctgagaggcaaattcgtccgaccgctgaaagtcgaaaataaaagaaggaattaagaaataaaatttaaatatttaatttaaaaaagaatggttaaatataataaacattttaaacaattttaaaaatttatgaaagaattttatttagaaacaaatccgagtggtggtccatcctaggttttctgtttattaggaagattaattcttttgtttgaataattcaaattttatggacccaatcatttttatcacttttttaaaattctatcatgacttctacgagtgaaaaaactcatattaaaagcgattttggacatatgtttggaaaaataatttttgttttctaaattgtttctaatgacaacagaatgtgaaggcgttactcatcattaagaggagttgctcaaaatttgctaatttttttttagaatttttctaaagaaaacaaacttgaaaatataaccttcattaatttgtaagagcaattgctgaaatttttgctacgtctcacattgtttaatttttaagatcatttattctgctcaaaattgaaagttgacttttattttgcttctcataacaattaagtcaattaattgccataatacattggcatttcgggttcaaatcgggttcaaaattggaccaaactcgaaaaatgcctctcctttcactgtttcgctgcttgcgttttgcgtcgcgcttccttttgtgccgttggaagcattgcgcagctgccggccgggcccgagcagtaccaccggcggccgaatgagtgcacttccatggcacattcgcccggcttcaacgggttgccacagtagccacaattgaagcatttgttgtgcactgaaatgattttgtaaaaaagcagaattatttacagtatttcaatgtagggcattttggagataaaaaaagtgaaatgaaataaatgtttttgaaattaagcggtcgcttcaaagagaaatatttaatttttcacaagaaactttaatttcatccaaatttctcttttaaccattttcaataacattggacaagtttttaaattttgaccaaataagtaataattacatgtgaccctgtcgatcatcattttgtcggccaattgtaccaaattgccacaaattacgcactttttcaattccgggtcacctccactcccaaaatacattgtgaatgaacaaacaatgcaattttatttaaatactgaattttgcttaataatttaatcagatttgtcatattattaatttagctgtatttagcttacgcataaattgttaaaaagaaaaatttatgaaaaagaa

SEQ ID NO: 30011 - DNA, 1541 bp, Heterodera glycines
  misc_feature (1503)..(1503): n is a, c, g, or t
aaaatgccaataattaaaatgggatccatgtacaaaaatccccattactatcttggcaaaaaatcttagattaaagttaataaaaacaaaaacgccatacaaatgacataattagtagggctgagaattttatataagataataattgcaaaatatgtaaaataaaattttaaaatggttattttttggaaaaataacttcataaagggtgaaatatgcacaaaatgtcataaaaatgaacaaaatagacttgaaacatattttatttagcaaaataaaaacccaaataataaaaaaaataaagaaaatcatcaaaacgtttctagggaagccagatgtgaaatgatctgcttcgttgacacaaatcacaaattttgatttttgtttttccaatttctgagagtgcgttcagagatttccaataattcagcaatttctttatcaagcaaagaaggattcgcttttttcatttgataataaattgtcattttactcattttttcttcattcgaaaagcgatttccacctaaatattaaaaattaaaacaaataaacaataatttatttatttattcaaatttactttttctcatttcaatgccaaattcccttttcaattttctaaacatttctttaccaatgcccaactctttcacaaattgtttctgttttccaatttcgaacattcttttaagctcatcacttcgctgaataaattccttccttttcatttcataataatttttatctttttttatattgaatccaaattcttttttccatttgaaaattttctttcgactaattcccaattttttacaaattttttgttcaattttattcttaatttttgccgaatatttcccgcttttcttaattccttcttttactgcgtggtatttgttaacatttcgcgtttttgttgatcatcacattgattggcattcagataattgacaatggaagctaaatcattttgctcattttgaatttccatgttttcccatttttggccaaatatttcatcaaaaattggccgtatttttgaattaattttattcaattgaacagacgaagcgttgattattaaattgtttatgaataataaaataaaacttaaaatataaaaattcatgtttacaaagattatgtttttgatttctaaacagttaaaaatatgatcaaaattaaaaataagaataataatgatataatggtagtttttaatttgaatgattattttaaaattttttttcaaaaaatctaacattaatataaagatacccccattttcgtaaatttttacacttcctgtgaactgttcgagctgaaattttaactatagctgcaactttgaaatttcaactaggtaagtgaaaacaattcctattttattcctcagtaaatggagtcaaagagaccaatcttcaatttccaattttatcaatttctgtttcaaatttttgcgaaaaatatttaagtttttttaaatggtaaaatgcngtgcattatccctcaaaatttgtgttaagtcatttttc

SEQ ID NO: 30012 - DNA, 1019 bp, Heterodera glycines
atttttacatatttcggtacatattttggactttttcggactttttcttatatttttttttacatattttgaggattttttacaaaatttttggaaatccccccaaaaaatccaaaatttcggcacatttttagtacatattttcatatattttttttcatattttgagaatttttgaaagtttataaaatttcttgtgaaaaaataaaaattaaccaaaaattaatttttaaaatactaaagatgattttatgcctatttaggtcatttttatggcattttatgcgtatttcaccctttccaacgaattttttccaaaaaatatccatttaaaaattttatttacatatttggtacatattttaagttttttttttgtagatattttgggaatttttttttttacatatttatgtacatattttgatcattgtacaaatttttgacatccctattaattacattaaataccatttgtatttaaaccgtggccaaacaatatacgaaattgtttcttgaacatgttgcgatattcagtgctgaatttaaaaaaagtatttaaaaataatttagatcaaaaataatactgtattaattaaattaatggatgacggacgacctattaaagtaaagaacaacagcgtttgatcctgccgctgcattcaacagaatgccagcaataaaaccgaattgccacgctcggattggtgagcttaaaattttaagcaaaaaatttcaaattatttaaaattttatatttcatcgttaccctaacattgggccgattgcttgaagaatttgaaacattgccagagtaaagaaataccctccaatgtttattgctaaaatgatgactaatgaccgtaacaggcgggtgctcgtctgttgtgatactgtaagagcatttttgaatttggtaaatgccaataaatttagcgccatttaggcaatttgcaaaaaataccctccgtttttgcatcggatgatcaaaaaaatggctacgtaacagcagacactgc

SEQ ID NO: 30013 - DNA, 1502 bp, Heterodera glycines
agatcaattcataaattataatgtgttttttatataattaatatacaaaatattttacaaaaaaattaacgtgaaattgaagcaaattccgcacaaaactagacatttacatttaaatatgtaaacaatttattattcaattaaccaaaattactaataaaatggctctattccattaataaaaattccgttttctattaaaccaaagcaataataaaaatgaaaaataaaatttaaaaattaaaatttgttaaaagggaaagaaaaatttgaattaaaatttaaataataattatcattttacttttttaacgaaatttattaataaatttattaatttcatttaaaaaacttacataaaaaagactgggtggtgctggatgttggtcaaaaaccataaaaacaacattaaaaaagattgtgattcttatgaaattatataataaatgtaattttaaatcattaattaataattttattattataataaaactgccaataatttaaaaaatatataataatagtttgtgttaattcaggtaaaattataatgtcaaaatacatttacaattaattctctttaaaataaaacttttattcttttatagtcatattttaaacaagaaatattcataaaccttaataaaattattttataaataataaaagaaaaggaatgaaataaatgttaaaaaagttgattaacaataataatatgtataatataataaaaaaatttatcaaatttttaacaaattcttatgcactgcaaatgcaggtaattttctgagtcataaaatttttgtaatttaattcgttaaaattatttatgtttaaattaccaaaatttgattttaaaaaaatattttattaaaaattggatttgaaatttttttgaaaaagttttttaagaacaaaaagctaaaatctcttataaattcaaaaaaatatattaaaataaaaggtacaatattaaaatatttatttaagctcttgaatgaataatttaacaatttttaattgttggcaacaaaatgaatgaagcaaaacaattttttttaatttcttgacaaaaatctcattgcagcataaaaactaattaatagagcaaaatccaatggaaataaaaaatggcatattctcaggaatctaaaagaatacatattttaaattgaaattaccaacataaaagtttgtaaggcgtaaaagggattagccaatcacgggaagggaccgccccgtagggatctcgccagagggcccctttataagctcgggattcccttcccacaacacacaacatctcagtcgcgaccatcagctacatatcgatgaattcttttgatattttgtatataaattaaaactattaattactaaagaagaattaaaataattgctaaaagtaaaaataaatgatttaataaaataaaatagagacacttgagcagaatatactttgcagaaaaatttttaacttttgtaaattatttttataaaaa

SEQ ID NO: 30014 - DNA, 1155 bp, Heterodera glycines
  misc_feature (10)..(10): n is a, c, g, or t
tttatgaganataatgttgggctgtgaaaaatttaattaaaaaatataaatttccgagaaattaatcttttttttttaaaaaattcatccttttctgttaagcttactaatatgatcagctaaatgggaaaacaatcttttaaacattaattttcagtatgaaatcaggcgccgcattggcgcctctacttgcccggcatccgttgggtataaaaatttttttaataagaaatgtttcttcgtaaattaatttgttcaatacagtatgccataggttattttcaaaccaagttcggttcgcttacaagtaaatgttttttgccagtaaatatttttggctcttttttttgttttggtatattaatgaaagcgattatagttatttttgaaaaaaatctcatcaaaatcccacttatattaagttgttttttttttgaaattattgcttgttttaatctctttttctccatttgaaattttacaaataaaatcaagaatttctcttcaaataattcaaaattaccttttttgatggaaaatataaaaaaaattcgcttcaatttctttttttttgaaaatataattaaagaatttttcaaattttttatttcatgaataaatcagttgaaatgaacaatttataatttcaaaagaattttctcatcttataattattaaatttattaccagaaaatttgagaaatttgaataaaataatcgctcaattaacattgtgtgagctaaaataatttttaatttaataaataaatttaaattagggcattaaattatgctattcttgaacacaaaagcgggcggctcaactgtagccaatctgttgttcaacaaaacgcttcgcatactgtactgcctcagttacggtatgtccacgggccaaatacactgccattgcagatgataagcgacaaccggtgccgtgggcaattttggcattgacattaagccgttttccgcgaaaaaactcttcggcaccgtccgatttgaacaaaatgtccgtgctttgatcactgttagtcaaatgtcctcctgaaaagataactcaattaaaatgaaataaaaataataatatgcctttcaacaaaactgctttagcgacaaatttgccctaattcatggcattgttgaagcatttcg

SEQ ID NO: 30015 - DNA, 1687 bp, Heterodera glycines
  misc_feature (115)..(115): n is a, c, g, or t
ccccccccccccctcagcagggttttgttctggatgattcgttttgcattaattcaattcgcttcttctcattaatttcattttgtttcttccggtcatcgcttccattcttttntaaggaaggaattcgctcttttgccgctctctcttctctttgctagataataataatttcttaaataacggaattcagcccaaaaggcacttacttcaatgagtgaagggagccgtaaaagggagcaaaattctacagaaaatttccgaaataatcaaaaggaagaaagggccttctcatatcttaaccaaaatattttaataataattctttcccgtctttttatgcttttcatccttgatagagatcgaaattttgaacttaacaaaacttgaagataacacgcaatgtgttcgcttcatctgttaggtattcttgtaattcttggccatttgtttttaactaatcgatgatgtgaattaagaatattgatgcattaaaatatggcttcctgagttgtagcccattttctcaaatggtctctgtgttttagaaggtctaaacatcggtgggcttttcgagaaactacagtatatgtctgctttgacgaattacacgttactataaataataacaaaatgccaatattttaaattaaatttcttaaattctaatttaaaatttaaaatacatacacaaatcgtttatttcttttgtattcaaatcgtttaaaatcaaaacaaatggtaatttacatataatttgttgctttaaaaacttaaatattttagcctcaaaacgagcatattgaactacacagaaaacgccatgggcgaaaattggatcacgaagagcgcacgtgagtaaattatgcaaataacttaatttgattattcatttttatactattccttttgatttaatcaggcgaaagaaactggccagagctgttcatgaccgttcaaaagtggccaagaaattgcggaaagggaaggcgaagttgtaccacaagaagagatatgcggagaaggttgcttcttgtcttactttaaaactaaagaaaaagttaaggtccaaatgcgaaaattgatcaaacaacacgaggagaagaagcaaaaggggacgacggacactcaaacggagggagcagtccccgcctatttgttggaccggcaaaaggaaacggcggggaaggcactttcgactgccatcaaacagaaacggaaggaaaaagcggtaaggaaataggcaaatgctcattggcatttctatcatttacacatttaaggcaaagtaccaagtgcctttgccaaaagtgagggcggtcagcgacgcggaggccttcaaagttgtcaatacgggaaaaactagacgaaaagggtggaaaaggatggtcaccaaagtcactttcgtcggcgaaacattcacacggaaaccggcaaaattcgaacgattcattcgtccgatgggtctccgttttaaaaaggtgtgatttttgtaatctttgctttcatttgttttaaactattttgtaagttaatttaggcttaagatggttcaatgttttggtttttgtcctttcctttccatcaaatgactttttaaaatatacaaaatgttcaggcacatgtcacccatcctgaactgaagacaactttttgccttccgttggttggcgtcaaaaagaaccct

SEQ ID NO: 30016 - DNA, 1296 bp, Heterodera glycines
aaaaaagcgtaacgtttcgcgatgactcataatgtcacaaccgcaatctttaacgaaaattcaaaaaatgtttgaccgtcgatcccccccccccaaccaagggcatttttggctttgttgtggtgggtccggcaactttacaatttgttacggttgggcacccgccgagtcgaaaaccgactcaatttggctcgagtatccaggttgaactcttgttagtgtgccacccaaacattgcaataaaaaaaacgtacttgtgaccggcgacgtgaccaccagaatcagacagtagaacaaatagtgagccgagtcctcacggacgagcagtgccaaaaagtgttggctgaacattggcacctccacgccgcgcatgcgatggtgcaaacggaaggcattggtcgcggcagctgaacgcgacaaaaaacatgcatatgtttattacattttcacttaaaaagaaattaggctgatgattttttgttgttgctttaaatagatgccatattcgtggtcatcgacctcgaaaacccatggatattcatcattatgggtataaaaacaaattattgctgaaaatgggatgaaaactgtgtgtgttgtgccgaacctgcagcgattgcctttgtgaacgccattttctgagcggacggagacgcaacggacagcgcataatttagggcaaagtaaagggtggccaaacgaagggcgaaacaaagtgtgtcaatttgattccgttttagaaagtcctagaaggaaaagatttaaatcaaatgacaaatttatgacagcgtttgcttggctctattgtaacttaggcgtcgaaatagtgaccgtcctcagtttcttaggtcataatcttgaatatacgaaaatgaagaatttcagttttatccattgcgcaatttctattttatttttttcttgtttttataaattccataaattttaagggtattaccactttaagctttctcaagaattttgggttttgtagcatatgaaactgaggatacctagttaccgattggaagcgtaaattggtaatagagtcttttgctttaccaaggctgtggtccggggaccgttagcgttttgctgagatgggtttcctccttctgaatttgttggctgctgctgcccttgcggttgttcgttgttttcttctcgaatttcaaccattgctttttgtatcaaaatgttttcaaaaaatttggaaatccttacggcgagtcaattttgggcccccagtgaaaataaatttattatttatttagtaatcagaacgccaaaactttg

SEQ ID NO: 30017 - DNA, 981 bp, Heterodera glycines
tccgtctgctgatgatcatcagcaaagagaagaggaccctttaattaacagcagcagcagctgaacaatacgcaatacgatgctgcattgtgagattatgctaatttatgggcagataaagcggaggaaaaaggagaagcaaaaggatgccctgaggggaggaaaaggggggggggggaagaggaattaggaggaaagagcacaacgagacaatatgaatgatcagcagcaacaacaacaggaaaacgtactactaactgcttattctgaaaattttaggcattttttcctaaatattccttttatgaaagtgccaaaactgcttattctgaaaattttaggcattttttcctaaatattccttttatgaaagtgccaacctttgaaaagccgaatcatttgaaatgtaaaggaaattaagaataatgttgattgcttttagtatttaaaaaaacaactgctgatgaatgtaaaaatgtaagaaatgtaccagccgacaccgttgggggggggggggacgaacgcagcacaaaccatcatttcatctgtcgtcggatggaacagaggatgaacatgaccaagaagatgatgatgatgaggaggaggagggacagaacaacaaaagggagggacggattattacgaaaagggacggaagagtcaatggaagggggggggtgacagacagacagagggagggacggacgtcgtccccccgggcgagtggcggtgagtgactcttccaatttcgcgaccgcatttccccgcgggtgcttctgttggtgctcctctttgtgggcggtgcttttgtccgtccgtgttttccgccctttccgcgccgccaccgacgggtgacttttgctgctttgacctctccgccgatcactttcttcactttttgcttgatcaaaaatcggagcggatttttaattgaaatttaatcccgtccgtttcggataaaatttttttgggctcaaattt

SEQ ID NO: 30018 - DNA, 933 bp, Heterodera glycines
tgtttttctggtcatgtttctggttttgctcatttcttttgtctaatcataacaacggtggaaaaccagaaattaaactgaacatggtttctggttcggctcattttgtattggtaactttatggttgtttttctgaaattaaacagtttctggttttggctcatttcttttgtctaatcagaacaactgtggaaaaccagaaattaaactgaacatggtttcgtctcatttgttttgtattggtaactttatggttgtttttctggtcatgtttctggttttggctcatttcttttgtctaatcagaacaactgtggaaaaccagaaattaaactgaacatggtttcgtctcatttgttttgtattagtaactttatggttgtttttctggtcatgtttctggttttgctcatttcttttgtctaatcataacaacggtggaaaaccagaaattaaactgaacagtttctggttcggctcatttctttgttaaccagaacaacggtggaaaaccagaaattaaattgaacagtttctggtttggctcatttcttctgtctaatcagaacaactgtggaaaaccagaaattaaactgaacatcgtttcgtctcatttgttttgtattggtaactttatggttgtttttctggtcatgtttctggttttggctcatttcttttgtctaatcagaacaactgtggaaaaccagaaattaaactgaacatggtttcgtctcatttgttttgtattggtaactttatggttgtttttctggtcatgtttctggttttgtcttttcttttgtctaatcataacaacggtggaaaaccagaaattaaactgaacagtttctggttaggctcattctttgttaaccagaacaacggtggaaaaccagaaattaaactgaacagtttctggttcggctcat

SEQ ID NO: 30019 - DNA, 677 bp, Heterodera glycines
taaaattaatttgctggttggttttggtatcacaacacttcatatgaattcgaaattcattcgccactcttttgccttacctttgcgcatcccacggcccttctcccctcccccccccccccacctgtgaccacaaatcaatcatttgcaataatctcctcaaatttgcccattcgactatttcatttctctccttttcgctttctctctcccttctctcgttcttcccttctctctctcactctctctcatccctcctccctttgtctttctccctcctcccctcttttttctccttcacttcttttctctttccttctctctctctctctcccttttctctctctttcccactttctcctttctctcgctctcactctctctcccccctcctccctctgtctctctttctccctcatcccctctttttcttcttctttctcctttctttcctacctctctcttctcgactgactcttttcgctttcgctttggtcacttccttctctgctttgaccatgctccctcccccccccttctcctcctacctctcttttcttttcttccttccccctccttatccctcctcccaccttttccccctgtttactcgacgcatttacccgtgccttttccgccctgttttaagagatcgaattaaagctccacaaaatgcc

SEQ ID NO: 30020 - DNA, 1070 bp, Heterodera glycines
tatttaaggcatttatcgcagcagttgtggcgcccccccctatcagtatcggaatcagaaagcagagtcggatggacgtcatttgattttcacggcatgtccccccattttcagtccaatttctcgtacattttgcacagctcatctttgaaatgggccatcaattgtggtcgcttgcttttcatggtcggagtcaacaggtcgttctccaccgtgaaaagctcggcgtacaaatgaatgtctttcgccttaaaatgaaaaaataaataaataaacacaccatccgaaaaaacgagatgtgtaccagggatgtgccgagccagacaaaatccgattccgattatggcccaaaatccgattaattgcgattccgattcggcacatccctgatgtgtaccaataaatagagagtgcagagaaaaaaacatctctcattttagcgtactatttctttgcctctgttagttgaaaaaacctgaatttacttcgctagtttaacttttttcaatacgttaaatcttcctcaaattttgcatatcgatagagaaaaaaattacgaacaaaatttgaggtttttgagagcaaaaagtgtattagctaaaaagttatttaaaaaagaaaattttgaaagcctgtatccttttttaaaacatcaaataccttagctttggtttagaagctttcgaatgataccaaaattgtccaatttggttggcaaaaccctccaaaaataattcccaaaaatgggcatttttttaattttttggacaaaaataaaaaaatattcatgttgcagaacggtctcgaacatccttcctgtgtccctttactatcttacaaaaaccactgagccacccatttttttggtacagtagctaaaactgtctcatattatttttaaagaataaaacaaaaactaaattaagaaaatagctgttctacgctcacttgtattttttcattcaaattcaaaccgaattgaccgacctgttcaaaggtgaagagcccagccttctttccaacttcatgaatgtcctccatgaccatcactttcacttgctcatttcggc

SEQ ID NO: 30021 - DNA, 1182 bp, Heterodera glycines
agcctggactttattttgtttgtgtgaaccttttttatttgaaaacattgccagacggaattattattttttttcgcggccgagtgacaagctgtgggccggattgcccgccaacgcaaattaaaaaataatcaaaatacctttattttggttaccccacatttgcgccccaggcatttgcgcctttgtccaaaatcttcacgctattgttttgctatcttattaaaatgtttacgaattctatttcattttattaatttcgttcatttttcttgcgagtttaatttgtttttcattttaattcctaacaaaataaaataaaacattgagccaggctcaaaacaaaaagttccaatcattaattagtacgccccgcccaaaaaataacctctaccacattaactggccattgtacttcttacaagtcattaaaatagtcatttcatctggtgctcatgaacaattatctcccgttccatgaagattgtctataaagcaatgcccttccggttccctatcccatttacaaggccttaccatatcatggcgtgtcccgacatttgtggccaaactgccaaaaacgacatttgctgtccgtcatttttgagcccaatcaaatgggacatttctcttcaaatttacgccgaaaactttattttaccaagtaatcgttttcaaaaattatacttattcaagacccccaggtgatactgtagagttcatagatttcctaataatgttcataccttttcttcaccatttcataacgcaaaaaaaaaaaataattttaatcgaaatcggcttttcaaaagtgacataaaattcgcttaaattggataattaattttatgaagtttctatttggccagtggccgcaaaatgtcggaccgaaaatgtccgaggcgcaaatgtcgggcggggtatacctacctatttcgcgatttttcttacctaaatttcccagccctactgatcaccttaaaaaataccaggccctgtggtatttggtcaaaaaaccgggcccgggcattgtcgggtaaagaaaaaaattgaaatttttttcatttcaataaaacaaaagtatttttattcaaaaaccctctgagtgcaaaaccatgtaatagtcctaaagcaaacgttgaaataagaattttgttttttttaataatttttttattccct

SEQ ID NO: 30022 - DNA, 1196 bp, Heterodera glycines
  misc_feature (1173)..(1173): n is a, c, g, or t
cctcaaatagccctaatgacatggtttttggaagatttccccccggaaaaatttttccactcaaaaatcctggtcacccccctttggtcccgaatcccaaaatcacttttatttttataacttttttttaaaaagggataaaaatgtaaaataaaatttatataatagagcaaaaaattgcggattttttcagtatttaaaatttcaaaaacacctttacagaaccgagttctgaatttttttctgaaaaatcgaaaatttccagaatttctggaataactttttttgtttttgtggtataaatttcaaataaaactcataaaattctcccgattttttgctatttataaagctttaattcaccaaaatagacctgatctgaactgagttatgaattttcaaatattcacccaaaatcccatgggccaaaaatttcccaaaaaataaagaatttttaaaaaattccaaaaattatgaaacgaaaaatgaacttcatattcgtgctcagcacatcaaaataccccagaaaaatatttttcacccccattttcaacccaaaaaaaaattctgaaaatttctagggggcctagctcgaaaatttttgaaattttccgggcatatagcacaccgttcgatagagcttaaaattctttacaaaaatgttctaagacgatttttggctaaacccaacccctgacgagttatgggcccgggactcaaatgtcccgctgaggccaaaaattttttctatttccgggaaaaaatcgaaatttttccgaaaaaaataccagtcgatagagctcgaaaaactatgttttggaagtggtcttcgttttcccgggaaaattcgttaaaaaatcctaaaattcaaaaacccgaaaaccgttttttaggcctaactcgaaaaattttgaaaattttcgaaatttttaaatttcagaaaatcgagcttcccaaactctacaataagtctgctgggcacctttccctcagatcaaaccccgactcggtattcgcctggtactgaagtgtactttttgagcacgcttcagttgccattttctgcaggccagggggtggctctattaaaaaaataaaaaataccagcatgtagaggacactttggcggggtgccctcgcagcgggcattttttgattcgagttttagaaaanaaagttacgggccttcaaacgca

SEQ ID NO: 30023 - DNA, 1316 bp, Heterodera glycines
  misc_feature (37)..(37): n is a, c, g, or t
  misc_feature (87)..(87): n is a, c, g, or t
gctttcgagacagcccttccggatggcacagatgtgncgggaatgaatgacaatccgggccagtaaaacaaatcaggaaatgggccncactttctttccaccacacgaaaatatcagtctcaatagtggttcttccaagtgccttgtaagaagctaactgaagttgaatttgtgattgatatgacgaatgtgaagtgccagaaacaattgagggcaccgaaacactccctggagacttgggcctccaaatatcgacttaaagtattataaaataaaaaaaagaattattcaaatacatttaatgctgtcgtcgcttgctgatcccgtgtcttcgaccaaagaatcgaggtcttccaaaggtgcagccattgcttcttccacatttgtgccacattctctgttgactgtaaaatagttagcaaatatttttaaaaaaccatgttttacttttttgatgcgcaaatttaattaagtcctcctcgataagactccaatttgcttttgaaaaaattgattcatcgtaggcaaaacgcgggtccaacagtgaacaaattcggattaacaaattttggaccattttttgaaccctttcattcaatgagtcgaccaaaccgtcgattaatggctgaatgattgggggaaatttttcttccagtaaaaaatcgtgaaggcgcttgatggtcggcaatatcacagaagccgttgatttttcgtgggataacttaaaactaataagtttattgagcaaaaagaaaaatttttactttttgggtttccacgtcaaaaattttaagaattgggcaaatttggcgcaaaagttcgaagtctttaaatgaaatggacggcaatgatgaagaaattatttccatctcggccatccgaggtttttttggtgcagacaaaattccggcatttctttggtctctttcaaattgcattgccagcaaaacttttttctgctctttgaaagatgccaacattcggtaggtcgaattccatctcgtcggaactgacttaaaattggccgaatttgaataagaatggaaagaattaccaaaacaagttgctttttcggcatattcaattgctcttggtgtcgctccatacatttcttaattttgggttttcgacattctttagtccattcttttgccttccagataatttcagaaaggcattgatttttgatcgcatcttgaataaccaaatttaaaaaatggcaacaacactggaaacttaaaagggaacacggaaccattcaaaaataaatgataaaaatggcctgtccttatccaattggcgtgtggccgactgca

SEQ ID NO: 30024 - DNA, 1118 bp, Heterodera glycines
  misc_feature (1097)..(1097): n is a, c, g, or t
  misc_feature (1100)..(1100): n is a, c, g, or t
aaaaaatatgtaaatgcattttttttcctggattctacgtagtctaattagtaggaaaaacatctttttcgtatttgcgtctaaaagtcggtttgggttttttaccgattttgcctagcctagtaagaggagttttttgccatttttaactcatttactaatgatatgtagggatgccaaaaatatgcacatgcatatttttttcctggactgcgggaagcctgaaacgcacgaaaaacatgtttttagcttgatttgaagcttctaggatgactttccatgtgcatattttggcatttcgtgcatattttatgtgcatattttggcgtttttccaaaaaacctctaatagatcggaccccaacagacaaattggcctttttgagctcaaaaaccggaaaattttccaaaaaataattttttagcaaaattttcacgaaaaatattgaataaataaatttctcaaaaaatggttaatttatgtcaaaaataagcaaaattttgcttttcaggttgatttttcgctaaaatgagtaaattttaagctgtatcgtgtttttttctcctaaaatgatttttaataccacatttagccatttttgaagattttactttatgtttaacaaatttgaagaaattttgagaaattacaccctcaattggaaaatttatgtgcatatttcacgatttttggtgcatattttacgattttatgtgcatatttttggcatccctaatgatatgtataccatttttcattaatattttatattatcagccggctttatattttacaaaaaatctatcaaaatgttcatccgtctccaatcctccatattgcctgttcggttttttttcacctcaaatcatccacctctattgcttaatataactaccaaaaatccaaaaacatcccggtcattatgtgtgataaagtctgagtcagttttcgtcaacaaaattcccttcaatgagttggtcgtttctgcactgagagagtcgcatcctggtattaatatgatggaattatctttttttttgtttcgttttcattgcagaagagcacagagtttctctgacgccatccgctgctgcaanttnggtcaaaaagggcatgaa

SEQ ID NO: 30025 - DNA, 1304 bp, Heterodera glycines
caagtctcgggaaattttcggtctcgactgattggatacaggttcctttaggtaaatcccgtcacctatgggcgttcgtaaatccgccattttaacgactttccaacaaaaatcttcataactttactcaaacgcaatcaaattaaacaacaatttcggtattttgttgtccgacacttttcattcaatctaagggcaaggcaaattgtgaaaattttaaaattaatattttgtaatttatcgtcacatttactaaaatttaatgaaagtttatgaaatttggcaagctaagggagacaagaagagctattggatttattttgtggacgtttgagaaaagatattgtgagtttgtcaaagtaaagtcgttaaaaatggcggaatttacgaaacgacctagcaccttctgattgatctgatcacaaaggatgaaactctcggtttaatgaagcatatgtgggcactttttctaaatttatactggtgagataaaaatcctgaagggtaaaaattttttaatatttgaaaatcagagaattgttttggtttcaaaataatatcaaaaatatgagcagcgaaaaactctctatattttaaatctgatcaaaaatgacctgcttatgtttttgtattgaaatttaataataatttagtcaaaatgaatttttggagtccatatctcccagagaggtacattcgaactatatgatatagtagttgataacaatcccacatggaaatttttcgcaaattttcacctgaaattcattagaaaatttttctgctaattttccaccaccaatcagcatttttttgatgctgttaagcccgtaacgtgttcgttttttggtgcgttccgctagcttgtgtcttagaacaaattctaaaaaataatttcaaattagtggtcagtttaataaaaaaaaaaattatattttaaatggaatatatttagatatttttatttctaaaatttttacatttgaacattctcaactacctcgttgttgttttcgattttcatttttttggtccgtcattgtcagcaatgcaggcacttggtcgggcagaacaggcagtagcccaaggatcggcgaatcacaccattttatggtcgggggacatttttccgtcacttattaacaatggaaaaaaagttaaatgctataattagagaccggattttgaatcatttgcttaattttctttgggcgtgaagaagcatgaaaaacacatttttaattcctttgaagcttctatgctcaatttttcagttaattttactgcatggacggtaaaaaaga

SEQ ID NO: 30026 - DNA, 942 bp, Heterodera glycines
  misc_feature (24)..(24): n is a, c, g, or t
gggcagtcccccgaccgatgcgcncagattatgggagacgaatccttcggaatagcttcctatagccttactttattctgcgtggattttgctccccataattgttgagtaccccaaacggacacttgaaaaaatcgatttttttgttttcggggcagtccccccgacccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagattaatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatagatttttttgttttcggggcagtccccccgaaccgatgcgcccatatttatggggagaccgaatccttcgggagtagcttccctatagcctgtactttaattctgcgttggatttttgctcccccataattgtttgagaaccccaa

SEQ ID NO: 30027 - DNA, 1101 bp, Heterodera glycines
acggttagacttccacacaccttagagcttgattccatctgtaagcgtcgcattatcagcaataatctatccatattcattcctctcgatcagtgtggacgaggatgactctatctctgtcaaactggttaatcctaactacagagaagatgccggaaattctgacatggaatcgcaaaagtttatcaatttgtcagtgaaaattccaaatgtacaattccaaagtgtacaaagtttacaaaaaacactgaatcagataatccagaatacttacgataaaaagtttggcggctcatccttaaatgatggtacgcccactaaaagagccaaacgacaaaccgaattgtcagaatcaggcgttggagttatcgaagtagagaatttcttcactcgaaatccctttgactattggcaacagattggagaactgagaaaaaagcactatcagctcagagaaagggttgaaaaaatgacaaaggagtacaattcaacagcggatggcgaacgaaaaacatttctctcaacggaacttggggtttttcaagggcgagaaacttttctgaaagaacatttgcatttgattgaagaagaggcgaagagaagggatggtgagcagcaagaagccaatgaacaaagactcattgaccgtttctttgcccgataccccgacaattatagagagcagctggacgagtggaggtcaagttacctccgagatgtgctagatctacaaacaaagatgggagagtatgaaggagttaaagatttgaaaaggcttgaagagctcaattcacaaactgaacgaatgagaaattccatacacgtttttggaagaaagatggaaatattaaacaacgcagcattgcaacgtgatcagaaaaaatctcaagaggattttgaacggttaagccatgaacaaaacctaaccttcgtccaagaattcttccaagccaatcccgtgaattactggcaagcaatccagaaaaattatgaagcgcttcaacttgagtacactaagaagagggaattgagggaaaagcttgaatttgaaactgacgcaaaagaaagggagtcgctgcagcgacaaatagagagcattca

SEQ ID NO: 30028 - DNA, 1727 bp, Heterodera glycines
tttttaaattattttattttttcattggtatactttcattcttattaaaaatttaaaaattattgtataaatttttttattttctagttattttatgctactaatatcataaatcaaatcaaaataaacatatcatatctttttttgatttccaaatgatgcttaaatttattacctttttaattgtatttttattgttgtgttgtttatgtctgaattctcgaaaataaatttaaaattattttataaaaataacttaatatttaatatttaggtttttaggaacaatttattttggataagaaatttttatcctatttttgtggctgaccattcgggtttataaattataattatattttttcgaattttttactctttttataaaacatttattttcgatttgttttattttttcattgaaccacttttttattttttttaaatttgtgttgttaatttatgtttattataaacttgatttccttaattacgaagattgtttgattcagattaagagtaaaatttaaattgatttaggtttttaatatctataatgttatattggctagagctaataaacaaaagaagaaaaattctcagcgtttggaaaggcattttaattttatgatttaattgcttctttcttttcgagcttcaattaatatttaataaagattctccaggcatggtaaaccgtttgtttttaacgggcatgcctaaatgcattgcttgcctaagcatcaaaacaacgcatatttaaaatttatatattaaattaaaatattcttagaattctgttagaatttttatacaaattttattgctggtttttgatttatttatttttgtaactgaatttcgccaggttttgaaaaactttaaaaagaaaatttatgatggattgtccaatgatggattgaataattaggcggattatctcattgaccacctgtgatatttgacctcgtatttaatttaaataattaatttgtggcattttgtctatttaattttgttcctcttctaaatttgttttgttttctcagtgctttctcatattatattttggcttcgaaatgatggtaatttattctcatcgctctccgactttcgaatttttattgaattaaatttgttctgttttgtgctgtggactttaatttgtgttggagatacacttttggttttaattgtttgagtgcaattcttttttgttaattttggttgacgacgaacggggacgagaagtgaattcggaggagaagagaagagcccgcaaaagccctgcatttgtgttctccctcattttcttcgaatattttcgacgtggcgctcctgcttttctgggtaagctcagcgacgggatttgattcgattttcggttttcaacaaaaaaacgaagcaaaagtgggaagtaaattggagattgagcgcattttgaggaaaattagtgattcacagggtgaacactaaacaatttgattgctgacatttgaaagatagatccacaggttgggctatcagattttgaatttgttatcggatcaccaactcgctgtttttcttcacactcgccatttttgttttgttccgcagcacggacaaagcacaactcaacaattttgtttcaacagcgacactctcaggaaggggttgcaacaaaacagcatcaaaagcgacactctcagaaaggggttgcgccacaggaggttgtggttatttga

SEQ ID NO: 30029 - DNA, 967 bp, Heterodera glycines
  misc_feature (949)..(949): n is a, c, g, or t
gggggcaatgttcgtttttcggatgatgctcggaatttaatcgaactaaaatagaaaccgaaaattgggctttttgtgccaaaacccgaaaccgaaactgaaattgaacccgtgggaaaatacaatacaccgtgatgaaatcaactactgtacatacatttatcttaccaaatttttgtaacagttattctgtcagccaacagtgcaaatttgtgtttggtgctgctgccgaaattggtccttacatgccaacttgtcgccgtttgtggtgctccgtgtccttcggataccaaatgggatgccgaacacaagtaaattatataaataattgattcattttaattggcatatatttggtaaaccaaaattttttcgtgtccttttaagcatatgccatgggccgacggcacgccctgcggcgataacatgtggtgccatcggggacaatgtgttggcatgtcgccaatgcagcggcaacccgttgatggcggatggggcgaatggaagccgtggcgtgagtgttcgcgcacatgcggcggaggtgcttaattagggcatagagtcaatcaataaatgatcagcgattcttatcaggagtccaaaaatcgtttcgagaatgcgactcgcctccgcccgagaatagcggcaaatactgtattgggcagagggaacggtatcgaccatgcaacatccaggtcagtattaatgagtaggtttttgatcatacatcaattgattgattagattcacatatgcacagttagtgatccattatttgaattttaaaaaatgcagtgatcaattgcttaattgcaaaatttttaattataatggccaccttttcattctgatcagtgattactcgcatttgcgtgatcataatttcagtgatcatcatattttgatccttatcactttgttttaagaacggtccctgggaaacgcccgngttttcgtgagcttcaat

SEQ ID NO: 30030 - DNA, 1041 bp, Heterodera glycines
ttttgaggtctcactgatcacgaattatccattcggccaattccggacccgaactcgaacaaaaaatcgaagttcctaatttccgaatttagcactgttataagtaatattgagctataaaaattttataaataaatttgcaggaatattctgacttgtgttttcatattgaaacaattataagtgtttaatcgattagacttgcttattctcaaaataagttgatcacttgagaaaaaaagttatggcttcttaagtttacctggaaaagaactggcagaaagggactgctgatggtgcctttcagaattacgaacgacaattttttcggttgtctcttacctaatttgttgtcacgacaaaaaaataaatcgtttgtcgttcaagttcgtcgaattgtcgtccaattagaattaacaaatttgcagaggcttgtcgcttgttctgaatttttatggaaataaataataaacacatgtttgtcaaaaattggcaaattttgggataacttagaaaaatgtgcggctaaagagtgataaatgatttcgtaaagagttgtttaaaatgagatgtgtttgttgtctaagccgtttaagttaaggctgtcgagaaaagacacgaaatcttttttcacactgtaatggggtccgattttctcaatgttgagtattgttgacgcgaagttgccgaagagtgcgcggaattgggacatccccgattcaatgacaaaaccgtcaaacaactgaggggcgatacttggcaaaaaaaaggaggctgtcatgaaaaaatatgacacctctcaaaaagcagaactatcggaggaagcgtcgaagtttgcaaattcgtattccattttagaaaaataaacaaaaaataaaattcggagaaataaatttattttcagagaataattttggagaattatgaataatgggattcagtttgggcttatggatcaaaataatttggtggatttttgggacacttatcagacgacaaatttgaggggcggtgttgagcgcccccaaaatatttggcgtt

SEQ ID NO: 30031 - DNA, 859 bp, Heterodera glycines
ggggacctctagagtctttaaatctttttttgcttcatattttaatatagattctcttaaattaatttaagttgtagtttttttaatatttgagaataatgtttttgaagaatggaatttaaaattttttatattttaaaatttaatttatttgagatatttaattcctactgaattaaatatttaatacttgataagataagcgagcttttacatcaaagattcttgcttggattaataaagccttttttaaatttaaataattgtattgtaattttgttattttttgaattatttattaattatgtagaaattttatttataggatttattttaataacagagtaaaagcattaaaaataatcacaaatcgaattaaaaataatacctcataaataagaaagatgaatctattaaatcaaattcaaaaagtgatacatgaaatcttgattttaaaaatataattttgttcgggattaccgaaaaccattcatatttgaaaaataaaattttttattaaaattcattaaaaatttttgtaagttaattggtgaaaatcattaataaatatttttttacgttcttcctcgacaattattcttgctaaataccatattaaccttttataacgcaaaacaaaatacttaaaagattataaaaaatttaaaattattattgaaaaaaacgatcataaattttgctttttttttgtatacaaatttttctaaattttatttgatattcatggtgaatttttttatatgcgcataaaattacttacttcagctttgaaaaagatatatcagataaacgacaaggcttatggaatgataattttatgggatattaatcaataata

SEQ ID NO: 30032 - DNA, 1416 bp, Heterodera glycines
aaaaatttgccattttttctcggaattttttaaaataaacgtcagcgtgctttttcccagccccgaaaattagtgaggaaaaaaaaattacgtagagttaagaataatttttttcaagattaaaaaaatgtattgtaaaattttgttggttctagtaattggagatttactcattttgtttaccaatttttaaaacacaaattctagtcccaaaaagcaaatttaattaaaaaagcgtaataaaattttcggtttgatttggtccattggtggaaaaccaaccgtgatcagcttcaagttctcctcactgaccgcatcaccgaccagaaaagtttcattcaaatcgccatggaagccgcgatggaacacagtcacatcaacttgaattagaatgccaggaattttttgaaatttcaaatttagcaaaattgaggcttaaaaaatgcaataaaaacataacaaaccatcgcaaatgtctccattgatcagtgcccgtttatccgggatgccatggcaaatgacctaagacaattagcgtacaaaaaccaaaatcttccaaaaaaaagcaacgaaattagcattttgctctattaaactttaaaaaaatgtgcttggaggcaaggtgcaagttacaacaaaaaaaaattggataaaattttttttttttgtgaaatttttgatttattaccgaaaagtctcaaaaagcaaccgtttttaggggcaaaatctgctagcaaaatgtatatgtccaactttcaaatatttcttcctgtgcttctctaggggcatcaaccatttttctggcaattggcccaataaaaataaccattgccagtgtacacattttttatggaaaaatttttcagataaattttattttttttgaaaatttgaaacacctcgttgaccgacgtacaacaactcttcgggaatttgtagtagcccagtgggctcggatagcactcccgctcaatgcacgcctcgtgcacaacacggtcaatctcatcggtggtcacctgatgtttaatacaaataatggcacttatttaaatcgaatcatacgaaaaattggcgtttttatttgattcgaattttttgaaaaatgaaaaaatgataaaaaattgaacaactttctttaaaaccaaatgtttaacaacaacaaaagaccataaccaatttgaaaaaaatcagcttggaaacatgaaatggataggatttagggaaaaaaaactattttccggaatcccctgatccggtttgtatttttatgggattttaataaaaaaaaaaaaaaaaaattcattacgccaggctcaatggcacgtgccgcctcgtcgagcacctcgcggcccaatttggcggccaaacgcattcccaactgttcctcctcgttcaacaccttaaaaattcagatga

SEQ ID NO: 30033 - DNA, 1359 bp, Heterodera glycines
gggtggggggggggggagagggggtaccaactaaacctagcaattaagaaatctcttattttggtgatagatttctagacaaataaaaatcaaatgaacaaatgttgttgttgttaacaaaagcatctgcggtacagtacgatcctaacaaattgtcgtgtcctcgtgtcggaaaagcctatttttaaaaaaacaaaacgccaaaaaatttattttaattctttcgtcatcttcccatcaattttaattaagaaaatgaaaacaaaagtacaatgaaaagctgaatttatcctttttcattaaagaatagcaaattttatgaattccttttaaagatctgttgatactatttcaatttttatgtccaatttgcccgtttcttctctgattcgtcaacagcacggcggtggtttaggagaggaagatggtatagaaagtgggaaaagaaagtccaaggatgagtacagacgacaaaaggacttggaggagcagcgaaaagccggcacggcgccggcgatggtcgacgtggagacggggagagacataaatccgcacattcccgagttcatcgagaaaacgccctggtatgtgccatcttcaggacccacgctcaaggtaagtggacgaataacaaacaatgcgacaacgaatccattttagcaccagcggccacatcctgaacgccaaaaacagatgtcatcggttgctgaatggtaccctaaggttcattttggttacaaaacaaagggacattgtgactcattggcttattgtcagggcactaccgaacgcgtggcattcaaataccgtgacggggcttgtcaaaattgcggtgctttgggacataacagaaaaaattgctttgagaagcctcgattagtcggtgctaaatttacgaactcaaacattgctccggatgaccatgttctggtgggtgaccactttgttaaaatgttagcaaaatgaccccaattcagccatccctcgaaatgggatacgacgcgaaaagggaccgatggaacgggtacaacgcggaggattattcattggtggcagctgagtttgaaaaaatggaggaaacgcggaaattgatcagagcggaacaggtaaagccaggaggcgtaatgcaatggcaatattcaaaactcagctcaaagaggccggtgaggaggacaaaaaggcggaggaggacgaggacatttacgcggaagacgcgtcggcccccggacagtccgtggacatggactcgcggacgcgaataacagtgcgaaacctgcgcattcgggaggacaccgccaaatatttgtacagtttggacccgaatggagcatattacgaccctaagagcagatcaatgcg

SEQ ID NO: 30034 - DNA, 1828 bp, Heterodera glycines
tgcaaagcactttgaagagagagtaaaagaggacgtgaaacgatgaggtgaacgggacagagctggcgtatctggtctgcattcacccgtttgttgctgtacgttggcctgctagcctccagactggggtttgctgtccttctgttcagtggcgaatggggcatttgcaggcggagtgcgctgagatgctcggagtagctgcgtgagctcggtcttgaggccagcctttcggggtctggtacccggatcgggggagtgctgtttactctgggtgaattgtgcaatggtttcgggtccgtgttgactcgagctgggggtcggtggcggtcgcgtgcgacacgtaccagcaaccagttcggtccagctcgggctctcagttgtgcgttctcggtgtaaaagccggtcatctgttcgacccgtcttgaaacacggaccaaggagtttagcgtatgcgcaagtcattgggtgttcaaaacccaaaggcgcaatgaaagtgaaggcttcttacggagctgatgtgtgatccctggcactgcggtgttggggcgcaacatagtcccgtctcgatcgcatgcgatggggcggagacagagcgtatgcgctgagacccgaaagatggtgaactattcctgagcaggatgaagccagaggaaactctggtggaagtccgaagcgattctgacgagcaaatcgatcgtctgacttgggtataggggcgaaaggataatcgagacatctagtagctggttccctccgaagtttcccccaggatagctggagctcgttaagcagttatcctcggtaaagcgaatgattagaggacttggggacgaaatgtccttaacctattctcaaactctaaatgggtatgaagccagggttgcttgactctgaacccaggcgttgaatgtttgagctccaagtggccccatttttggtaagcagaactggcgatgtgggatgaaccaaacgtggagttaaggtgccaaagtgcccgctcattagacctcataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtagtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacgacttttctgtgcttgcgcagttggtccatccggttgccgaaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtaaagcaccgcggttcctgtggtgtctcgtgcgctccacacggcccttgaaaatgcgagggaagctatttgaatctcctgcctgatcgtaccgatatccgcggcaggtctccaaggtgaacgagcctctagtcgatagaataatgtaggtaagggaagtcggcggggttagattcgtaacttcgggaaaagaatggcttctaaa

SEQ ID NO: 30035 - DNA, 1514 bp, Heterodera glycines
  misc_feature (1467)..(1467): n is a, c, g, or t
  misc_feature (1476)..(1476): n is a, c, g, or t
tctagagtcatgggacacaacaaattaatgccatcggatgatggcattaattgtcctgaggaattgaattattgtcctacattacacttgcaaatatactaatttttgttgactttcaatgtttagccatctcccatccgaaatggagaactttttttgctcttcgacaataaaaatatttcataactattttttaaaaaacggaatcgtacatcttttcttggacaaaaaataaccaattttgacttttttaggtaaaaattataaaaattccatgaaattcaactgaatgtttctgcattcggagcaaaggaaagtttttaaattgttaattaaaaagtggtaaaatttaaaaatcctatttattttcataattttatttttccacgcagaatgggggggggggttggggctcagctgggaacgcatttgaattttgcaattcgtcgggtgttatttgcgtctgattgtgagaaagaagggcattcatcctccggctgaattatgctaaaagcacttgccagaattttttttttttgaaaaatggaggaaattttttcaccgcgagaaaagaaattggggcgccgacgaatggcttaagccccgaaaatgggtggagggtgggcgaggtggggcgggtcgagagcaaaggccaattaaatggtgccagaccgacgaaggcaatcggccgggggcggcacggctcaacgcccttgtcactcgggtggggttttttttgccacagcttaattaaaaccaggcaaaaaatgtgtttaattattcataaattggggccctgctgaacatttgcatagccgaaaaatgcttggcttggttatgcatattattagtaaagtacgaccatttaccataaaaaaatttttctaattattttaattttttttaacagttgaaacataatgtaaatgctgcaatattatttaaccatttaaattttgcgattataatattttttataatgccttatttaatatttgtatttaattttcattttctgtttaattgttattacagtatgactattatatttaccgtaaaaaatggttttcttgaattggaaaatattatgatgattaactattattttattcaatcccaatatgcggtaaaattcacacccaacaaaaaaaactatattttttaaataacatatgaaaatgcagatttcaaaaaataaataaaataaaaactaattgccaacccttggcatgtttcggaagcgtgccattgccgtgacaacccgaagtgccgatgtccaacgcttttttggtgaaaccatattttgacttattggattagtagaatcctgctgctgtgcaatattgtcatcatcacgatcgcgagaaacactctggaaaacattttaatttttattttaaataatattttgaaaaaatgagagcaataaaatacctgcttatcagtgcccaactcatcgccactctnctccatttntggtccatatttttaacagaaataattaaatcaattaa

SEQ ID NO: 30036 - DNA, 1238 bp, Heterodera glycines
  misc_feature (1189)..(1189): n is a, c, g, or t
atcactttgtgctccgtttctctgatcactccccatcctttgatcactttgtgctccgtttctctgatcactccccatcctttgatcactttgtgctccgtttctctgatcacttcccatcctttgatcacttcccatcctttgatcacgttgtgctccgtttctctgatcactccccatcctttgatcactttgtgctccgtttctctgatcactccccatcctttgatcactttgtgctccgtttctctgatcactccccatcctttgatcactttgtgctccgtttctctgatcactccccatcctttgatcactttgtgctccgtttctctgatcactccccatcctttgatcactttgtgctccgtttctctgatcactccccatcctttgatcactttgtgctccgtttctctgatcacttcccatcctttgatcacgttgtctcccattctctgatcacttcccattctctgatcacttcccatcctttgatcactgcgctctccgtttttctgatcacttttcgattgtttttgtcgttcttctatcccattttgtccttctgtccctttttgattattgttgtcgttctgtccatttctctgttggtggtccttttctgtgaatgcgtttttcaatgaactcccaactctcgaagcagcttctttcgcgctgtgcccagcggaacgggcgacttctttggcttcattgcccaactttttcactttttcatatttgtcttcgtatttttttggcatttcgtcctctaaatttttaatttttttaaatttcattcgctttaattgcaccttttttctgttccttttgttgtcggacagccggtgcagcttcagcagcagaaacagcttctccttgctcactttttccaagggatttcttcgatggcgccaatgtttcggcgatcttcgataaaatcatttcctataatgggactcagctgacgagccaaaactatcaacaatttttcttgcgttttaactttggtatttaagttaaaaatttattcccattttcgaatatattgggaactgtagaaattggtaattcgcattttttgcttttagtatttcctcgattataagattataagtccctgggcttttattgttcaacccccctcaagaggaggcttatattcgaggggtcttctaattgagaaggngcttataatcgaggaaatacggtaagtacggccacattttaaggacttt

SEQ ID NO: 30037 - DNA, 1266 bp, Heterodera glycines
agattagattaagatacaaaaaaaaaacgcaaatttttcaaaaaaaaaaaaaaattcagctttcgtaaccatccctgggcctaatttaacttgactaaattcttttttcaacacttgctttttactctattcccagtgattaaaattgcttaaaaacaacctgtgcactttttccgggaaaataaaaatgcgcaaaaaaattaaaaatcacaaattttttacgatttgcgagagatcatcaacttgaaaaggtacaaaattgttgggatgatcatttcacgaaaacaaaaccaccaccaacacaactgaggagggcgctaggggagaggcgcattttttttttttttgtgtggcgttgtgcactaaacgccaatcacaaacacaacacccacacaactcctgggctattacatttttgtgatcggcgcggatgtgcgtttgggctgagttgggctgagcgacacccaaacacacagacacacacaaagacaaaactccccaaaaattcggttgaattggatttaatttggggcccgccgccggcgggggcatagccaattgagggggagggggccaaacggtctaaaactgcctcctgcgcgatttcgatggaggacgactcttgacgtggcggcgacggtcggtcccgagaccgccatctcggccggggccggctggctgctgtcatcaaccaccaaaactagatttgtctcctttctccttcaatttgctgccagccgaccccggtctccccccgggggcgtcttctgctcctcctcccagccaaataaacccggtcgccgaagggccaaaacgcgggggacggaggagagtgcctaaatcgttaagtgctgccacaccattctcatcatccgccgatgagtccacaattctacgcgccatttctgcattaaatttacggtagtgcgatggggaaatgaattaggaaaaaacacattttttggaaaaaaccattttagcgtaggataagcaaaagttggaattttttttttttttgtgaaaaacacaacgaggaaaagtttttatttttgaaaaaaatttggtacttttcgtttgttcctacatctcaaataaaaaaaaatcaagtacgcataaaaatcggttttatatcataattattattttggaactgaaaatgacattcaattttatatcctaattccaaaaaaccaaattaaattgatggcagcatatcattatttctacatgaaaaatggcataatatttcgcggaaaattttttttt

SEQ ID NO: 30038 - DNA, 997 bp, Heterodera glycines
ctatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcactaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacaggtcagcacaaaaaattaactattcacgcttgagaacgcgaagtttgct

SEQ ID NO: 30039 - DNA, 1253 bp, Heterodera glycines
tttcctggatttttgtccaggaaatccaggtccaggtccaggcaaaacacgaaaaacctggattttcctggacaaaattttagaatttattatttcaagtgaccaatgtttttttaaattttcaaaaaaagattaaattaatttaaaaatacattattattattattaattagatatttttaggtgtttctaagcaattaattaattttttcaaacctttttttgatttttaagatgagtttcaaaaaatccaggtccaggcctggatccaggtctcgaagagcctggatttttcctggacctggattttcctggatttttgtctaggaaatccaggtccaggtccaacatggaatccaggtccaggtccaggtccaggcttttttcaaaataccgatctctagaaaaaattaatgttttatttattagggctgaaatggttttaccgagtaccgagaccgaagaatgacaatgagtaaaaaaccgagaccaagaaacgtgaaatcataaaatccgagattaactttttagtttttagcaatttcaattttagtacatatgtagaatttctcctctcggtgatttcaaaaacccgagacagagaagtgaaaaattgagaaatttaattcgagaaccaaaacatcccgaacagccctaaaatgtatgaaatttcagctgacccaactgacaaaggagtgaaaaaacgtgtcatttctacggacaacggtcaatttaagtggaatatttggaatgctgtgcgagatcttgacactaatgccaagattacggtactcttgtgtttggacgatgagtaccgtgtgtatggccaatttgcggattatgatgcgatggaagatgagatgggtgaacggttccacgaagtgtttcaagtggtgtacaataattaccccatttatgagattgacgaaacggtgccaattgaacacgacgtgccgattgagtacgaagacgaaggccattcgacatgcacaattcaaaagtcagtttaatcaaattcaaaaattgttaagcttattttttaggtgatcgaatttttggcaaatattaggaaaagaatttagaatctttaattgaaaaccaaagaaaatgatgtacaacgaacggattattcatttgaaatatttaccccaaaatgagcatggatttaatttatttcatgtcattttgtaaaaattgtttttttttgactctatgataataaatagggaacggatttatatgtgctaaaaacg

SEQ ID NO: 30040 - DNA, 1170 bp, Heterodera glycines
aaaatttacaaaaaaagggataacccttttttggggaaaccctttaaatataaaatctttgtggaataaaatggcgattgtccactgcctccggtttcatacgcaaaccgcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaaagagatagacatttttctgggataaagtctaaatttaaaaattccctcaaaaataaaaggtctattgcacacagccctccctatcatgctcgagagcatttgtgtggtataaaaattctcaaaaaaagagatagccatttttctgggatagagtataaatttaaaattcccctcaaaaataaaaagtctattgcgcaccgcccctcctatcatgctcgagagcatttgtatgtgtataaaatttatcaaaaaaaggagatagccatttt

SEQ ID NO: 30041 - DNA, 1319 bp, Heterodera glycines
aaaaaattttattaaatttttgaatattcaaaaaagacatcgcttcaaaaaattttctttattaaaattttaccaccaaaaaatgcgcggcggaccgcgcattcaaattgccgtggccgcggaccgcgcattcaaattgccgcggccgcgaccgcggatcgcgcaaaaaaaaacgccgcgaatcgcggatcgcggtcgcgctccagccctgttgcaaatgtgcgggcgaaaaattaaaaaataaaatttttctgcgatttttctgcataaaacacttgatttttccaatttgagaacatgcatattcgcacttattttggctttttttttttggtttttagcatattcaacctttttagcacatattttattaccaaattaaactatgactccacccaaaaagaaatagttttttgaaaaaatttgatagaaacttgaattattgaaacgtgggacagaggtaaaatccctcgaatccccagtctccgtttgacctgctgaagatatttcatccaaatcatccgtatcgtaattctgagcatcattttccatccaagcagctctcacagaatcactaagcagtgcaacacacaaaaatattttccacatagcaagaaaattaaaattgaattttttgcatcaaatatgatttttgagatcattttttaactcatcatgcattttatttgatatctaacaaaacctaattgaaaattcatttatttaaatgctatttttctagttttttttcttgtttttttctttgctgaggttccacctctcaaggtatcatttaatgacactaaggtaaaacatggcaaaaatttataattaaatagcaagaataaggagaatggatactcagccatcgcctctcatcagctgacaccaaaaaataactgctttcttccacttggcctgctgggtgatcaaagaatactttaattgtgatgggttccatcccattctcgattttatttatttatttatcgccatgtcaatctttttgaagcaaagtttttgggaaaattacaacttaaagaaggcttattttgaggactaatgttgtcatagaaacccagcattttagctttagtttagcttaagccagggctgccatcgtccatcctccgtttccaaggacgggtatgccgattttcaggacatagtggggaaattcatgaaaccaaggacatttaaaatttttattatatgcaatgaaaaatgggtaaaatttattcaaatggtttgtatttttcaccggaatggattttttccaatatttttttggttcccgctgatcatttttcctcatttcc

SEQ ID NO: 30042 - DNA, 1400 bp, Heterodera glycines
aaaaaatggatccaaatcaatacaaagaaacattgtagaaaatggtgtgtacataggttgaataaattatattaatattaatgaaacagataatttataattttggattagaataaagcgtaaaattaatttaattttatgggtcagccttttattcgtaaagtttttgtttataaataaaaactgaaaaggaaataagaggatcatgttagccaatggaaaaaatcataaatgtatatttaattatgtaaattaattaggaaaaaattgcagagaacaaaatgaaaatatgcctaatgaaaaacaaaagttgtgagaaaaagcaagggttattctgttccaatttatccattgatctggtcaaattttttacaaaatcagaacatcaaattcaaaaaatcgcattttgaggtcaaaaaatatgcaaaattgcttcaaatgattaacttacaattttttcgttcaaaaataataaattatttttatctttcgtctctcatctctagggttataaattaatatgatttttaatatatttttctttgcgcatatgctattaaaaagcggctcagaaatagcatttctacgttaaaattttttggttgttttggtgtttattctcctgatgagataacacaaaaaattattaaaaaaacaaagattcatttttagagaaagggaaaacattaaaatagtgtatgccagagatattttctgcttttccaaaaaatccaaccaaaaagggggaccaaaactaatttgtaagacaacattagtaccaaaaatatacatattctaaatttagtgtaaataaaggcacaactttttttctagttattttgttcaaattataattttaaattaaaaaaataggaatgaaataaaagacaaaattgaacttttttatagagggaagagagcgcaaacaaattaacttctcgcaattacactgatgcccctgttttttttctaaaccatagcctcaaatttaggagtgtaaaatgacaaaatttattcaaaaattataaaaattaggcaaagtcaatattaagataaataattttaaaatccaaattcttgtcaagaaaataaataaataaattttggagatggatttttgagaaatttttcatttcttagggatgtatttttgaaaactttcgggtcgattcttatggggtgtattttttttttaattttcaggtcgattcataggggtgtatttttcgttgttgcatttttgggcaatggccaaaatagatcgaaataggttttttcaaaatttttaaaatctctttaagctctaaaaaataaaaacctaaaatagcctctagaactcgaaaagtaccttcacaccctaaagcaaaaaaaacatatttttcgtgtttcaggccacggag

SEQ ID NO: 30043 - DNA, 1773 bp, Heterodera glycines
  misc_feature (46)..(46): n is a, c, g, or t
  misc_feature (1636)..(1636): n is a, c, g, or t
  misc_feature (1684)..(1684): n is a, c, g, or t
  misc_feature (1733)..(1733): n is a, c, g, or t
tttttaaatttgttgagatcggacgggcgcctcgcgcccgttacancgtgttagaagaggttcaatagtgatcagaagaggtacaacagtgataaaaagggtacaacagtgattaaaataggtataacagtgatcagaagaggtacaacggtgattagaagaggtacatcagattagaagaggtaaactgttattagaagaggtgcaacagtgattaaaagaggtacaacaatgaagagaagagatacaacagcgattataagaggtacaacagagattaaaagaggtacaacagagattagaagagttacaaaaatgattagaagaggtgcaaaagtgactaaaagaggtgcaacagtgatcagaagaggtacaacggtgattaaaaggggtacaacaatgattagaagaggtacaacagtgattagaaaaggtacagcagttattagaagaggttcaacagtgattagaagaggtggaacaatgattagaagaggttgaacagtgaatagaagtagtacaaatttgattagaagtagtacaacaatgattagaagaggtacaactgtgattagaagaggtataactgtgattgattagaagaggcacaacagtgatgagaagaggtacaaaagtgattaaaagaggtacaacaatgattagaagaggtacaacagtgattagaaaaggtacagcagttattagaagaggttcaacagtgattagaagaggtggaacaatgattagaagaggttgaacagtgaatagaagtagtacaaatttgattagaagaggtacaacagtgattagtaaattcattaaattaaaatgaaaatattttttaacaaatttaatttaaaaaaatacatgaaattctatcaattaaaaaaataattaatttaaacttataaaatgtattcatcaaaaaaaaaattaatttaaatataattttttatttattaactcaacaaaatattttaaattaattaaaatcattgaaaataacgtaaaaatgcacagaaaaataatgttacaccgtccggattcgaactttgacccccccccccaaaaatgatgcctcagaatccccaatcacacagggattctgaggacttgacgatgtcaaaagtaaaatctgatcacgtattcgtgatcagcaccctcaaatagccctaatgacatgtttttggaagatttttgttaaaaaaaattttccactcaaaaatcctggtcacccccctttggtcccgaatctcaaaatcacttttatttttataacaattcgcaaaaaagtgataaaaatgccaaataaaatttatttaatagagcaaaaaattgcggatttttgtagtattttacttttcccgaatagcttttcagaaggcagctacgaatttttttctgaaaaatcgaaaatttccagaatttctggaataactttttttgtttttgtgctataaatttcaaataaatctcataaaattttcccgattttttgctatttttaaagctttaattcgccaaaatagacctgatctgaactgagttatgaattttcaaatattagcccaaaatcccgagggccaaaaaattgccaaaaaataaagaatttttaaaaaattccaaaaattatganaattaaaatagacatcatattcgtactcagcaccttattttacccagnaaaatatttttcacccccatttttcgtcgaaaaaaatttcccgaaattnctagggggcctagctcgaaaattttgaaaatttacatcat

SEQ ID NO: 30044 - DNA, 1217 bp, Heterodera glycines
tatttaaaagaggctattttttttcccttttcacaaaagaattattaaaaaaagccaaaattcgccttaaaattataagaggaaagtttgaaaatgtttcttaaaaaatttaaggatgaaatataattagaataaatcaaaaagaaaaaaaaatttatttttctaaataaataaaaaacattgtcagaggcagtgcctgccgaaaaaaagacaaaaaatttttcgaaaaaagctaaaaaaattgaaaatttaaataaatttaaaagtgaaaaaaggaaaaaagcttacaacaccttcgattcccaggacgtctccgttccaagtactaagaaggcccaacgttgcttaacttgccagacggacgggatggcgtgctttcaacgtggtatggtcgtaagcaaaggaaagcaatgaaagtaatttaaataggcatatttaaaagagcctatttttttgccttttcacaagagaatttattaaaaaaggcaaaattcgccttaaattaataaggtgaaagtttgaaaatgtttattaaaaaatttaagaatgaaatataattaaaataaatcaaaaagaaaaaaaaatttatttttctaaataaataaaaaatattgtcagaggcagtgcctgccgaaaaaaaagacaaaaaatatttcgaaaaaagctaaaaaaattgaaaatttaaataaatttaaaagtgaaaaaggaaaaaagcttacaacaccttcgattcccaggacgtctccgttccaagtactaagaaggcccaacgttgcttaacttgccagatcggacgggatggcgtgctttcaacgtggtatggtcgtaagcgaaaggacagcaattaaagtaatttaaataggcatatttaaaagagcctatttttttgccttttcacaagagaatttattaaaaaaggcaaaattcgccttaaattaataaggtgaaagtttgaaaatgtttattaaaaaatttaagaatgaaatataattaaaataaatcaaaaagaaaaaaaaatttatttttctaaataaataaaaaatattgtcacaggcagcggctgccgaaaaaaaaaacaaaaaatatttccaaaaaaggtaaaaaaatagaaaatttaaataaatttacaagcgaaaaaggaaaaaagcttactacaacttcgattcccaggacgtctccgttcccagtactaaaaaaggccaacgttgcttatcttg

SEQ ID NO: 30045 - DNA, 1817 bp, Heterodera glycines
cgtccggtgcacactttgtgtgttactggtttggttggcttttctgccggtctttccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaaatcagcgtgcttgtccttccccgaaaagggggttggtaaacccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaacaaggtagctgtaggtgaacctgctgctggatcattacccaagtgattcctattcaccacctacctgctgtcctgttgggctagcgttggcaccaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacatgtgaaagcctgtgtatggctgctgcgtggcaatgtgtcggtggcgggccgcctcgcttggttggttcgctgcgccaatgtgggatgcacgctcgtggggcgacctaacggctgtgctggcatctgtgcgtcgttgagcggttgttgtggcaggcacataacacatgactggggatggtggtttcgttcccggtcttacgtgccgtaactagcggtgtgtttgtgcttgctgctacgtccgtggccgtgatgagacgacgcggtagggcccgtgcttggcctagcacgtggcttaagactcaatgagtgtcagctcgggcaccgccagctttttctttttttcattatttttttacacttctgttgaagaatgaattctagtcttatcggtggatcactcggctcgtggatcgatgaagaacgcagccaactgcgataattagtgcgaactgcagaaa

SEQ ID NO: 30046 - DNA, 1178 bp, Heterodera glycines
aggtaagaaaaaaaacttttaaattttcccgggggaacgtagtgcacctctccccacccctttctccaaccaaagcaaagaaagttagaggcttgtaatacgtcaccctattgcgtgcgtgtgtgtgtcaaggcgccataattgtttgaattaaaatgtcaattttcaaatttcagatcattgaacgagccgattggacagcgagcgatttttgtggccaattgtttacggactgtccaccaaactcagatgaaatgcaacaaattttgtcttcctttgagttagccaacaaattgaatggaagcgcggcgaatagagacgaagaaaatggcggaggaaatgatggcggaggaggaggagggaccggcaatttattggaatgaccaattaattagaaaaaaaaacaaaaaaaagcatcaaaacgccaatgtgtattttgttttctttattttaaatggagacttttaaatgcacttttcctctgtgtcacaattgtcattatttctgtaaccaactccatttggaaatttatatgttcatgagtaatgacggttccgagctgctttgtgggtagggccaagggttttgaaaaagtcgggaccgggattcgggagtggaaccaggctgggataggattgattatctgaagtttaggtttgccggtgtttgaagaccctggcggaatttaaatccaaatttgtcggaatcgaattccggctccttttcaaaaaaacaaagccaggattgtggtcctggactggaccccgtcctggctctatgtaataaacggactctttccctgataaggcccaaattattataaaaatttttgtataaaaaattgtgccttttattacacaattacttaggtaaatcaagcgccttttaaaaggtttgattgcaacgtcaaagagtgtgcagtttcctttcccctcccctcctctcttttctgttgtgttgcggacgaaaagcacaaccaaatccaatcgatggtttgcgcggcttacgctcaaaccaaaaaatgctttatttcccgcattatgccctcgggggggggggggggatgcgttgcgcagcgatttatacggcgcgagcaccgcacacacgcgaacacttattaagcaatatgccgctgggcataaaaccgcgtgggcgtagggataatgtgaaaatatacg

SEQ ID NO: 30047 - DNA, 1254 bp, Heterodera glycines
  misc_feature (1233)..(1233): n is a, c, g, or t
ggggacctctagagtcttatctcccaattttagccgtgccttatggtgaacatatatgtgtacatttgtttgcgagttgctttcagcctcagacagcagtgaaagaggcaaagaaagaacgaaaaacattggggaggaagtgatcggcagagcaaatgatatgaaaaatggaaatgattgtgattttgtgaattgaattgatcaaaaatgaaaagccaagacttttgtgagtagtcccaacttgaaaatacacgtaaataattaattgaattttaaaatgcggaaacgaggtttgattgtcggagatggggccagacaaagaacatttcaagcgcttccggttaaagttttcacaatttaaagatatgctctggtataattgtcagattttaaattctttaattttttattgaaattatttcaatattatttatcaaattcttcggaaaagaaagaatattactttttttataaattttttgacatatttcctgcttattgattttacaaaaagatttttttcaatatttttgtcggatgtatttaattagggtcggggtcacttcggcgcggaccatttcggcgccgcaaattttgaaatgctataacttttttatttgtcagttagctttagccaatctggcatcatttgaaagctctatgtgtgctctatatttacatgtaaaaatagaaacgaatgattcaaaaataaaaaagttatgccacgcggcgccgaaaaagccaagaaaaagttaatttttgaggttttttggccataacttttttgtaaactgacgacattttttgaaattttacaggctaatagagaatctgaagagctatcgaatgataacaaaaatttttaatttggttgatcaggaaaaaagttgttagcaacggcgccgaaaaggccggcgccgaagtgggcggttcccatttaattatgctttacgttgttgtcggaatattaaaaaattgccaagccaaatgttatgacgttgtaagtgttggcataaatataagggagtcaaagtcatcataaatttaacatttacctatatgcaaagtatggcgaattttaattttaatttttttagaaaaatgaatttatttcttattttattattgctcctaataattattttaaataatgttttattctttgctaaagacacgaaagagcagcaacctgtgcccgatggtttgtcttatcttggaattgaattttctcanattggttggcctttctctgcg

SEQ ID NO: 30048 - DNA, 1029 bp, Heterodera glycines
agagagagaggaatagcacatcatacatacacttcgtttctgatcatttttctcttatctgttccatccatgcattattttttgttggtaattgtttagtaaatggtacgtacccctcgcccctttttttggggaaaaaaataccctaaatttataatttatttctttgaacttttgtgattgctgatcacaaatccggcattcatttcaacaaattacaaagctcggacgcgaatttcgaacaaaaaccaaattttcgagtttcgcattttttgcctaaaaatggttcattttttttgtaaaatgtaaattttctaattttactttaataatttggatcggggtttgaaattaggtagtcgaaatgggtgttagattcgtgatccatgatcttgaaaacgccatgtttgtattgcaagggggggggggcggggcgtatcacctaaactattacaccttttttgattcaatttaatataaaattaaataaaaattgttttatttaattcgtttcaattttaatgtttggtacaaaattttgccaataatttctttctttctttttttttgttgccaaaatgtgtgacaatttgttgtccaaaaagggccaaccatttgctgttgttgaggaccggaattacgacagcttttcgtcatccatcggaagaagaagccatttgacaacaccaaaaacgacgacgacgcaaagcaacgacaccgcggagggacgacggattcgaaagcggaggaacaccggcgaaagtacgaaaaattggggaatttttttttgaaatttaggacttgctgccatattaaatttgtccttttttagtaaaaattgaaaaaattagaatttatttctaggatataatttttgaaataaaacccatttttaatgaatatgaccattcaaaaaaaccgtttttcaaaattttaacaaaattttcctttaaattgtgtagtaatgcgccgcaatgccaaaatttgaaaatatttaaaaaaaatttcgacccttccaaaaatggggga

SEQ ID NO: 30049 - DNA, 1344 bp, Heterodera glycines
tttctacactatggaggacaaatacaaaattttcactgactttgttttggaaaatttgagtattaatatacctgaaacaaaatttttgaataagtctaaaccttcatatccagcgcacttattagcatctattaaagagaaggccagactattcagattagggttgcaaccccgacgtcggggttggaaaattcggggttcggggttgtcggggttggaagtgtcggggttcggggtcggggttgccaaatcgttcggggttcggggtcggggtcggggttttttaattttttattttcgctatttaaggttcattttttaaattttattcaggtaaatgactcaatatttttaatcatcattaatcatttcattttcataatcaatgagatcgataggatcaggttcaattggaggtgccagctttacatcatccatatttgccttaaccactaacatttgtcgtaccgtttttccggaaagtctaaaatatacttatttttaatttatttgagaataatgcaattcacttgtttctcaaactatttgcataaattagtccagccttgctaaaaagtctctcactgctcacagaggttgctggaattgaatgcacaatttgagcaatttttgccaactcaggaaagcgaagtccgttttccttccaccacaaaaatatgtcagcatcaattccaactcgttcaacatctttgtaaagcgctaattgagcttcaattttggtgccaacggcgggggcaggttctccagaaagtgtcgatggtgtaatcgatgaactgcaaaaagattttgggttaccgttccaaatgtccactaaattttattgcaaattagtttgtactcaattaattgtttacattttagttcactctcgtcactttcactaaaatccgtaaattgagcagattctgactgatccaaatattgtgtttcggaaaaattttgctcattggcaaaacaaaataaaattgagattaaaattgtttaacttactttcctttgcaaactcaattaaatcgtcggcaattgctttccagaataaataaattcagatcatatgcaaaacgggggtccaacaacattgaaattcgcaataattcattctctttgtaattgtgcattcgagagccaatagattcagcaagaactttgagcaatgatcataatttgttgtgggtgttcttctttggttaaaaagtcataaagcctttttagagttggcaaaatgcaagacaagttgacttttcgcgtgaaaacttaaaattagaaaatagaaaagtttatagattaaattgttgttactctttccgtttctctgttaaacag

SEQ ID NO: 30050 - DNA, 732 bp, Heterodera glycines
acattaagtttcgaatgataccaacaatgttggatttggatgacaaagaaaaaagttgtagaaagttatagtggaaaaacatgctggcgcccaaccgtgagcgcccaactgacgcaaaccgaattttttgtattaatcgacaatttacttactcaccgtatttgctctaattatcccccatggggattatttttcaacctcctcgtagactgggggataattggagactgggggattaagatagagggattattttcaaacccctcctagactgggggataattggagattgggggataattagagcaaatacggtatctattaatttttatgtatttaattgtttgattatttatgtttgtgcgattgttcaataatcatctcattggctaatatgtaaatagtcggtcagggtcgttttcgtaccgccgttttcgtacgggggacattttcgtacgagttcttgtacaagcgtcagattcaaatagaaaaacttaagaactaataaaaccaaaatttatcattttttgtttcccattcataaaattttgtagaaaattcataacattatacaaaaataacaaaatccgggacaaactaggtcgcatctcataattttggaaaataccagcgagaaaattgttaaggttttcgggattgacattggcattggcataattatgatcattttgggggacaatattgttattgatatcgttatagcgttggacg

SEQ ID NO: 30051 - DNA, 1239 bp, Heterodera glycines
acaacaacaacaacaacaacaacaacaacaacaacaacaacaacaacaacaacaacaacaacaacaacaataattggccacaaagttgtgacccaccgatgcaaccatcgccacctgggattgcgctgatcagtaatcagcgaacacaggcaaaaaaattaagctttttctgagaaaattaatggagggagaacaagttttacatagtgaatttattggaaattaaaaaaaccctttttaagaatcaaaattttaaataatagccgcaaaactttttgttaattcgatgcttattaatagattaaaattcggctgaagatcttcaaattttttacgagcgtttattcatcaaaattggttctggtagcattgaaataattacaaaaacttgtgaaaagatttcaaatatccggttacaatcgcattaattgcttctaattgcccatctaattgaccactcagttttatagaatagccaagtgtaacaacttccatttaaaagattatggccaatcaaataatttagttgataaagtgcattggtatgaaaagaaatttatgacaaatcaaaaaatttaatgaaggttcttccgccgtcgcttagtccgccaccgtatcgtcaattcgacttgcaacaaccgtatcggtggccggcagctgccgaacttcaacaacaaccagaacaaacgcaattttccagcaattttggaccattgcgtcaacaacagcaacaacaacaacaacaacaacaacaactgaatcaaaggcagcaaatgaaaagtggaattggtaattaataaatgaacaaaattaaaagcgtattattttattttttaagggttttataaaaatattttattttcatcaaaatttatcaattaatttgcttgaaatccgtgaaattatcgcttgaaggttcgcctccttattattttgacatataaaaaagaaagacactaagagacagacctaaatgcatggaaactttaaaacttttcaactttagaatagagcaaaaaagtcaatttttgataaaaaaaacacagcaacaaattttacaaaaaattgataccccaaataccaaaaactttgcatatatcgaagttattaaattaatatataatttttataataaaattgtttagcatcctgcaccaaatagccgcttcacaacaactttagcccctaattgcacatcccacactgtttcaccacgaaatccatcaaatcgtgctggca

SEQ ID NO: 30052 - DNA, 1264 bp, Heterodera glycines
  misc_feature (59)..(59): n is a, c, g, or t
  misc_feature (65)..(65): n is a, c, g, or t
  misc_feature (144)..(144): n is a, c, g, or t
  misc_feature (1189)..(1189): n is a, c, g, or t
gaaaaaagcttacacacccttcgattcccagacgtctccgttccaagtactagaaggcncacttngcttacttgccagacggacgggatggcgtgctttcaacgtgctatggtcgtaagcgaaaggacagcaattaaagtaatntaaataggcatatttaaaagagcctatttttttgccttttcacaagagaatttattaaaaaaggcaaaattcgccttaaattaataaggtgaaagtttgaaaatgtttattaaaaaatttaaggataaaatataattaaaataaatcaaaaagaaaaaaaatcaatttatttttctaaataaataaaaaacattgtcagaggcagtgcctgccgaaaaaaagacaaaaaaattttcgaaaaaaagctaaaaaaattgaaaatttaaataaatttacaagtgaaaaaaggaaaaaaagcttacaacaccttcgattcccaggacgtctccgttccaagtactaagaaggcccaacgttgcttaacttgccagacggacgggatggcgtgctttcaacgtggtatggtcgtaagcaaaggaaagcaatgaaagtaatttaaataggcataattaaaagagcctatttttttgccttttcacaagagaatttattaaaaaaggcaaaattcgccttaaattaataaggtgaaagtttgaaaatgtttattaaaaaatttaaggatgaaatataattaaaataaatcaacaagaaaaaaaaatttatttttctaaataaataaaaaacattgtcagaggcagtgcctgccgaaaaaaagacaaaaaaattttcgaaaaaaagctaaaaaaattgaaaatttaaataaatttacaagtgaaaaaggaaaaaagcttacaacaccttcgattcccaggacgtctccgttccaagtactaagaaggcccaacgttgcttaacttgccagacggacgggatggcgtgctttcaacgtggtatggtcgtaagcaaaggaaagcaatgaaagtaatttaaataggcatatttaaaagagcctatttttttgccttttcacaagagaatttattaaaaaaggcaaaattcgccttaaattaataaggtgaaagtttgaaaatgtttattaaaaaatttaagaatgaaatataattaaaataaatcaaaaagaaaaaaaatcaatttatttttctanataaataaaaaacatttgtcagaggcagtgcctgccgaaaaaaagacaaaaaatttttcgaaaaaaagctaaaaa

SEQ ID NO: 30053 - DNA, 1530 bp, Heterodera glycines
ctgtggccatccaacaaattgtatttgactcaacatgagagggttttgggattaaaaaaatgaagtaaaaaacgttttaatcccaccgaactcatcgccaatttggcgaccaaatttccaaagttcgcaaactctgctcattgtgggacggcgcttctcttcggcaaccccaaaaaactctttgaaatttttgcgttttttctctaaaattttattttgctcttcggttaagcttttgatgctagcattttttaatatttcctcaatttcgtttgcaaataccgacgcttcgatttcaaatattaaattttggtccaattctttgggaacattcgcttcagtcaattcatcaactgtctgctgctccttttttatcggcaagccgaacaattttgaatacatttcatcaatttgggcccaagaaggcactgaaaaaagaatttatttaacaaaaaatttatttaaaatacaaaaaatgtaattaaaaattaaaacaacaattctttgcagtgaaaagaaaataggggatcatcagaattgaatcaaccccattagtgatgctcgggagcgaaactttcccgagacttgtgaccgaaacagctgaaagccgagacttttcccgaggattttcttattgtattacgaacaaaaaaacaaatataaaacaaaatatgtaaaataatttttattattattagttttggacaaaaaacttcgaaaaaaataaaataggcaaaaaatgcataaaaagacctaaataagcttataatcaagttcagctattttcgaaatttcatttttataaatctcaaaaattctcaaatatgtaaaaatgaaactattcgtaaataaattagttgtaaatagtagacacttttcaaaattatggtaatcaaattatagaattcgcagttttttcaaacgaaagcccaaaattaattctcggtatttatgctaaattttttattttcttttttttatgtataatttttacattttggttgagtttcagacaaagtcgaaatgacaagaagaaattgaaataaaagaaaaaataatcttgtcggtagaatcatttttggcactgaaaaagtaattcgcaaaaacaaaaataaataaaattaatgttaaaaatttacatgaattttcaacaaaaagttgggatgaggtatagccaatccccacaaaaaatggcacaaattatatatcccaatcaattgtctcgagtgccaaaatgtgtttaaggcgttttctgaccagtttaaaagccgaaaagtcaagaaaattggacatcactagccttttaaaacaattaactaattggtatcattagtgataactccgccctccgtctcgtctcaccacttttactccaatccccttagcggcctcgagacgattcaattgggtatataatttatttgtgtcattttttgtggggaagggaggattggctatactaactaaatatctaaatgttgcttctccatataaaatgaaaacaaattattaattaatgaataatttttt

SEQ ID NO: 30054 - DNA, 1109 bp, Heterodera glycines
atttcaatttgggaagcagtaaattaacaaattcactttttatttcaataacattttatttgttttttcggcactccgttgggccgacgcaaaatgccgtaaaaatggcattgaatgttcagcagagaatcgccgtcaaatgcttggcccggcacttttcaatattcgttttccgctcgtccaaaaaatggaattttcggagaaaattggtaaaaaaaatataaattaattttatttattttttctaaatctttcagttcctttcggcgtgttaacaatggaagaagtgatcggcattgaaaagtaccacagtcctccaaattttcgtgggatgtccaacggcatattgtacccattgcaatttccatgtcatggacgcatttcacctcgtggcacaattctggtgcacattgacaaattgtccgaatttgcgggagaatctgtggggagtcgccgatacagcataattgagccaataatgggatttggatggagaattgtggcgcaaataagaataaatataaaaaccaaagaaaaatttttgggcttttgtcttttctctctggtgccaaaaggaggttaaaaaaaagcattattaaaattgcctaatgattgttttatttgttttaagattcgtgcctttgctcggcaacctttcgaattgtcacacaaaatgccgaagctgagaattgcattgggaaatttaatgacatcatttttaacaataaatcgaacgatcggggattcgttaatttcattaaattgacagttaagatgcactcacttaattgttctaattactactaattaaggaattgatggatcagggaaatggtttttacaacaaaggcgaggacaaagtgacattggccattgatttaatagtgaaaaatacaaaagtggccaaattcactcatgatccaagcaaatccgacgcaacaatttcgatggaaattgaaaaactgtcggaatttgcgcgagaagtcattaagagtgaacgtaaaagcgaaactgtgcgcatcaaaggattttcatggcaaattttggcagaaataaaaacgaaaaatggaacgctgacaataatgagaaatgtttgggcattttccttt

SEQ ID NO: 30055 - DNA, 918 bp, Heterodera glycines
aaagccaattcgaatgtgactcttttggacattttgataatgatttttttttcatttcatatactggaaaatatattttaagcaaagggcgggcggagagactcaaacaaattgacatcataggttttttggggtgagacaccccccgcccccctccttcgtcgtaaatggctccggatgatggggtcttcgtaatgagggggggggggggggggagggggattcgttgcgaatgggaaaaagaggaaaacttgaaaaaattggctaattttcttgcaaattcattaaaaattctttaaaaatttccacatgccgcctatcggcattaccggccccctttttcccaaaggttttttggataaagcggtccgaaagctcgtcgatttacatggcagggaacccttcgtaaaatttggttgacctttccccatttttaacgtctgattgacatggacaaaaattaatgaccccaaaaatagttaattaggcggagaaagacaattttacgactcatgaccataagctgaccaatttgagcacgggataacaaatttatggtaatttgcacatttttatgaattaatttgtatttgaacgatgtagtttaatgacttcgcccggacatttatgtatatatttttgttaaatagtcgaccttgaccaatgagagaagttccacactgtagatgaacatttgagcctatggataaagacatagacctatccgtcacagcgagtgctaacggatcagcactgtacgcgacaacaagaccaacatccagagacaaaatcggagggcagccgtgacggtttggctttcgcagcatcaatcgggaaccgctgccccgtgacgaagatcaatagacacaaatggtcccaaattgctgtctaaaggaaggaaggcaccgtcactggatg

SEQ ID NO: 30056 - DNA, 1110 bp, Heterodera glycines
cagcctttaatctcccagggagagaaaagtttttgatggtctgcgaaaattagaaaccaacacgagatttctaattttccacttcgagcaatatcaccacgagataaagctcggaatattgtttgccggtgatgtgcaatggatagctgactgcgccaaaaattgttatgtccgaagataacaaattataaaagtttatttgccggagaaataaataataaataaatgcagagaataaattggaaaggtcaaattggtgggcacaataacaactgaataagaggggaaaggagagggaggagaatggggaagtgaccaaagatatgagagggtgctgggtggggtcatacacataatcaatattacttccttctctaacaatgagctttaagtatttttggttttatttaatatatgtttcaaaatagggttgctccccgactccgtgccccccgactcaccgacactaattcgggggattggggactccgagcgttgtaaaaatttaaaagttaattaaacaacgaaggaggaaaaggttgaaaatttttgaaatcttgaacaattttgttaataaaattaactaaaaattccgaaaaacctttcggcggcgccaatcgacaccgcctgccccccaaactccaaattttttcttaaaaattgattcgaaaataacaaaatttggacaatttttggacaaaattctcttaacaaattatactcattttcaaaaaattttccgccggaccacttccccccaccccaagtttccaaaagttttttgaaaatcgcaccgctaaaattgttcaaatttatgagattaaaatttttgagcctcgaaattcgattttcggtttctgaaattttttggagcctgggatgccttgttataaaatgccaaattggacgcaggctccaacgaatgaattttaatcagatgattaaagtgaaaaaaggaagatttacgagcatttaaaaaagaaaaattggttttttcgttaaaaaattttgttgatcactacccgatcggggtccccgacctccgacatgacgccccccccccccccgaggtccccggccccccgacattttgcccccgaggggtcgggg

SEQ ID NO: 30057 - DNA, 1080 bp, Heterodera glycines
  misc_feature (1069)..(1069): n is a, c, g, or t
tcaacctgttgacgctctttgcgcccattgtctgtccgcgtgccaacttggacaaatatttggcactcagtcgcgcttcaaaccaaaacagtcggaatccgtgccaggtgtgaacgagggcatgccatgccaaccgtgccagtcctcttgggtcccgcaatttgttccacactcggataagcaatggctgcttgtgttgctggtcaccactgctgctgccgctgtcccccgtcgtcggcggcgccgtgccaccgctgccagatgcagcctcctgatgatggcataatgcaattttgccaaaaaattattttattgagtggggaatgacatcgaggggagggcatcccaagatggattctcgttgaatttttaatatcttgggatttttgtgttggtttagtgcccccggcaagaccactcgcccctcttttggtcgcaattttttgaaacttacaattaaccaaaattttcgaaaatttgtaggaaaaaaattacgcaccaaaatttggcgaaggtcgccagagaaaatcatttttttagaatgaaatgctgaattgaggtgggaaaaaataaattagcggaataaatgaaatgagaaaaaataaaattaaatgaggaaaaataatacatggatgttgaaatgtaatttttatgaaaaagggtagcaaaagaaaatgtggccgcaatttttatttaaaaaaatcaagatcaaaaattcatagttatttaacgatgtcaaaagaaaattctagcctaattctttttttttgaaaaatttactgggtttgcattgggcttaagctggacccccccccccaaaaaaaaagctaatttaatcttggtctgatttttggaaagtgaataaagacaccaaacggattgggagaggtttggaagggctcaattatcgaaaaataccgaaaatatgtacaaacaaagaagagaaaaaccatggtaatttagcagacatttttttatttgttagaaggcaccataaatggacaaggggtgcgccagggcgatgcccatacgccgaaaaaattggcacgggggggggggggtgcgccanaagcccaattt

SEQ ID NO: 30058 - DNA, 1628 bp, Heterodera glycines
  misc_feature (47)..(48): n is a, c, g, or t
  misc_feature (73)..(73): n is a, c, g, or t
  misc_feature (1056)..(1057): n is a, c, g, or t
  misc_feature (1062)..(1062): n is a, c, g, or t
  misc_feature (1066)..(1067): n is a, c, g, or t
  misc_feature (1078)..(1078): n is a, c, g, or t
  misc_feature (1080)..(1080): n is a, c, g, or t
  misc_feature (1105)..(1105): n is a, c, g, or t
  misc_feature (1107)..(1109): n is a, c, g, or t
  misc_feature (1112)..(1112): n is a, c, g, or t
  misc_feature (1114)..(1114): n is a, c, g, or t
  misc_feature (1116)..(1117): n is a, c, g, or t
  misc_feature (1119)..(1119): n is a, c, g, or t
  misc_feature (1130)..(1131): n is a, c, g, or t
  misc_feature (1134)..(1134): n is a, c, g, or t
  misc_feature (1136)..(1136): n is a, c, g, or t
  misc_feature (1150)..(1152): n is a, c, g, or t
  misc_feature (1156)..(1158): n is a, c, g, or t
  misc_feature (1160)..(1160): n is a, c, g, or t
  misc_feature (1163)..(1164): n is a, c, g, or t
  misc_feature (1166)..(1166): n is a, c, g, or t
  misc_feature (1169)..(1169): n is a, c, g, or t
  misc_feature (1171)..(1171): n is a, c, g, or t
  misc_feature (1179)..(1179): n is a, c, g, or t
  misc_feature (1182)..(1182): n is a, c, g, or t
  misc_feature (1187)..(1187): n is a, c, g, or t
  misc_feature (1190)..(1191): n is a, c, g, or t
  misc_feature (1196)..(1196): n is a, c, g, or t
  misc_feature (1199)..(1199): n is a, c, g, or t
  misc_feature (1204)..(1206): n is a, c, g, or t
  misc_feature (1209)..(1210): n is a, c, g, or t
  misc_feature (1223)..(1223): n is a, c, g, or t
  misc_feature (1227)..(1227): n is a, c, g, or t
  misc_feature (1229)..(1229): n is a, c, g, or t
  misc_feature (1237)..(1237): n is a, c, g, or t
  misc_feature (1256)..(1259): n is a, c, g, or t
  misc_feature (1261)..(1261): n is a, c, g, or t
  misc_feature (1265)..(1265): n is a, c, g, or t
  misc_feature (1268)..(1270): n is a, c, g, or t
  misc_feature (1274)..(1274): n is a, c, g, or t
  misc_feature (1285)..(1286): n is a, c, g, or t
  misc_feature (1293)..(1293): n is a, c, g, or t
  misc_feature (1302)..(1302): n is a, c, g, or t
  misc_feature (1304)..(1305): n is a, c, g, or t
  misc_feature (1307)..(1307): n is a, c, g, or t
  misc_feature (1309)..(1310): n is a, c, g, or t
  misc_feature (1320)..(1320): n is a, c, g, or t
  misc_feature (1327)..(1328): n is a, c, g, or t
  misc_feature (1330)..(1330): n is a, c, g, or t
  misc_feature (1332)..(1332): n is a, c, g, or t
  misc_feature (1339)..(1343): n is a, c, g, or t
  misc_feature (1345)..(1346): n is a, c, g, or t
  misc_feature (1352)..(1352): n is a, c, g, or t
  misc_feature (1358)..(1359): n is a, c, g, or t
  misc_feature (1361)..(1361): n is a, c, g, or t
  misc_feature (1374)..(1374): n is a, c, g, or t
  misc_feature (1377)..(1377): n is a, c, g, or t
  misc_feature (1380)..(1380): n is a, c, g, or t
  misc_feature (1391)..(1391): n is a, c, g, or t
  misc_feature (1399)..(1399): n is a, c, g, or t
  misc_feature (1439)..(1439): n is a, c, g, or t
  misc_feature (1441)..(1441): n is a, c, g, or t
  misc_feature (1443)..(1443): n is a, c, g, or t
  misc_feature (1448)..(1449): n is a, c, g, or t
  misc_feature (1451)..(1451): n is a, c, g, or t
  misc_feature (1462)..(1462): n is a, c, g, or t
  misc_feature (1510)..(1510): n is a, c, g, or t
  misc_feature (1512)..(1512): n is a, c, g, or t
  misc_feature (1532)..(1533): n is a, c, g, or t
  misc_feature (1561)..(1561): n is a, c, g, or t
  misc_feature (1564)..(1568): n is a, c, g, or t
  misc_feature (1573)..(1573): n is a, c, g, or t
  misc_feature (1576)..(1576): n is a, c, g, or t
atatataaagttagctattgcaacaattagctcaaattactcattannctgcttaaagaaagcagtgcccttnccgctggggtttcccgcatttcactttctccgccccttcgtcccccgcagcgatttccaacgacgacgacacgtgcattgaccggttggaattctggaagtgcgatgagttcctttatgtgtgccgttattaccgcgagacgtacgccttcgaaatgtgccgcaaaacatgcaatctgtgcgacttcaatcggaaggcgaaagtgaagctgatgatggcacaaccgtactattattaccacccttattgaagtggaaagaatatttggacaagaaagaattgcaaattatcaggacaaggacacgaaaaatgctaaacgagtcaccaaattagagatcggcacaatcgatcttttttcgcttttgtaccgaaaaaattatttaaaaaaaccatttgaaaaagaaccaaaaatatccaaactctaaaatgccaaaaaaaaaaaaaaattaattttgcgttttctgtgtctttaatgtacagttaacatgattttgcaatgatcttatctagtttcgcctttaaacatccatttcgtggatttagccctagaaatcccatcccgactaatcataagataaatttcgatgcaaattaacattttaacattcaattccatcgtattggcaaagaatagatgggtgattgtggggcgctgtcactcggcccattttgtagcgggtgccgtcggcatcaatttgccaggcacaatgaaaattttcgaaatagttcagtgtcgaaaatttatctgtgccgaaaatactcagtgtcgaaattaccagccgcgcattttcatttgaaaaaatattattaatcatttttttattaaaaattctcagtcattgttgagaattgctgtgctcccggtcctttcttaacttaataatacaatacataaataaaatcctgaaaaattattggtctttttcaattccgacttttctgttcttttatcgaaaaaacgaccgaaaaaatgattcccttcnnttctnttcnnttttttcgctngngcgtgtccccgtcgtttttccgttntnnnttntntnntnttggtccctgnntgngntggggcggtttctnnngtgnnncntcnntntcntnggtgtccngtngtttngcnntctcngtngtttnnngtnncctcgcctctttnggcntnctcctctngtggcgggtggttcgtttnnnncncgtntgnnnccgntccttggttgnnccttggncggtttttntnntntnntcgtttttcngtcctgnntntntttttgnnnnngnntccttntgctgnntntggttctttcccnccnttntctcctggccncgttttcnttcgttttttgttctgcgttttccccgggtttcttgtttntngngttgnngncgttcgttgtncccgggtatgtcctccttgtttttcttccgtcttggtgctttgcgtgntngtgttttttggcccttttcnngtgcgtcgataaaggtttcctctttggnttnnnnnccggngcnccaaatttaaagatggaccgacaataaatattaaatatatttataagaatga

SEQ ID NO: 30059 - DNA, 1796 bp, Heterodera glycines
cctcccttttgtcctcctcgtccccccattggtcctcgttctcccattttggcatttcctctgctcaggctacgcttctctcgctccgcgggtggactccccgtgggtggcactccgttcggcttttccccttttggccgtcctcctcgtcctccctttttgaagcccccgaaaaagttgaagaaagggcttcgcttgcggcgatcgtttgattcttccgacatttcattgcttggcggtggtccgggaggggattgctcatcattttcatcattttgcattgactcatcggccgaacatttgacgacgaaaagtgccacgaaagcgaggaacagaagggagcgcatttaagagagaaaaaagccaattaaattaattaattaattatgcctttgtacggttttctcttttccctcgccttttatactccgttttctaaatgatcggacactttttgcttcatttttgcccctgtcttctgttcaaacatcaaactctccaatttgacgtttttcataatttaaaaatcgtgctgtttttttgaattttcattttgataatggatttccgtcctaaataatcgtaggtgaacaaataaatggcgaaatgtttacgtggcacttcaaattgaggtacagactgatctctttctcaattcaacaattaaagtcggatccacagaaagtgggcatttgtttattaaattttaaaatagtgacaaaaataatgttgtcaaatgccaaaattcaataagagaatgagaggctacgcagaacttctgggaattggctaaatatgtattcagtttaagcatttgttaaatgcgccaaaacggcgttttttcatagctaaaattttattttatttatttgacttttttattataaagcttatttctctgattttttcaaatcaaaacgattgtagaatgtctgtgcatgatgttctattaattgggtgcagttttactatgttggagaattgaggacccaattccccttggggtgcagaaattcggatcactcccgatcacatgaaggagtgatatgatcaaggtgattcagtgagttcaaaaggtgttatgagtgaaatttgaaggatgaaaattagaaataatttatttataatctttatttttgttttgaagttgacaaattattattttatttctttgttttttatattccgataaacacataaattgacaattttcaacatttctttaaaaatcatcaaaattgcaaacgaaattattgacataaatcatccaacaaaaataataatctctttgacctaaataatttgtctgattcatacttatatgtctgtaattaaatgacaatgtgtataacatgatccgttagctgttcaagattgcttgcttctccattcaatttgtgtgaatggcatatttttattggcatgacggatttaaatgtctaaaaagccgaatattaaaaataaataaataattttaccaaaattaccatttcatccttcagaagaaaatccgtaataaaagtcattttagcattaagtccaccttctatttcacatgtgtaagcctttatcacaaattccaaattgataattttgccaatttttgtcattttttctggcaaagtttgcacaaaaattctcttttttaaatcgtaccaccattcgacattattctttgagaaatgaccagtgacgtgttgcaaaataaacgatgaacaattttcgacatcattttttatgctcatttttattctatgatatttcaattcacacttttggttttgatcagttttgac

SEQ ID NO: 30060 - DNA, 1612 bp, Heterodera glycines
  misc_feature (1181)..(1181): n is a, c, g, or t
aggagtgccgttccaagtctctggtccgagattgacaccaacgaacctgtcgaggagtaagcttcttttcttcttttttttttgcttgcccccattcatccgtttcttcccgttaggttggtctctctcgaaagaaaagcaatgcgcaggcgcagcattcgttccggcatcgcgtctggggaaataagtcgggtgtcgccctttctgaacgacattgttcacgtgaacaagttgggccatgaggagatgatgaacagcagcaaattctcgtccgctgcctccgtccgttctgccaatgtgccgcgtcaacgaatgcgttctcgttccgctggtcgccaatcgatcgctcgactcatcccagcttcaaaaccgaatgttcatatccataaacccgccattccggcttcaagaccgaatgttcagatccataaacccgctccgaaagaacacatttaaattgttgtgttttaatgaagtttatttgtatcaaatgggtcttgtttaagtatgtaattggttattaaaggttaaatttatgtgaatttttcatattatttgtgtcacttttttgtaatgtccgtataatttccttgagagcgaaatgccgcttaaaaagtcgtgaacatgtttatgggggttttctgggtcggggaacccgaatccaatattcattttgaccaattcctaatacctgcccgaactcattttggtgaaaaaacaaaacgtagccctagtggggataagttcagcatcctatacttcgaattttaagactagattcgaaatttatgaatacctatttaacatttaataattaaacgaatttttaatatcgaagaaatgatgtattctgagatacaattgcattttttgttcttcccaacaatcgatcacttccaaatcaattgtcgtccatctgttcctgatcattccgcgacttcggccgatcatcagaaacattttcatctgaacagagttaataatttaaattcgaatttatatgcatttgttttttgcccggagcgtcattcaaggagccaacaattctttcctggaaaagaaattaaaatgtataaacaaataatttcatattgttaccaaatttgctcgcccttctgcgctaagccgtaccctaaaataaaaatgaaataactacaaaataattgtagtcccgctgccgngttctaatattaattaacaaaatgaaaaatgaattgaattttcgtggaaattataaattttacacattcaaaattgtttcttccatctctctttttcttttataataattttcaattatttctccttttttcccccattttatatttaaaaagaataatatgaataaatttatttagttttttcaaatattttctgttaaaaaattttcctttaataatatataaatggtggaaatgaaattgaaatgatttattattattattattgttgtaacaaattataaaaatgtatcttaaattgtttttttagttaaaaaataaactaataatattttttttcactatatttttcaaacactacgaaatgaccattttgctatgtcatatttctaatgcttataaaaagaaattttttgtatataaatttagga

SEQ ID NO: 30061 - DNA, 622 bp, Heterodera glycines
tttgcaggggcctaaaaaggtcaaggaaaggcgtctctttgttgatttagcagtagtacctatgaatttaaattttctatgaatttttaaagttttttgaaatttttttaagtgcaaaatggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattctgaagggcgggggggg

SEQ ID NO: 30062 - DNA, 1284 bp, Heterodera glycines
aaacatataaggtatttggctttcctttaataaacataaagttaacaatggttagaaaatatatacaaattagaattggtttcaattttgattgtatttcagatgggggaggtataagaagtgcattgacattctgcgaaggtcgtcaaacaacattttaatggatgcacaattttacatcccatcgccaatgttgagtgaaatttttggagaaatgcactggagcggctattctgtgagcaccaaaaactgtcaacattgggctctcgagttttttgaaaaaggttttcagtttaaaaaatgataaaaaatatgtgtatcattaattttatttaatcgaaaacatgcatctggaaaaaactggttggtgtgagtgcgaccctgaacgtgtcagtcaaaatgtcatcaagatggagcggcgcaaaaggtggacaaaacatttgcagtgtcggtcttcatccattgtccatgtcgtcaaaagtcgcctctgcacaagtcgttccgcttcagcaatgctgtacaatgtcaaagtacttgagcattttctccttttcccccattttcacattttttagcaaggggattttcgcaaattctgagagtggtcgacggacataatatcaccagcaaattgcaattcaaaaaccttatggctgtttacaattcgatgcctgacaaaaaattccaccgcactgagtggaactcatcaaaggggagcgaaattttgtatgacgagggtatgtaaaaaatttaaatggctaggcaaaaaaactaataatttagtgcttaaaccctaaactgacatttgaaatttgagttcggcaccaaacgaagaatgaatgtgttaaccttttattatgttactatttgatacaattttatatattttattccgttgctattgtaatttttacattttttgttttgtttctcattttttataccattgatgttgagttgtaaagcaatttttaacatttttgggtatttatcgttgtttgaatgcattttaacagtcttgtaaataatgggcaaaagtgctgcctatgggctcttattggaggtgagctggtcaaatttttttaatcgaagaataaatttccgctgagaacaactgttggtaaaaagaaagtttgcattcatttcaccattttgcaaaaaaaaatttttgataaaactacctatgtaaatttcaacaagtttaattgcctaaaataaatagaattcgtatttttcggttttttcctgagctctttttggtctaaatatatatggaaaaaaaat

SEQ ID NO: 30063 - DNA, 852 bp, Heterodera glycines
accgggaccgggccgggaattcccagtcatccgaggtcccggtcccgagttttgaaaagctcaagtcccggtaccggtcccgaaaaaaaatcgaggtcccggtcccgtggcactctaaaaaatatttataaattgttaattgaaaaatgcaatgaattcctaatgtaacctttaaatttattcaaaatgatcgatatcatttctcaattcattctttcacttttccttccgctgaccgttgggcccgggattcattggcagacaatcttttgcgttgatttgatcctctgctagtggacacaaaggcctcaattaaaatttagtattaaagcaaacgctttgctattattaaccccatgcaattgttgtcaccataaagcaaaatctggatgttgttcaaattgttcgaatttgggctctcccatcggaccgtcgccgtccccccgaaaattgggcatcgcttcagcagcaattcaacaaaaatttcatcaagaatttttttctccagagtcaacttttccttggtccgttcgttcaccaattcaaatggttcaattggcattaatgcggaaacataaaatcaggggtcggatctgtccttatttataagaaatgttctgatataagggtcaaaatctgataaaacaaaatctaagtatttaaaaattgtcttttattcttggtagttactagagctcgacctgacctggatccaggcctggatttatcctggatccaggtccaggccatttttcggcaacctggatttttcatgggtttttgtcaaggaaatccaggtccaggtccaacatggaatccagttccaggcttttttcaaaatgtcgagctcta

SEQ ID NO: 30064 - DNA, 1020 bp, Heterodera glycines
ccacttctttggagcaggttttcaactgtcccaagatgcgtttcatggaggtgccgcagcggttgcagacactgctccaacagcccgacccattgatcattcaccatgtcatccgctgggacggaagcggctcatcagtgggggccgcagcggcagcggacggttcgccgactgagaacaaaaacacggcatgttacgatgtgaggaggacggggctttagggttggtggtatgtcaaaatttggcacttttgtgcctttgcaggtcgatgttgagttggacgacccaatcaaacagcagcagtcggcctttttgcagtccaatgccaatgtgcaagaattgatggcactcgaccataaggttggattgagagacattaccaaaatgggggacaacgaccccaaaaaatttaaatgggaaatggcacggtttatttttgtttcccgacagtcgaaatcggcattgatgcatattcaaaataaccaaaaagtcccccaaaattgaaattttgttttcaattaagatttacaacactgttgaagagattaacgaactgaaagtgcgacgcgacttttttgccagttttgtggagaatccgcaagcatttgtggagaaatggctcatttcgcagagcagagaccttaaggtgagaatttcatggatttggatttaattattccccgcacccaaaactgaaaaattggatttcattaaaaatcgcctctgatttcccccctcccggccaatcttaaaaaatataaacacacaaaaaagtcctttttgcaatttattcctaaatttcccattttgcattgttaacaaattgcgccattttacagaatttgtccgaaatttccgccgattatgagatggagcgtcgtgccgacaattattatcagcccgttgttcaggagggcgtcttccgttacatgtaaaaattgaatgaaaaaacgaaggttattttgttcacatttcagttatgcaaaggtccaacaacgccgttttgagttggaagcgacg

SEQ ID NO: 30065 - DNA, 1948 bp, Heterodera glycines
  misc_feature (1847)..(1847): n is a, c, g, or t
cggggaccgatttacaatttgtgctgttaaaactcccaaattaatggacgaaggtacaagggaaagatttagaaattgtgcctcgttcaggtctatatatgtatgtgtgctagcatcgtcgaggagacctattcccttaacaaaattggaagggatttccgggttaaaaattgtaacttcgacacattttaaaaggatgggtatttgatggcattcttgcaaatttgaaaatgtagtatttgtttgtgatgtcaaaaaggagttttttgtgaggtcagactcagaagtgttaattggaactgagcttgtcaactgaatagaagggttaggagttaaattttgattttggttattttggtgcggaaatggttgtaagttagcttgggattgtgaataaaaggtatcattaggagaatatgttatgtctgaattaccagaaaatgtattggggtttggggaaaaagtatgagtacaataagtagaagattgcttaggtttggatttgttggacaaagcactcgtggatgttggcccttgcatgcggagcagtcggttggtgtagtgcattgatttacaaaatggccggatttgagacatttgaaacaacgctttagagtttttaagcactaattcgagctgtaacttccaaaaagataggacagtaagttgaaaaatgggatggatcatcacaaaataagcagggtaattttggtattattttgtgagtggattgagaatagggttttccctttttagaatgaaatgttagggttgaaggggggggggacgaaatctcatggttaaagggtttattagtcccgtggttaaatgtgaagtttggctttgatggagtttgttttagcagtggcaattttggttgtactgaatcgatttgctctcttctccgtaagatgttgcggagacggtccttcagttgatcagtggaccagttggcttcttcgtctttggccttgaaaatttcttccagaacgaagcgagggagacgttgctcgatttccatttgaaaagaagtagtatcataggattggtttagttaattcatttggacacaaatgcattcaatttgatcaaggagggagcgcaaatcggaacaaaacaaatcacctccacgaatacggggcaaattcttaagggaattatgcaatgagcgagctacatcttcgggattatcgtagctttttgtaagtaaagcaagcgcatcattgtatgagttatccgaaattggaagagggctaatgagggtaaggggagtcccggttaaacactgtttcaagtacgtgaatttgatggaatcggagagtggtaaatcatggacacaatatttaaaggaattccaaaaggactgatattcgacacaatttccgctaaatttgggaagttcggtttttggcagatggataacagaggaattgggagaattagtatttgttgggttagtattttgggaaatagaagtctccaatttgcggcgctgatttcggagggtacgttcgtattttttgagggtatttaaaacccggggaaatggtgttgtagcaacgaattcgtcgtaggcggtgttgtctgatagccgttcgtttccggtcatgcttgttcgcagagccatccatttgtcactcgcatcagacaattgagtaatgtaatcgtttacctcatttgtctcctcatccaggtcttggatgatggattggacttgtcggtaatgattggaatcggattgaccctgggggcgggcggggatcggaaaatctttctggttatcggcaatttcagaagcgtcaggaaacaccaggccaattgttgttcgataatgggtactcataaangatttaagttccccggccgttgtgtctcgtaattgggaaatatgcccccaaatttgactcaaactttggacggcaaatcacgagaatttattgtcactgag

SEQ ID NO: 30066 - DNA, 1465 bp, Heterodera glycines
  misc_feature (1006)..(1006): n is a, c, g, or t
atcgaatgtaaaacaaacaaaaaaccaaccccccgatgttcgccaattcgctttataagcgtggcctgggcccggaaaaggcaccgcttgagtgcaaaacggcgactttgcataacggaaaccaagcattcaactctttgacccattggtggagaagtgtagcgggacaaacgatcagagaaggaccaaggcctttatacctacaggaaaaacagggattgaaaacgcatgcaaaaagcacacctgaaaatgttggaaattgtttgactctccgagagagagcgaaggaagacgcaaagttggatggtctttccgagtcccatttcatcggccaaaatgctgaaaagtgccaatgggaaaggcaaacgcaattgctcatccattaccctccgacatattgaaaatgcaattcgtagagccatcggacgccccttttttggtatcttaaaaatatttatcatcgcttttaagcaaaaaagagacaattattgacgactttcattccttttatgacctgtaaagtctgttccaaacggaatttgaaatgcggcagtcattggacagtgtttggaagtcattggggtcgtcaaaagggtcgcccttaaatttggccaattcttggagtgaccgatgctctctgaaattggggttggccaagtacttctctgatatttattcattacttaatccgttccatataattggcctcttccccgtcgtccttaacgcctttgaccgttttttcccttcttttggcttttcctttattttgttttcttgacgaagtgtgcgcttcgttaaattcgaaaaaggtgtcacaacaagtttcatcactttcgtcggtcgaattggggacaacaaattcatcatcattggcatcagttgtgtccgatgacgctgatccgtcatcaaactcaaatgaggctcctcctttatcagagccatttaataacactgcttcattttgcatattgcataatctgaaatgggcggattacctcggtcncagcggcatcagaagagttcaaaaaaccaaattttgtttattgtttgtttattcgtaaaaataaaaaagtcatcagaagggcgaaaacctcttactctgacgactgttcagataatgtgtcgtagagtaagtgataaaataaagtgatgatcacaagaattaaaagacaaatatgtgaaaataaataaataaattgaggtcaaagtcaaatgaggtcgaaaaataaaaataaaaccaaatcacttaggaatttgttataattctatttctggtttcattaccctagtgaacttttaagtttggttttaaattgatttaaagagtttgttttgattagttctttatcgagttgattccacaattttgttaccctcccagcaaagggaatgaattttttgctcagtttatattttgagttaaatctggctaatagagcatgttaaaagctttcgaatgata

SEQ ID NO: 30067 - DNA, 1218 bp, Heterodera glycines
tttctgtgtatttaagccatttttattaggtttttgttcgaattcgggtcggggttaattgtggtcgaaatgattacaccctattttaaaatatgtttacttttaactttattcgaagcattcaagtatcaaaaagacaaaatatgagttaaaggcatcaacttattgtataaaatcaacaaattcttcaaaattcaaacaggggcttctgctggatggcctggttttgtggctgaacatcgcccttcatttccaagccctcgttttcatcctccgagaagaattcttcgattatcttgaacacattcgaatatatttgctaaaaattggaaaaaaaaatatatacaatatgacagacaaaacactggcctcagactcatgttgttgcaatgtctccaaatggtccaccccatcgcattcctcgacacggtcgcgaattcggtccaaattttcaggatcactaaaaagcggggaatgagaacaaacagtcaaattgatgcaagtttaggccctacgtttgtgcaacagtgcgcagcaccgaacggagagattcgagcatattcaaagtctaaaaaatggaaaatattgaaattgataatgaaaaacagcaaccaattcgttgttctttgtgatcagacagtcgcaaattgcctccactccgttcttgacacgacaaatttcgatgatttgattcgctgttccaccacagcacagattcgaaattgcccaacccaaagggggaaattcgaattaaaactcgaaagcgaacttagacaaattcactcaccagcctcattctgcaaacgatgttcacccttttgcaaaacactgagcaaaattggcaacaattgcgcatcaatgacatcctaagaaaacagaaatgtttgaattaaaaaggggaaccaaaaattgagagatcacttggatttgcgaggtgttaccagccaacacattggagatcaaccaacagcaatccttgacaaacgtggtactgttggaaagcatcagttgagcgatggcaccactgagaatgccggtgtcaatgacagcctaagggaaattgaaggaaagatgagatgactaataaacaaatagcggaaaaatccattttctgagtccacctgagtttgttcgtcacttccggtcacaaaattgccgagaacgcgcagtgcgggcgcaatcagcgagtcgtggccggacgagatgaaagtgaccatg

SEQ ID NO: 30068 - DNA, 2440 bp, Heterodera glycines
tcctggtttggaagcattacataataatatcaaaaaaaattccattggctttaattttgttttgtcttagtgccaaagtcagccaaggtctttatttatgtaaagaattttcaaaaaaacgaatactttttgtcacgattctcgaaaataaagtcccaaatctcgagaccgaattagtttagttacatgataattaatattttaaataatttattaatttagaaagaaaaaagttatcatctataaaactgataatggtactaattattattctcatatttttcgccacttttaatgggatttttggggttggagaaggtggtgaagaaaacgatttgttcagtgatttgtggaagaattatttcaacgcaaaaaacgttcagaaggcaaatgttggccgaaacggaggacaaaaagtgaccaatcgcgtaaagatggaagaaagggacggtggtgtagaaatgggtgcggtcggcattcgcatgccacccaaattggcacaaatgttgatcaaaactgaaccaaccgcagcagcagcagtttttgatcagctattgaaaaatgtaaagcatgagccaaaagaggaggagtttgagcaattggacattggaaaaatgggtgtggttggcattcgcatgccacctaaattggcacactctgtgatcaaagatgaaccgccatttgatcagcagagagagcatcaacaaaagcatgcaaatgaagagccaaatcatttggactatatgctagaaagaacggaaacagcagataattcattggaatcgaatgggaaaattagccaaaaaagtgccaaaaagttggcaaaaaagaaagacaatggcaaaaggaagtggacagaacgccacaacaatttaaaaaggaggaagattccaaaagcgaaataaaagcattgatcgaaacatttgatcaaatgaagaagaaatttagaaaaaaatatcattttgttgacagaaaaataatgtgaattttggaaataaaattgcaaaaagattgggcacttgcagaaccaaattatacaaaatgaaaagagaaaatggtaaataaacaaaaaaaaatttttttaattttaaatatttttaaatgaaaaattcatattattgtttttttaataaaaaattattttttttaatattttcacataactatttacttgaaaaaattcacccgttttaaaaacttaaaatttaataataaaaaataaaaaaaatttttggtatttaaaaaagtttaaatttttcaaagagaaaatatataaaattttaagtcattagaaggattttatacttttaaaataattaagcaaaaataaataaacattttcaaaataaaatttactaaacttttttaattttaggattattgaccagaaatttttcaaatgaacaaaagaaggaaataatccatcgatttgaaataataaaagaagaatttatgcgcaaattcaaaataaaaaccaatgccaaaattagcgataaaattgcgcgaaaagttggcgtcaatttggagacaattaatcgttggaagaggtcatttggctcaactggtaaaaaataataatcaaaataaaactaaatcttttgtttttaaaagatttttgcatagctttttggggataaatgtttaatttttacagcaaagccaatctatacgagcgcagaacaattggaatttatccgaaaatatgatgcactgaaaattcaaaacccactgatcagcgatcagaacaccgcccaaatgatcggaacaaacgcaataagcataaaaagatggaagaagaagtttggtatcgcatatccttgcaaaagagacggatcacgtgaattgattgggcagtgatcagcaatggcagttgcttgaacatcacagaagcggaagagtgatcggtggcttctgatcagaattggtctgctgacctggtctgagtgatctgcttaatttaatatgttcgtaaataaactgatctgcctagtttggtttgattgggctatgtttcggtaatttctgatcagttttgggcttaacgcaaacgatcagtaaagtaattggctttggttattttttcccttgttcatccgagaattgtctgtgtcttgccatgagcgacctaaaggtttaataatcatatcatttgaagctttctcactattcgcttgatttgatttttttggattttttggggcatttaataaaaatttccttaaaaaatcctcaaaaattgcaaaatatgtaggaaaaaatggcgaaaagtccaaaatatgtataaaaatatgtactgtaatatgtagaaaaatcccaaaatatgtaaataaaagtcccgatttttgttcgcaaacacaaaaaagaaagtgtttttcctactaattaggctatggagaatccaggaaaaaatatgtatttacataaaaaaagaatccctggt

SEQ ID NO: 30069 - DNA, 1588 bp, Heterodera glycines
tgtaaacgaagacgaacatcactccactgatcagagtgatcagaacgcccaaataattgatcagcggacttttgatttgctgcggtttggtgccgaacagaccgaatttggccacggaccatccgacgattatctgcatgaaatgaatgaagtgccatttgataatttgaacccaatctatgaacctgaaaagagccccaaatgaacatgccaaggccaatgcccatttcggcgataatcggcacagaggcaacatttccttaagggacaattaaaacgaaatttaaattgttaattatatttccttaaaggattaatgtcagtgatataacggggggcccttttcccagttgaaattcccaatacaaatggtgtaccttcaaacaatagtcctttatatgggtaaaataaagaggtacaactgagggctcaacacaaaacgtcctctggaacagaggagcgcctgaggggggtccctctcaagcaaaattggattggccaaatcccaagactgatcagaggagaacgacggggaaaaggatggcaatcgaagggaccgctctttttcgccccaggaacatttgttaatgacagattaaggtgaacaattaatgtgttaaatgagtggcatcttcaggataattaaaacaaattcaaatattaatgagacaattaaaacccaatcaattttaaatgctttaattcaccggtggcataaagaaaaccgccaatggcagcgatcagattgaacgggggaaggcctcgggcgatgtttatgatcagtccggccataaaaacgacggcgcattggacccattggacgaaaagcccttggggggaaaagcccaatttgaaattattgtttcagtttgagaccatctttggtgtcgcaacgtttcaatggcacaaagagaaagccgaaggaaagacacgagacgaaaagggacaaatagccaattagcaaatcggtgcccgaggcattgtccattttattataattttcttatataaattttaaatacctaattataatttaaaataaaagaaaaggttaaggttaaggtgaacaaacaaaaaataaatcaatttactttctgacaaagcgcacatcaaaaagaatttatatttcacaaagcaatgagaaaacggaaaatggcttatgttttgttatttatgaaacaatttaaataaatttttaaaatcttataatatttaaagaaagtaaaaagtgtctcttttttgcctaaatattgacacatttattatcattaattatttattcatttattcaacacatccatttataatcaatattcttacgaacaaaatgagaatcaatttgtgcattttatacaaaaaaaattttaatttattttaatttaatttcattttgtcggtaatcaaacaattaataatttttaattggttaatcgatgattcaataaatgcagtcgatcaatcaaagcttcatttctctgtcagactgtgcccgtcgtccgattggcaatttgttattaagatttgaactaataatgcctaattttagaagtgattttggaaacatttagcgaattttttttggaaattt

SEQ ID NO: 30070 - DNA, 1270 bp, Heterodera glycines
cgacatagagaaatttcgacactgaactatttcaaaaactgtcactgtttttccagcattttcgacacaggaccatttcgacagtgagtaaattcgacagtattgagaagtctttaaaatttccggacttattctggtttggacgactaatttttcaaaaactttacaattcataattaccgaaattaacaattttacagaatgggtattggattaaatgggctttaaagatttttttattgtgttaatttagttctgagcacgaataagatgtttgtttttcgttcttataatttttagttttttttttaaaaaatctttaatatttttcaattttttggcctcaggatttgggactaatatttgaaaagtcacaactcacttcagtgtagaacaatttttacgcaataaagctttaaaaaaagagaaaaataaggagaattttatgaaatttattttaaatttttatcttgaaattggaaaacgttattccagaaattctggaaaaagtctaattttcagaaattaatatagaactcggttctgaaaagttattttggtaaagtaaaatacaacaaaaatccgcaattttaaagccgtttgtgttcggtttaaccggtaacacaaacggttgaaaccttccgtcgttctgaaactacggcgaaaacacatgcgtttatgttttcggtttagccggcgacggctgaaaccggaatttcacacgtgaattgtgctgccggaagcaaaaccggagctaaattcaagggtttttgcgaaaaccggattttccgtgcgcaaaaattgccaaaatttttaaagttttaaaaactttaagggattcggaagggggtttaaaatagttaaaattttacgattttttttacagctctttttaacacaatgtataataaataggtaaattttaaaactttgttttcatggctgatcagtaaggggtcgtaaaaaaacatagatattaatccagaaaaattctatgaaatacaattgtttttctggtttgcgctaaataaaaggcaaatgtttccggttttgttacagaaaatacagttgttttccggttttcgccaaataaaagaaatgtttccggttttgttacagaaaatacagttgttttccggtttatgctacatagtttatgaaaagtcggtctaaaaaaaacaccaactgctgaattttaaattaaaatcgcataaaatcaatttaaattaaaaaacaaaataaaaaagaaaaattgtggattggtccatcc

SEQ ID NO: 30071 - DNA, 233 bp, Heterodera glycines
cccggcccagtcccggtcccggtcccgctgcactctactaaaaccttaattaattacgaattactttttgtttttctgcctcctcttctttttccaattgtttgtggagttcaaccagcaaaattcggtttttgttgctattttgtataaaattgtcattgatctgatcaatttctgcccatatttggttagccataaaattgttgttcaaatttgctgttgcaggttgtcct

SEQ ID NO: 30072 - DNA, 1266 bp, Heterodera glycines
gttctttgcgactctttaaaaatagtaatatttttaaaaaaatcagaaatgtcctgatttggcgggccaggccgttttcgtacgaacacatgtttttggggcacccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcgacagaaattgtacaaaaatctaatttttttttgaaaaaaaacaaaaatttgaaaaattccgactttttatgaaaaatttcggaagtcggaattccgaggcccccaaaaattttagaattccgaccccaaaaatgtcggaagtcggaattccgtgccatccctgcttcacacttttgtagtttggtttttctttttcattttggttaatgactgatattttacattcataacatttggagaaatgtaacaataagagttgaaagcaacattcatattgaaacaacattcgaagttaaattttgaaaaataaataaattagacaaaaatcttgaagaataacaatgtaaagagaattgacaaaaacacgtatatcagattggtagtgcttcctaatttaaacaatcgaagccgtggcgggtgtttcggcacataacgggagaacaccggcacaaagcgaggcggagacggaccacttagaagtgctttaatgacgaaaaaaaagataaattatgggatttgcacaaacccaccagccgaggcgaaacgactgatgaccgagtcacggccatgctgacgcaagtaatggaccagccaggcatcggtccatctgatgctcagttggtgaaggaaattggcgaccggacgaatgtcccaatagccaatcgacggaaacgcatcggaaatttgccgtgaatacttcgtatagtcaaactttgcttgtcgatttacgacctgaaaagcacaatttttgttcgttcttccaccttcgtgatgacctcgagccgaccatggggtgtcaaaaatagcattttggtccatcggtctgtctaaatgtttcgaatttgaatccaagtgaaaattatggcattcatacattatggtccggaattttcgggttcaacacggaaaagtttgacgat

SEQ ID NO: 30073 - DNA, 855 bp, Heterodera glycines
gatcgacttcatcctctgatttttagacttagctcatcaagagctttcgaatggtactaaatttgtcaagttttgatcgttttaaaaatcccccggataagtcaggagtgccaagggatggaaaaagataataaaatgaacaacagaaaaatgttgaaaaaattgcacacaaaaaagtggactttgatgctttaatcttcgcaaattgcgcttcgttgtttcaactcttccaataagccggcaatacttttcaaagcattggccaaatgttccttgatattcttttttttcatcaaagccttctctttcaaattttcaatggcttcttcctttttcttttccattttctttttctccttttccgttttctttttttccttttcctttaatgctttctgttgttccattttctttatttgttcctcgtgttttttctcgttggcttcctttttctccatttcgtttttccattctttttccggacctttaagaaatgcgttaaatccttccgtaaatccttctgtttccgttaatttccgcaattcttctaccgacacattaccaaacattgcgactttctcagctgttttctcgtaatattttggcttacatttcccgtccaaatagtcaaccacccctttggcagtcattcgttctttcgggtccaaatttaacatattctaaatgattattaatgtaagaatgaagctggctgggtggttaaaatacggaaagtggggggtttataagaagacatataaaaagaaagggtggggtgcctcggtagctaaatggtagagctgcccgattggccgtgcggcgccgacatttgcggcgttacatttgcggcgcgca

SEQ ID NO: 30074 - DNA, 926 bp, Heterodera glycines
ttccttcccttcccattcgtttgtcagtcagttcccattctttcgcaatttgctgctgttttcgaagcgcgtgaacactttccgcgcctcctccaaatcgttgcgcactttttcgcgcatgtaaaaaatgggacagtcgcggctaaacaaaacgtcccattttaacattcaaacaaatgaaaaaatgtggagactgacgcggaacagaatatttcgctttgcaatgttcccgcgcaattttggcattccgtccacaggcgtgaaaaacgatgctcaatttgccgcattgtcagcatctaaaaatgataatttatgaattaagtgcaaatggaataacaaatacaaaactaattggtcttctcgcctgttccaaatagattttgtcgatccgcggcctgcactgctcgcatgtggcgggtgccgcctcctcctcgaagtccatgcgcgttttgcaccccaaacagacggactttttggagaaatagcccgccatcatcccactcttcagttttgtccgcgcctttttctttgtgtgttcgccgcctgtaaaaagagtcagttgccgaaggaataaatggaaaacgcactgatcaacagcttttccgcctggtcgcccatcaccgggtccaaaatacgtgccaacggtttgaccagttggtgctccaaatagtagtcaaagtcgatggggatgttgttttggagcacaaaaatcgggtcttccgccttctcataggcgggcgtattggcgccgccgccgcggttgacaatgacgtagggcacgcggtcgccgagacgcggggcggagccggggtcacgcttgcgcattcgctccgctaactccacgtgggcttgtttggcggcatatttctgtaaacaaaatgaaatactctcgtgaaaatggcactaaaagtgaaattccgtgtaca

SEQ ID NO: 30075 - DNA, 1547 bp, Heterodera glycines
ttgattggcttaagctttaacatacatttttacgagtcgaaaaattttttaaacttattaaatattttttattatctaaattggctcaataaaaaggtttaataaaaattatttttagattaaaataaagaattcgaatatgcaaaatttaatttaaaaagagatcccaaaattttacacttgaaaatttattaaagaattaatcaaaatgtattttattttttctgtttttgtttaagatatagaatttttgctcaaatagaaaaaaaatttgtattattttataactttttttttcaaaaatattctatgaaaccttttgagttttattaaatttgttttttttgtggagttaaaaaacataattaattttcattttgaattaattttttaccatcatgtcccatatttgagcttcgtcacttaatggtttaccgaagttttttaaatttttttttactgttacttttactgtttttcattgattattaatcaaaattcttctagccacatatttatattttttaaaataattcattggtataaccaaattatatttaaatacattttgggtttggattttatatatttttcaaaatattaattttcattttataattatcttaatcggaataaataatttttgttttctgtcaattgaaacataatatttttattaattctatctttcatcaatataattttaaaaattactcttttgtcgcgattaattacttccgggttaaaaatataaattttattctcatggttcgtagaaaaattgtgaaaggaaataaaagtgaaatattttaattttaaatatttttaatttcccttctttttttttgctctcaaaagcttagtaagtttctagttttttgtcttcataaatatttttaagaaatttattttgttgaaaattaaataaattaatatttaatttaattaaataaacaaattaattattttaaaataaatttgactaaatataatttagttttaatgctttgaataatcatttttctgatttagagcatattatcatggcgatctgtcctgtatacccttgaacgaatatttctcattaattgaatttttttatttaaattatattcttttgtgcattaaataatttaatagtaattttattaattgcatatatcgatttttaatatttatttatatatatttttaatcattttttatcattttatttattagaaaatattgttagtaattaatgttttttttaattatttttttatttctttacgaaattttaatcttcgttactttatgtattcttttgggccgttgacgtaattaaatcttttagagtcattttatatatttttttcttttaatttgcttttattgtgtaataatttgatgtgtaataagtttattttttcactttttaattctaattataattcgttttcgatatcaaattaaaacatttattttataactctttataattataaaaactaattctttcattttaaatgctttttacattgcctcattaaatttattctttcatt

SEQ ID NO: 30076 - DNA, 1215 bp, Heterodera glycines
  misc_feature (68)..(68): n is a, c, g, or t
taattggttttcgcccttctgaagactttttatttatgaataaataaataaataaaagaacgagcatngggctcgaagtttttgaaataattaaacaatgaatatttgagtatgataaaaatttatttaaatgccattttgttaattttcattttagaaatatttgttctattgaaattgttattatatttattaatcaaggatcattaatattaaatgacagcgcaaaataaaaactatttaaatgccatattggttaattagcgtgaaatttatttagacaaaagagtaacaaatagaaccgtagttaaatcgaacaaaagaaatttttaaaaaacaaagaacaaaacgaattacctaattagttaattggatgaaattatcgcttcttccgttgtttcttgctttcttcaaagagttgccaaattgaatttgaaattgggcccaaagttcgcctcggtttcgtcatcagagacgtcagcaaatgaaccgaatgggaacaattcatcatcatgaacagaatttggtgaattgtcgaccaaatagaatggacctatgaccatataaaagaggaatcatttgtgctttttttgaaacgcttaaatggatttttgtttcaaaatcacaaattaaaaagaatatttgacattatgtgttttgattatgctgaaaaagagtaggagtcgttttcggcgccagcccaagtttttgacaataacttttttcatagtcaaccaaatcaaacaatcctggtaacattcgaaaacccatcacattctctatgtcttacaaacaaagtaggctccctggtgttccgtcactgaaataaaattttatgccaactatttgtattttttgaaacaaaaagcattaaatttgtgcaaaatattatatttcgaaaaaacctatttgaccaatttaggcgtttttcccagaatttattaatagggctgggatttttatgttttaacatattttttttgtggcttagttatggcgagagaagcccaaaaatagcattttctccgaacaatttttgatttagagcgacttataaaaacataaaaacacatattttggcgttttggcacataaaaacatatcgcacatatttgggctattttggattttttagcacatattttggcatttttgagaaaaatcgtaagaaaaatacaagaaaatctgaaaatgcaccctaaaaattgactcctt

SEQ ID NO: 30077 - DNA, 1437 bp, Heterodera glycines
  misc_feature (1420)..(1420): n is a, c, g, or t
caaatcacagttaaacattttctgttctccgcgtcttaaattttatttcttctgttcattaataaattacgaaataaaataatagctacataattagcaaatattaccttaaaaggctttttaaattagcgggaatttaggcgttttgcgtaatgtatgagacaatgatttctttacaattgaaaacaaatacacctctttttgataataatcattttattgtcaaatttcagaagcgaacaaaatgtttaaaaatttccagaaagtttatcctttaggttgtattttttgcatttttcttgtgaaaatttcaaaaaatggctgaaatatggactaaaaaaataaaatggtgaaacatggatttgcgcactttttgccgttcgctctgatgggtctgatgctgctgaccgatccgatcagcgccaaagggggacgagaatgtgaggggtgacaaagttggactggtgcttgatggaattgtgcagcggtttgctgcttgctttacggcaccaccgacaaggttttggggaagggcttgtcggacccctttgaactgaagcttcgttctcgactcgacgaccacgggtttcgattcccgtttactgtggcggatactccagctggcgggagtccgctttgatcgatgcgcgcttctccggctggagggattagcccgacgagcggccctgtcccgctttggacgattttggcaccgctcggctcttccttccttctgacgacgacgggaggtcacacccgtctcttcggttgctccggctggcgggagaccgaactgctcgaatttgttgctgcttcggccccctcccaaatgttccctaattgccgacaggaaggaaattgggatcgggatggttaggggagacgacggaggctgccgggaaaggaaggggtcaagaccggagtgggtgtcgttctgacgacggcaaaaaagtttgaatgggctgggcggacgtattcagagcgagttgacgaaaattaaagaccaaagacgccgaaaatcactttattttgtaccctcaaacttgggtaattaaaccgtcccaatcgggacggtgagggaaatacaaaatattgggaacacacaaaaatcggaacgacaaaagggcaaaatatggtgaaatcaaattaacaaacaaatgggaaatgcggccaaatcaaagaggcaaaagcaacgcaacaaggagggcaactcgggcagcggcaaatccaatggggcccaaacaatggcacggggaggggagggcactcgggcaatggcatggcatgaaaaaggagcagtgcgggccgggtgcgctgaatggcagcaggcgggtgctgtggaaacttcggagggaatcgttcgtgttgaatctgaaatttccggaaaagcccaccccttaaatacggcttttttgcaccnaaagtacgctataattt

SEQ ID NO: 30078 - DNA, 1083 bp, Heterodera glycines
acacacctcccaagtccctggtgcgcactttcccgtctctgatcactttctcgacggattctcgcagtgccgagccgtactgatccaagtggagatggttgagcatgttggcacagcacaaaatcattgcggttgggttggcaatttgcctaaaaataaaattaaattacgaatctgaatcaaaggatgggtcaacaatttcacacaccttccaaacgcctctttgtatgtgtgtcgtgatccgggctcaaaaatgacgtagtcagagcccactgattccccattgaccacgccggcaccgccgaccaaaccggcggccaagttgtcgacaatgttgccatacaaattgggcattaccatcacgtcgaactgttcaggatgggcgaccaactgcatgcaacagttgtcaatgatcatttgttcaaattgaaaaaggaatttgatagtcttcaaaatcagaatttcaataaatggacaattaacccccttttcccattattaacttatctcaatttttgggtacagtttcgacgtctccgtgcacacattcaaaaagagtccgtcgcccaatttcattatgttcgctttgctatgagtgaaatgaatatgaaaaatgagtgagaaaagcgggtaaaccccaaaacgtcgccgcaaaaaaaaattaaaaattttaataaaatttaaagttattttagcttttttgaaaatctaagtgttaataaaaactaaattgttgatttctaagaaaaaaaaaatcaaaaaaaaacttaaaaaaataaaattttttccttgaatttcttaataaaaaagtttttcgaatttttctagaattttttccgaaccaggctaggtaactaaaaattttttgataattttgtttataaaattttaaaaaattttgcggcgacgtttcggctggcgacgttttgtcctgctcccgagaaaagcattcattgaaaaacactcactgaacggcggtgacctttttgcggccatgtttagtcgcataatcaaacgcaaatttggccaccctttcgcacttctctcgcgtcatgattttcaggcactcaattacaccttaaa

SEQ ID NO: 30079 - DNA, 1398 bp, Heterodera glycines
tcactgagaaatcgattataaatatcttctaaacatctatggctttcgaatgataccatgattgtgaagtttggccaacaaagataaaagttatagctttttgaacgatgttgagacggagttggccagacggagttgacccctaccgcatccccgcgactctgacccccgcaatcccccgcccccgcgaaaagccacccccgcccacggggtccgaaccctacttttgatggtgacagtataaaacggcgcgcaaaaaaaaagtcggctccaataaatctcacgctaaaaaacccgcgtcaagtagcaacgcaaactgggcggatcccttaacaacagggctgccaagtgtcctttttttaaagatttgtccttttttggaggggccggatctttaaaatttaaaatgtcctttttttaaagattgtcctttattttaggcttccccaaactttttaaattttttgtgcttaatgatttatttcgctgatattttatttatttattttcgttttaatactattttctcttcctctctttccctctcaacttaacttttgttttttgagcattctcatccataacctgttgtcagacgcataactatttcccatttttagcttttttttacattttccaaataccccaccaaaaacgcaaaaatatttattgtgaaaattatgcaaaagaattccggcacataaagaaattcgtgttgatcggttccctgagaaattgcgttgggtctcactgatgtcggacaaaatcccgcacaatgacgcgttggacttggccagacagattgccccggacctgacaaataatctctttgacgatgttagcgaagccaatcaaattctcaattcaatcccaaaggacgaattgcagaagctcaacccagaacaaaagtggatgaagctatttgaagccgatttaccgcacttgtacaagttggtcagcattgtactttccgtgccggtctcaaatgcatctgtcgagagagtgttttcgctttgcggctcacaatggactgatgttcgaaattcgttgaaagtcgaaaccgtgaaggctctgctccagacgaaaataaattttgatctcacttgcccagaaatgtatcagatgctcatttccaatcacaaactgttggatcagatcggtggatgggacaaatactttgaatgactcttttttgaaaaaaacaatattattttcaataataaaaccgtcgtaattgtgcaaatttgttgtattttgcttttataaaagccaataatgttttttaactgtttttacaaggtaacaatccattttttcaaaaaatcttttttttggggtccaaatctttgttttagcctcgtttgtactttttttgaaaaaaaaacttggcagccctga

SEQ ID NO: 30080 - DNA, 1775 bp, Heterodera glycines
tactctcacttactcactcttccccctccccctcccctacactcaattttccaattttcagaaatttcctaggcctcaaatttctccgccccctcccccacactcaattttcaggaaacatttcctaggcgccttcacaaaatttcttccacaaccaattgtcactctgagcactggggcaactgagtcccacgcggtgatcatctccctcttgggccgggtgtcaggggagcaacagtaatcccatgtgtcccatgttttgggtctgatacagtacatataccgtatcccggacatgggaaatggggtggtaacattcctgtattgtattttccatgtttttaattccacgttgggacttaggctacttttctttccaaaattttttgtttaaaaatagtccaagccgaaaccttggaaccgacactcgtacacagggtttgctgtttttacgaatttcccaccgaagacaataccgtagctatatgtagggagtgatgctacagtcctccgtccgaaaaataatttttttttaattttttgccttttttgctgccgtaagaaaaaccaattatatttgtgtgccatactgtattttcgtctccctttttcacggtcctctcacagggcagaaaatctcgacttttttttggtccaaacttggcaaaagtgtcgagagttgtgtgcccgctcacacgcacgcaattgagctgctctttcatctttgctctgttttcttggttcaccggcagttgtaattttcttgattcactattccctctttttctctcccctctctctctctctctcctttctctctcttacctcccctctcattctctcctctttctctctctgttttcccatgtggcgctcacttggccacaaggccagctgataataataatgagggagggagtacatgcactagagagagagaaagagaaagacagagagagagaagagagagagaggcagggagtaaattggagaaaagcggaacagactggagaacaaagaaaaaagagccgacacatagggagaaaaagaaaaaaatcaaaagagaacgatacggaaaatagagaaagaggtcatgcgaactggtttagagagagacagagaaatgggcaagagagagggaggagagagagagataatgatgtcctgaagaaaaatagggaaagatacagagaaagcgagagagtatgtaaaaaaagataagagagtgagaaaaagaaagagaatgaagaggaagacagggagagaacgagacggtggttgaaagaattaataaagaaaagatagaggaaagagagagagtgggcattgaggagtgcgagagagaaataggaagaatgtggtaaaatggcttttcttgcccattcatcccctgcggggacaaaagttggtcgtcgctgggctgctggagctgctgtggcgatgctgctgctgcagatggcgtacataccgccggcggcggggcaccgcaacgacggacggacggacgaccgccccgccggcgatggcgcgggcgggggcaggcagtacgacgacggtggtggtgttggttggcggcggcacatatataataaagaaggacgagctcacacagcccttccccccaaccattctccatccccccccccaattttcccgtccagcgaagacgacgccgactgaggttgaggtggaggtggaggtggaggaccacccctgctggcgggggacacgtgacaggagcagggcggagacggaagactaggtaaacggaggag

SEQ ID NO: 30081 - DNA, 1134 bp, Heterodera glycines
  misc_feature (76)..(76): n is a, c, g, or t
  misc_feature (122)..(122): n is a, c, g, or t
aatgtaagggatgaaaaattatccaatattaaaaatgtgtgcatttaagacaattaattatcaaaaagggcacganaatgggaaagcaaattttacaccaaaatcttatggaaaaatcctgnaacaaaaaatgttatttaaatttattttaaaaaattttggtcactattttatcacttttttgccattttttgtcactatttagttaacaggggatttttcgtacttaaaatccacgccttactcatatgaatgttaattattgcagctcgatctgttgaaggcaaaaattttgtctgattttaacaaattggacaatgggaagaggaaatttacgagcggtgctacgctgggatatgtgacaccggtgagtgtattgaaaagaatttactaagcgattaaaacttataaaaagatgtaacacgaaaaccgcaaaaaatcagaatttttgcatatttttatttatgataatatctttatgatttttgaaaagccaataaagcttgttgcgagctttcgaatgataccaagtttgttggtcaacaaagaaaaaagttatggtgctttaaacttagctcaaaatccgattgtgtccggcctccgaaccttggataatttcgaacaaaaaatcaaacttaattttcctcttttcgcgtttttggtctaaaatcggtttaaaagatatttattgaagctcctcaatttttcgagttttaaaccggtttaaatgcttttccgcgcccaattttgagctgttctatcgttctcagcgcctaagaaaacctataaaagtgtttatgcgacttttcgttggtaccgtattcgtcaatttttccttttttagtttatttccttacatttaaaccggttttgaaccaaaaatgcgaaactagaaaaattttaaatttcgtatttttgttcggattcggaattcgaattgtgtcgaaatggctatcagaataaaattctccgtcctgaaatctcataaaatgacttttttgagaagaggggggggggggggggggttaccatcggcactattaccgattttcctgataatttttgacgcgtgagtcaaaaaagccaaaaatttacaaaaaaaaatcgacaattctctacacaataaaattggaa

SEQ ID NO: 30082 - DNA, 573 bp, Heterodera glycines
tgaggaataaaagtatttttatctggtgatatttcgagaccgcgcacttttttagggggggggggggctacaccaacaatcacggactaagaagatggacgacctccttgaacttgttgaccaattcttgtccccttgatgcataattgcctgtgaagcggcaaagcaaatgctttggttggccatcggttgtcggcgtgtgcaaccatttggacaacacttcgccagcagttgcattttttccgtcataagcaattggagcggggaacagacgataggaattgatcgatttcagttgcgtcagatcagtgagaattgtcggggaaacgaaactgcgcaaattgttcaaatttgcaggcgaatagaaggccaaatgacgaatggttggcgcaaaaatgggccaaatctccctgaccaacacatcccaaatcgctgttccagtggacgcgtgcaatttcaatttggtgccccttcggtcaaagatttgctggtttaaacggaaaaattcgatgacagtttggtcgatgtatctgcgcaaaagtggggcaacaacataaaacgcgttaatacacg

SEQ ID NO: 30083 - DNA, 1110 bp, Heterodera glycines
  misc_feature (1080)..(1080): n is a, c, g, or t
  misc_feature (1104)..(1104): n is a, c, g, or t
ccaaactttatttacaggttaattaaggcactctgatgcttttaataccaaaaagggatgaataaaattcttaaaaattttttaattgctttttaaatatgcgaaaagtttaggcttaactttttactgaaatttcactcactcatagttttacgagtagtgatcagaaaaatcccagattttgcagggtaacagctgagaaccatacctaatttatacttttttcccgcttactaggccttgttaaaaattttttagattttctgattttctgtactttttcaattttttgcaaaattaattcataaatattttttcagaaagtgctctgaaacacaccaataattaggcgcacttttcgccgttttatcccgctttttcttctactacttgcgacggagacaatgaccttaattaagcgaaatttgaataatttttaaacaaaaggaaatgcattttgttgtttacccaagccaatttttggcattgtaaagccaaaagttgacaatgttcaaattgttcgtcttttcgtcctcccactgaaccgacgccgtctccccaatttggcatcgcttcatcacccaattgtaaacttcgcgcggcacattctccagtgttagcttttctttggtcctttcgtttaccaattcaaatggctcaggcattaattgttgcagttcaagttgaattttgtagctggcagaagtggtggcactaagaaatgcctaaacaattgagaaacaaaatcaaatggcaattaatccaaatagttttgtgccaatgtggggactggcctccttgaaagtgttgacccattcactggattttgacggataatcatagcaagtcaatcgcttcggctttccatcttttgtcggggtgtgcaaccatttggacaacgattggccagcagttgcatttggcccatcatcagcaattccatcggggaacagatcaccagaacacattgaagggttcagatcggtgagaattgtcggcgaaataagacgacgaaaattgtccaaatgataagcattggaaaagaacaaatggcgaatgtttggcgcaaaaatgggccanatttcacggacaaaaacatcccanattggc

SEQ ID NO: 30084 - DNA, 2072 bp, Heterodera glycines
ctttactaaataagcagaacgcatccccatacgtgatgaggagccctaatgagaaacccaaattctcgttcagcttgttctgcggttgatgctaatgagactgattagtggcaccgcgtgactaatttgttccgtgccggccccgcggaaatcgcctttatttaagcctcaactttttgtgcgtttcctccccccctcaactcgtcttcgcccccccgtcgtccatcatcggagcaatgctcgtaatcgccagcatcagcctcctggcttcttatggatttgtatataatggaacaaatgaagcgaaaagaagaaaatgggagaagcagagaaattggaaatatggcgtttcggagagtgaaatggacgaacgacggatgaccaaagaaacggcgaaaggcgaaattggggggggggggggaatggaatagaaagaggcaaacgacaaaattgaattggaaatcacccaaatgccaacgaattcagttttgaaattaattgcgcataatcaaaaaaaaatttgttgcctcaaaaaactttctttaatactaaaaatataaataaaaatgcaaagaataagaaaaagtcggcgagatgggcttatgttgtaatgttggacaggttgtttttgtgggaaagaagaagcgacgattattcatttatttgttgaaatgattaaacgcattatgcaacaaaaagataaaaccaaaaaagcaaacgagattaatttggacgaggtggaggcaagggaaatggcattaattagtgggatgggaagaggtaattagcataacattaagggcaaacaaggatatagagctggacgagaccaggattacaatggaattttaccggactcccggtcccctttttttgtggggatgagggaaagaccgtgaccgggaatctcggaaagcaattgaaaaaatgaataaatgacctttattcaaagttaacttagctaatggtgaataagagtaatgtttggcttctgctgtgtttggcagttcaatgagagaatggatttgtgaattaatggggggggggtgtcgcaacgcaacgacaacaaaccgatggacagacgaccaaatgaccgccgtcgacacaacgccaaacatttcctttttcaacggatctttcgaatttctctccttttctccgcattctctgtcttcgcttcttcttcttctcctccatttgctgctgatctcctgaaactgcaaatggatgtgcgaatgtaaaaaatgggtcaatcgtcggtcgcatcgccaaaagtgcgggcgaaggggcggcaaacacttaacgatggacgcttaaaacagagcattttcaatttcacattgaaagcatgaaaagggaaaaaagggaaatgaattgaaaaagtgtcagctaatagggagaaattggcaaccaaaaatgttgatgatcgcttggcacttccgacttccgttcttactgtttaaatggcatttccaatattttcggagggaccaatcttaaatattatgcaaatcataaaaattatggcgctttaaagtggttctttttgaactttttgaaaaaattttcaaatatttatttacaattacgagagtgccacttaaaaatatattaataaaaaataattaatttctcacattttgcttgaaacgcatcttttttcgaaaattcacctcatatttacttcatctacagttggaagccgaatcggagattagtgaaatcaatgaaagaatatctaaaacattttaaccatcttttaaaaaaaaataaaaaaaacataaaacactaaaattgatggaaaagtatttgaaaaaattttttcaaaaagaatcactttttgtagcgccaaattttcttacatatttaggcttctgattgaaattctcttttaccaatcaaccgattcctcagatttgctcaaaatgttgaaaatataaaatggagctggtttttcaatatattattggatgagtgtgctgatttgtgagtgttgaccatccctcccacccgcttctcattcccaattttcccctcttccgttgctcaagttactttatttttttcatttc

SEQ ID NO: 30085 - DNA, 1624 bp, Heterodera glycines
  misc_feature (31)..(31): n is a, c, g, or t
aactttttttttagtcaataatccaaattcntgaaacactggggaacatttgaaagcatttgtttttttgggttagtggcaaaattagcaaaaattttcatataaaatcagtctgcttttttaatttttcaaaaagtcatgacataagcgggaaagaaaggggggggggagacaaactagagaatttcttctatgagccaccgattgtaacttttcacgaacatttctgtatttttattcttcgaataaatagttaatttgtagagttttcgcagctaatatccaggccctagctattaatatgggaaagtcatttgaaattacttaaaaagtgtaaaaataattaatttaaaatatattttattttacaaaaataaataaaaacaataatctttgaacaactaattttcgatgaatggcggaggaccttccaattaaccaatgtttattacctacaaaattgtcaatgaaatgggaaattgacgacatgaaaaataaggggatatttggatgggtaatatacttaaaagataaaacccaaaattgataaggtgataaggaaacacaggagaaatcagctaaataatagtaacaaatcataaataattttgtctctaatttgaatcattaattaatgaatgtatcaaaatcgtataatttgtgcaatccccgtgagacgattaattttttatacattttgattggaattttataactaaaccgttttgtcaaaggtaaaacataatgcttacaattaaattttattattttttttattattattatcgtccaattttgacattttcatttctttggcaattaaatttaatgcattttaaaattaaaccaaaaagcaatgaatggaaaataaataaataaataataaaatcaatgatttattatattgaaaaaaaacaactaattttattatgcttttcattcaaacaaattcgcaaaattaaaatttttctttgcaattatttcagaatcgtagaaatgatttgtgccaattaataattttattttttaaattcattttatttaaaatagaaaaaatgtacttgattgctagaaaacatgaaattttgtttgctaatatttgtacaaaattttctgaaaaatgagctaaatttttttcgacagcgaattttcagcatctccaggatattttatgaaaaaactagccgagaattcgcgactataatgaaattttttcgaaattttgcagagaaatagaggacactagggctatcgaaatgaccaaaattttgcatttttatctaaaaaaaattggtggttttaggcgttgccgggtgaaaagtgaaaattttggccctattttgaaataaaaatatttttcataatatgggtttttgttcttgtttaaaatttaaaaagttttaacagaatattaaatttatttttaaatcccatattaaattattccatcagaaatatttttaaaggccaaaaatgcttttatggcatttgatatttccttttattttattaatctatacaatcgaatccggcaaaattcgaacaaattttgatgaaatattcggcaacaagtgggatccggggggggagtgaagaaaaagtgataaaaatagagcaaaatgaa

SEQ ID NO: 30086 - DNA, 1536 bp, Heterodera glycines
  misc_feature (51)..(51): n is a, c, g, or t
  misc_feature (66)..(66): n is a, c, g, or t
  misc_feature (1469)..(1469): n is a, c, g, or t
  misc_feature (1514)..(1514): n is a, c, g, or t
ttttattatttttagaattaataatattatatttttccaggattatatttntagtgcaaggaaaanccaaaaaaattaaaaataataaattaggttggataagtaataaatcggtttggtcagggttcacaattttattttaaaaaatgtttattctaaaaatacgcaaaatctcctttaaaaattttcactagaacaattttttttcaacggatttttgagtaggtagggttagaaaaaaaaatttctaaacatattgaaagaaggcttttttcactttaaaatatgaaccccacagacgaatgctggctccgagattcaagatcgagacccaaatagcaagaaaattctcgagcacgggatcagctcgtttccccgccgcacgaaattttttttttaaattttcaagcagaatttttcagcaagattagaaatttttttcctaaaaatttttaaaattttccagtgattttttagtaaaatttttgaaaaaattagtaattcacagaaaactttgaaacttataaaaatctttttgaatattcccataagatttacctgaaatggaacgcaaaaaaatatgtttatctaagctatttttaaatttggcatccttattaattacccttcaatgttttgttggcgttctgccgctgctgctgttgataattagtcacgccaatttgctgcagcaaattggcatttgaattcttcggaatgtttgccggcggattttgaacatttgagaggaagacacttcttccactagtcgaatttacgccacctaatttggaattaatcgatgattaatcacaatttttgtgtttgttaattcacaaagctggcaaaatttgaatcaaaaattccaattttaatttataggcaaaaattttcatttctacaaaaaaaaaaaagaaataagttttgcacgaaagcaaaaattgttttttttaaaagcttaaatttccctttttactttttagaattttgaaagcttagttttttattgaaatctccccaatttcatgtccccttttacaatgagttttaaaatgacaaatttgaaatgtattttttggaaatttaaccaaaaaatatctttttataaaatttcgcatccctaattaatattatttaaattattttttaataccattaaaaaatgcactcaaaaacgacaccacaaacaccgcaaagatttgatttaacaccaccattttttctgcaacgaaaattaacatttttgttttagaattttttattaatgcataaaatatgccaaattattattatacaaatgtacaatttttatattgctaaaaatggccattattatatgctgcaatcgatgttcaacgtttgtaaatatttgctgctgtttgttgcgtgggatggcattggcattttaaaaggcgccacgtgccctcctccaactccgcccctcccacccccgaaggctaattaggaanatttggatgagtgccacggaattcaacttccgtcatttttttggntgagtggaagcatgatttccga

SEQ ID NO: 30087 - DNA, 975 bp, Heterodera glycines
ggttacgagatagaaaattgtcctaaaaagagatacccattttttgtgagaattaattcacaatttccgcagctcttgcggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttacggtaaggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacagattagcatcggggttacgagatagaaaattgtcctaaagagagagccatttttctgagaattaattcacaatttccgcagctcttacggtaatggaaaaaattttgaagaggctctgcggaacggattagcatcggggttacgagataaaatattgtccctaaaagagatagccatttttcctgagaattatttcacaaatttccgcagctcttacgggaatgg

SEQ ID NO: 30088 - DNA, 1078 bp, Heterodera glycines
ttttcaattaccgcaagagtggcggaaattgtgaataattctcagaaaaatggctatctctttttaggacaattttctatctcgtaaccccgatgctaatccgttccacagagactcttcaaaatttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaatggctatctctttttaggacaattttctatctcgtaaccccgatgctaatccgttccgcagagcctcttcaaaatttttttcattaccgcaagagttgcggaaattgtgaataattctcagaaaatggctatctcttttta

SEQ ID NO: 30089 - DNA, 1678 bp, Heterodera glycines
  misc_feature (1619)..(1619): n is a, c, g, or t
ttagcaatgcaaatgtccaaaattgggtccgacatttggcttagccgttgggcttccgccgtttcaccgctgcccaatgggtccgagttcactttccctgcggctgattggaggtgcatctccgatcgctttttccttcgcttgataatctgaatcatttccgtcccttttagttttcctcttttctcgcgtcccattcaaaaaatggtcccatcaacgaatgctcagcaggaggaaaccaatttttatcttttcgtatacattggaatcgctgctctgaacaccatttgcactctgatcagggcctttttgtatgccttcggttgcattttggcagctaagcaaatgcacgaacgaattctccaccgaatacttaatgtatttaattgactaattagttgtccctatcaaaacatccccacaggccacgctgacttggtgggaccggacgccctgtggccgtgtgaccaatcggtgcgttttcggcatttcgcttcccaatcagtcagtcatttttgtccttttttcgactgtccaccgacgtgaaccgtgttgacgatgcgttacccttccaactgaacattctactcgcctccctcttccccctcgtctcctcccttttggtcacggtcgttgctcttccgctgctcagtccctttgtgctgcttctgaccgtcgcttatttcttcctccaggcacattcccttccatccaatcattcccatttgtgctgtttagcgatactatcgaaggactacggtcgaattggtacgtacagtactccatttgtgtgcaaagggagtcaaaacgggggataggaggggggggggggggggtggaaaggtcgagatggtagcacattctcctttgatttacttagcgtcgtatcgcagcccttagcctgtcgcccctgtacagtcatttggccgagactgtgtccggcctcgtgtccatccgcgccttccgaatcactcaccggcatgatcaattcaatccttgccgtccattgtcattaattaattggtttgtccattcggcagattctcctcgctgatgtgccaccgtttggagggcaatgtccgtgctctcttctctcaattagcttgttaccaatggttggctgttcgcacccaaatgctcggtgttgccattgtctctgtggtcgctttcgccagtgttttcgatgttcatttcttccatttggctgaccccggtgggtccaattggtctctcttttccagctccaaactcattaaggcttaattggcctttccattacttacgctctttcatttaccgcccttttcaacggcgctttaaacacttttgttgaaacggaaaaaggtgggaattgtaattacaactgttgaagcgcattaattgccatttcctgggcttttaattcagaattggtttctgtggaacgaatttgcgattatttggccaatgttccggaagaaattgacgagaaaaaggccgaaggacagccaatcggacacattttggtaaagcatcactttggatttggatagagcatcctcttcaatatccctttttatcttcaaaccattaatcccacacaatgtttccttcttcacgtagaatcgacaaatcaccgnccaaattcgcttcctcgggaagatctcttcgctatgcttccgatttgacctctggcaat

SEQ ID NO: 30090 - DNA, 1368 bp, Heterodera glycines
cccgtgcccccgcgggggcgaaggtcgcgggggcgggggatgcgggggtcagagtcacgggggcggggacgggggtgagccccaaaaacctgtcccgcccccggggacgggtgcggggtccgaaccctaaattaaattaaatgcgaaatgtgcacaaaatatttaaaaagccctgtccatgaaaatgttaaaaagtaaaatttggagaaaaatggaaagtgaggacaaaccaaccaattacgaattggaaaaaaacgaatgatcgctttgtctgttggtcgtttgtcttcaagagaataatctcattgtcaaataaacattattacatatgtgtctcatttattaatgcttctttccgcttccatttgctgtccctaccgtatatctcatccgcccgctaccgtatcgtaactcgcgcgaaacaattttttgtggagttgcaacttccacacggcgccactcaacaaaatgaggaggatgagaagaagaaagacaaagataagcctgtgtgatagaaaaagctttttgcggaaaaggaaaaagccttaggaaaattaaaattttagtaaaaaaaaacccacgcggtgttattactctcagtgaccgccggtgccaatgtcggccgttcgaagatgacgtgttgctgttgctgcttcgtctcgctgtccccgcgtccgttctccatctcttcctgcgcctcctcctcctgctccgtctcctccttttccgctgtctcttcctctccctcctcgtcttcctgtaactctctcctcctgctccctccgtcttccccctgctctctcacgcccttgtgtcccttgtctttcgcttcttccccttccgtctcatcttcttcctttgtcttttcccgttcctccttttctctcgtccctttgccctttaccctttccctcccattttttggcctcattttccctgcttttctttccccattttgccgactttctttggcacgttcaatggcttcggtgtcgtttgtctaaattatcaattgcataaacacaattagttaattggttgccatatgatttgatagattaccgtgaagcaaacttccacttgcaagtcttccgaattgaactttgcgcaccccgtcggctccaattcctccgccaatttcgaatcgcgcgaaaaagaggcgcagccaatctccaagggaaggaagcacatgaaaaagaaggtgggggggggggggcaattggtgttgctgctgcgctctctctcaccgtccgataagcattcaaatggccaagtttcgatttgatgaacgctcggaagcagaattcgccggtgcaagatgtttttttagagggcattttctggcctagcaactgaaagaatgagaag

SEQ ID NO: 30091 - DNA, 1114 bp, Heterodera glycines
  misc_feature (977)..(977): n is a, c, g, or t
  misc_feature (1010)..(1010): n is a, c, g, or t
  misc_feature (1034)..(1034): n is a, c, g, or t
  misc_feature (1048)..(1049): n is a, c, g, or t
cgggttggaggggcacgaaaaatgaagtgaaatgtgtggcgttctccgccagcggcgaacacttggccacctgctcccgggacaagtccgtctgggtgtggcaagtcagtttttcgttcaataagggaaaatcagatggggaaattaaacattgttgcttttttggatatagagaccggacgagtcggaatccattcgggcttttttcaaaatcctgatcccatattctctgaaaattttctggtttgttggttttgaaaccgtccaaaaatttttgatttgctaaatgcatgtcccatttttggttatttccgaaattcgcacagatggacgacgctggcgacttccaagtgatctccatcctgcaacatcacactgccgatgtgaaattcgtgctttggcatccccgcgaggaactgcttgtctcgggcggctacgacggctccgtccgcttttacgcttccgacggcgaagattggtgcactggccattcggtgaatggtggtggtgggcgggaagggcaatgtagacatataagtaacacatttatgaaaatatctgtaaaatttaatgtaaaaatgttttagggagttttggggtcactgaccaccacgaatttgcatcggtttcttccaattcgggactccgcacccaaaatttgaacttcgcatttttcttttttatttaaaaaccggtttaacttcacgaaacaaatgatgaataaacaatcatttaaatcgttttagaacaaaaataacgaaatttaaaaattgaattttcgactttctgttccatttgtgttcgaaagtgggcaaaatgggtgccggattcatggtcagtggcctcaaaattaattaaaacatgtttaaatgacattaaattttagaatttttattaggggaggcttaattacagtattaccgaaaaattttatcaaagacaagcacgaataaaattattttacagatatgaccggncgacatataggttgacaatcgtgcaaataattntatttttgaatttacatatatatntatttaataatatnntcacgaattatgaattattttaagatttcataaaaaaattcttatcactgacgaaatcacttctg

SEQ ID NO: 30092 - DNA, 1598 bp, Heterodera glycines
  misc_feature (1553)..(1553): n is a, c, g, or t
  misc_feature (1559)..(1559): n is a, c, g, or t
tggcaacggttgtgcaaagcgttggactacccaggtgaaaagcggattttatgggagtgggaaaatggctaaaaatgaaaggaattaaacggagagactgaaatgatgaaaaacgggggccaaagcgaacggaaggggtcaaatgcgtcccagggaactttaaaaggcttaacttttttctcatttggccaaattttccaattttggcagcatttgaaagctctatatgtttagaagctgctttgaaaatgaataatgaatgcataaaagtcagaatttttgcatatttttatttataactagagaccggatttttatgtttttacatattttttttgcggcttagttatggcgagagaagcccaaaaatagcattatctccgaacaatttttgatttagagcgacttataaaaacataaaaacacatattttggcgttttgtcacataaaatatgttagcacatattttggagtttggcacatattttgcacatattttggcatttttgagaaaaattgcaataaaaatacaagaaaattgaaaaatacacccctaaaaatcgacttttttcctaattattaacataattttcaaattaaaaaatgttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgggccctactaatcaattacagaacgccaaaataaaataaaaatacaaaaataaaagatagcactatgttttaccaatgattttataaatttttttagtttatatcttggtaaatactagaccaaataaaaccattttatgctcattttgaagggaaaattctgaagaatattataaaagggcttttagttttttaactatttttctgcggctttatttcgacgagaaatgcacgaaaaacacatttttagctcggaaattcttcgttttaacgccactattcatcactaggaatcactattttggagctttgccactaaaaaaaattattttggaagttggccactaaaataattttttgccactattttgacattttttggaaaatttcccaaaaatgcaataaaaatgaaaaatataccccaagaatcgacctaaaaaattcaaaaaatacaccccaaagaatcgaactaaaaattttcaaaattacacccctaaaaattggaaattttctcaaaaattcgtcccccttttttttcttgctcatatttgctaagaaaatgttttgtaactgtaatcagtgaataaatttgtttgcctaattntatatnattttcaaattaaaaatagcaaatttaaaaattacaccc

SEQ ID NO: 30093 - DNA, 1079 bp, Heterodera glycines
  misc_feature (965)..(965): n is a, c, g, or t
  misc_feature (968)..(968): n is a, c, g, or t
  misc_feature (994)..(995): n is a, c, g, or t
ttgttgattgctgctcgatttgtcataatttttgaaaatgttaaattctcaatcgttcagtaataaagatatttgcttcaaattgccttgcggtataattgtttccgggccctcctcgtcgggcaaaacggaattcctactaaaatttattgctgagtgcaatgaactgatcgcacccagtcccatctcaattctgtactgttttggtgagatgaattcggcggtgccgctactacaaaaggcgggagttgaggtgtattcgggcgtaccttcggaggagctgattaggcgccttcccaaaccgatgctgctcattctcgacgatctgatgctgtcaatagaggagcgctatctgtccgatttgttcaccaaaaaatcccatcaccatcagtttacggtagtgttcatcactcagaatctgtttgagcggaagatcaaggtggctcgcctttcggcgcagtatttggtgctaatgcgcgcgcccaactcgctgctgtccatttgaaatattggagttcagctttttccgcgtcaactcgattttttccttgacgcctaccgcaaggcaaccgcccgcccctatggctatttgctaatcgatatgcacgcatcatctgatccggcgcttcgcctccgcaccaacatatttaaagaggagcaggaggaggacgagggaacagttgtgttcatccccaaaaatggagcggtataaacggcaacaacaacgacaacaacaacaacaacaagctaaagttagtcaagtgcttgaacattgttgcttcccgattccgactgacaacttggcagaagaaacgactaatgccctacgtggacacggtgcgccgcgtgagcagagcgaggagcgagaggggcgctaagcgagcgcttgtcgtccagaaagggagagggggtttggcggactatttgcagcccttttacccccgtcttaattgaattgccaaatncgntgtgacccgaaacacataaatacccnntcgtaaatgtctcacacacgcattcattcattaaataaaatgggcaaacaaattcattctcgtaccacaaaaaaattatcgggg

SEQ ID NO: 30094 - DNA, 920 bp, Heterodera glycines
aatagcagaacacataaatttgcaataaaaattttaattctaaaatttttgtacaaaattaaacattttcataaataagtaataacatggaataaaattattcatctaagaaatttaaattaaaaattaaccaatttttggtgctattgaatataaaaatagggctttcaattcaagaaattaaataaatattgtaacatattcaggataaaaaaaccattttaatacataaaataataaaaaataatttcaaataaaaaattaaagtgcccataatataaagttaatttttaaagttacaacctatttacttaaattctaataaatgaaagacggctgaagtgaataagaatatgcttgatcacttttttgaacgcctaggggacagctcctgcaaaataaaaagaaattaatattcttttgatttatattaatattaattttaagagttaaaaaaaataaaactataaaaactaaaaagttgtaaattaaattcatcatcaaatataataaaatttttgtgcaaaaataccaaataaaaattttgccttcaaaaataaagtgattcaacataccattaatttcgacgatataaaaagaaaattacagttgtatataaatataaactaattcattttttcggtagaaagaacattaaataattattacttaataaatttaaattgtatgagtttccttgtattattactttttttaattagttaagaatagtacttgaaattttaaaatattttgataaaagtttttaaaatattcattaaagaatagtagttaaaagtatgctaattattattttgtcaaatttttttgcttcaatagcatcccagacttcgatcactattgttacaacaatggaatttattttcatttacattaccaattgataagcaactcgattc

SEQ ID NO: 30095 - DNA, 1815 bp, Heterodera glycines
atgaagcagggaatgaaaattctagaaattcctttcctctttatatacacattagtttttgctggcgacaatgagacaaaaatcgctgcccgtcaaaatgtcgctgcgtcgaaatgtcgccgcgtcataatgtcgctgtgtcgaaatatcgctgcgtcataagtcgctgcgtcgaaatgtcgtccaagctaaaaagagtcaaaatgtcaccaagccaaaaattagtgaaaaagtcgaaaactacattttaaaaaattataaaaaactaagttcattatcaatttatcagaatcgcataaacaaataacaaaaaaataaaatttgcatgaaaaaggaatatttcaaaaagcgaatgaataaaaaaagggtgaaaattgggattcaacaattttaagcaacagccatgcttgaatcttccatgttttcgtagtccttcaatttttctgcgtatccttcgacctgcagaccaagatccgtaataacatcgtgaatctcggcatcattgtcccgtccaaatgccatcttgcactgtttttgctcaaatgtccaaactctaaaaaattaaatataaattctgtctttggcccctaatgagacaacccgttcgcacccaaaaacgagcacaacgttctttgttccaattctgacagtgcgactgtcgtatagcacgatgtcctcgccatccagccgcaatttgtcctgattcggggttcggctttcacgcgctcgagttttttgccgtcgaatttccgcctaaattcttctttgtctaatgaattaaatgcctcccaaacattttgtttcgggggcttaggcaaatgattgttctttttgtccgagaaaaccggacatgctgctgtcacttttgtccgcaattgtcacgcgggcatggcagcacacacagtgcacctccatcggacgtttttttcgtgcgtgtaccgaaaacctttgacaacttttcataattctctatcaaatttcccaccttcagaccaaagacaaatgcctcccttttgtttttccgagttcgaagttgatgatggcgcattcttcttcaaaattatcgtcgcatccatcattttggcgttttattcgtggtgctcagaattcccttcgttttcgctgtcattgtatccaaaaatttgtgttcacgacatttttgaagaatttaaatcttttttcgatccattgtaagacaaataaaattcatttttcaaggtcaaactagagtgccacgggaccgggaccgggccgggaattcccggtcatccgaggtcccggtcccggggttttgaaaagctcaggtcccggtcccggtagggcaaccgggaaccgggaaaaacaagcattggtaagaatggggggtctgagtgaaaaattagtgaagaaaataggagtcaaagggaaaaataaaaaataataattaatatattctttaaaaataacactgcccaagtgtgcaaatggcctaatggctagtctccttgactttcccttcttctttcccctggttcaatccctctacagaaagtaaattattttgaattttgtttttgtatactcgtgggtttcctatagagaaaatatgattcctcatagttttttttaaattgatacatattttatcattttttaaatgaaaatcctaccaattgagcttaataatcgcaaaaaccaacctttttttgttgaaaatctgttaacaaattgcacccaaatttttaaaatttccccaggcggcgcctatcagcaccgccggaccccttctttcccaaaaagttttttgaaaaagcgctccgaaaaaaagtgatgtga

SEQ ID NO: 30096 - DNA, 645 bp, Heterodera glycines
ctccatttatcccagtctataattatcccccagtctttgagggggttgaaaaataatcccccatgggggataaaaagagcaaatacggtattgaaataaaaaatttttttaagtggtgctttagtggaagaggatcagaaagtggaagaggaacagaaagtggaagtgaaacgaaagtggaagaggaacagaaagtggaagagaaacagaaagtggaagaggaacagaaagtggaagaggaacagaaagtgaaagagaaagtggaagaggaacagaaagtggaagaggaacagaaagtggaagaggaacagaaagtggaagagaaacagaaagtggaagagaaagtggaagaggaacagaaagtggaagaggaccagaaagtggaagagaaacagaaagtggaagaggaacagaaagtggaagagtaagaggaagaggaacagacgtggaagagaaagtggacgaggaagtggaagaggaccagaaagtggaagagaaagtagaagaggaacagaaaacggaagagaaacagaaagtggaagagaaagtggaagaggagcagaaagtggaagaggaacagaaagtgaaagagaaagtggaagaggaacagaaagtggaagaggaacagaaagtgaagaggaacag

SEQ ID NO: 30097 - DNA, 1005 bp, Heterodera glycines
gggagtgagagtgtggagaagggaagggggaaagatgggggagaggggaagggtcaatggtcaccctttggtcactcttttggtcatcattttgtgttcgtctccgatggttatgcatcacaattgggggggaggagaggtgagaagggcacttgggctaacaaaagagcaacaaaacactcaaatctcgacaggggcgagaacaacgcacgtttggacaagaaatttgggggatgaaagtgcaaattgtgaggaatgaggagggaggagagcaaacggacggagaaagggcgtgcaatgggaaatgcaaagattggtactgaacaggcggggcggagagggaggcggagctgaaataaatttaccaaatttctggggttttttggagtgtttttgggtacataaattcgtcgttccctcagcagaattgttaaattatttcttcactcactttattttttatggatatttcattggataattgaaattgttttttttttgacacgaatcctttcaatttgttaaacgatgcaagtgatgagaaagaagatgatggctgagtttgcccattatgcaaatgaaagaattatttgtcgttacaaatgactgagtttgtgaggttaaacttgggaatgttttggggaagggaaagggacggaaaatgcgcaaaaaaaaatcgaaacaaaaaaatacgaaaatgaaaatgaatggaatgaattaattaattttttgccattttcttatatttttaaaatttaacgtaaattgaaacataaaagagcagcaaattgaatttgcgcctttaatttcgaggactttggcgggaaattgtcctaatttgttgacatttgaagagagtgagtgagtgccattttacaggaagggcaaattgccaaagtgcgctcaatcttaagggaggcgccaatcttcgctaaaatgaaaaataaaatttaaaataactttgtaacttatctttgtattttttataattaaaataaatgaatg

SEQ ID NO: 30098 - DNA, 1235 bp, Heterodera glycines
  misc_feature (1129)..(1129): n is a, c, g, or t
caagtgacgaaaagtcgcgcagcatggccaaagtgccattgatgcgcaagtcgatgtaacgcaaacgatggagcaaaatgggctcaaaagagagggccgcctaaggggggggggggggttcagaaagatggacttttggtcgctaaacaaacctccggatccgagcgcaacaaatgtctgtaccggttgagcatgtgttgccggtccttctcctccgcccgtatgtaatttttcagcgtccgtaacacgttctgtcgattcgtttgacccacttggacagccaacgcggcacggtactcgtgggttgccttggtaattgttgcaattagtcaacaattttggtaataaataatgcattaaaagtcacagcccgtccccttcccccacccatttggaagatacggctctgatgattccccgacaacattacagcaaaactatatatatatttttgtcttcaaagaccatggacagtccagtccgtacatggttttttgaaagaaaaggttttttgttgagaattcttgattttcgtgtttataccctgccaaccaaatgcccgtttttcgtggttttccttgccattttccattccgttctcttcccatcgtttcgctttctctttctgctcacctgtcgcttcttctcgttcagcgccgtctgcactctttcgtcgtgcaattcctcaatttgcttgcgctgctctttgttctccgcttcgagtgccgccacagtctttcggaattttgcggtccttcgatgggaatgcgtcactccaaaaagtgccgtcccttccctcccattttccctctcacatattccgtttgtactgctccgcccccttggggtccttctccttcattgtgctgtaccgttcaaacagttcactccattccgtgatcactttggtcactttcttccgatggcgtttctctagacgttcctccgcatcacggaaacgttcgtgctcattgccttgcgggtcgtccttaaagtacgggtcctgctcggcctttgcgtccgccgtcgtctccttctttgcggttttgtcatctaaaaagagtagatgatcaatttttgttttttccaattctattttcccattgtcatttctcgttcccttttttanattcctctaaaatccctgattccgcccagataatttgctaacccggttcttcctcttcgtcgtcatcgccgtactcctcgtcgtcctcgtcctcctcctcttcctg

SEQ ID NO: 30099 - DNA, 1670 bp, Heterodera glycines
aacgaagctcttcaagttcggaccattcaaaccacccaaaattatcatcgtgaacttatttaggcgcctccaattgtcaatccattggggcaaaatccgcagcaaatgatccgttggccaagacaaccgtggattgggagacctgttgaccctcgctcacccccgcattgacgaaaaatatgcatttgttaataaattttttgttgattgagcattttatgtaaagggttgaacattccctgattcctaaagttttaagggacagaaacaaattttaggaaaatgttaaacgacacagaaattaatcagaaagaaaataacgaaaaagtaattggattggctttaattttagttatttattcgttttcttttttgtgtttctgttccgctatcgtaagagaatgacaccgtgtcttttttagctaacaatgcccctgccccccgagttattgtttgaaatagttgaagcccttccctcctcaaaattgtctacagtcttcttgagcaatcatctcttgtcgtcgtgggctcaaaaacgtctcagagggactttcaattcgctgatgtcacagaaacaagaatggagaaatctgttaaaaatatctcgtttggtttttgaaagtcacagtggattaaatatgcaataattggtttttagtttttcgtggttttatatccattttattgttaattcttaatgcgtttttaattagtttttcagcaaaaatgtcagaatttctcattttccttttgggtttctcctttgcaatgcttctcatgttgtgtttgctggtttcgctggtgctctttgttctttatacaacatggtattattggacaaaagaagaacaacaagaagaatgtgatgattttccagaatacccaccgccttattaatgaaataaattttttgttgaaatgtgtcatgaaaaaacttgggtttaatccataatatctttttaactttttctgttttaacattaccatttcaaatatctaagatttgaaaaatgttcaattcatccttttttgttgatgtgaaagaactagggcgtattccaacaccaaaggggaaatttagtgagaagaaaaatgaaacacaatttatgaaaatatttaggtatattttatgcacttgagttcgctaagctttatcaaacggttggacgtgaaatttctcgtgataaattccgacatatcatgaaaacagggaaaaaacaacacgaattagcattggttttgatggaaaaggctgggataaatacacagcagaaaacttttgggcttaaacacctccaatttgtgcaaaactgggacaaggaattcccagatatatttcgtatcgttgcgtttgatatggtaaacgaacatttccaaaactgtttgtgattgctttccggacttagaccgattttcaaagggaagggagtaagaaaaaacgaagtttatgtgataagagtgggcgaacattgggatggtttaaaatctgttactcaatttttcgccgtcaaaaatctttgtgtaagctgtgaggtgacatacgatcgacacgaccgtcaccgaatggaatgtagggagcgctgcaaaaagtgttgccggatggggtttgggtttccttgtttggatgtttgtgaggcgatacattgcggataatgtaatcggaatttcta

SEQ ID NO: 30100 - DNA, 212 bp, Heterodera glycines
ctcctttccccctgcctctccccttccctccctacttcctccccatcttccttactttcctactcgtccccttcctctcccctcccctccctacttcctccccctcttcctcctttccccctgcctctccccttccctccctacttcctccccatcttccttactttcctactcgtccccttcctctcccctcccctccctacttcctcccc

SEQ ID NO: 30101 - DNA, 1309 bp, Heterodera glycines
aaaatgagggggagagatagttgatgtggccgcccgggaccgtacggctgctgcccccgggagaaaaagagagaaaaaaagaaagtgaggagcagagaggaagagggggcgggaatgtcccacactattgggttcagtccagttgaggaaagttcgaagaatgggtacgggccaaatgacaaaaatgcctggcaatggcgcatcccacaacagggcaggtgtttgcattcggtcggagtctcggtgagcggtgtgcgagcgcgcaatttttttttagatttaaaaatataattgggtaataattatgtatttggatgaccggataaaaaaatcacttacgctataatatatgtacatgaaatgcatttacctgagtaaattatggaattattcgttccggttctgtatcggagagttattccgaaaccgaccgaccgaaataatcaaaaaaccgaaacaaccgaccgacttttatgaaaaaccgaaaaaaaaccgaatcaatggagaacctgttaataataataaatttattgcttttttgtgctctttttcattttgaagaattttttgtaaaatattttctgctattttgaaaaaaattattaacaaaaatgcaataaaaacgaaaaatacacccctgagaaatggaaaattttatcaaaaattcatattcaaaatttatttatttatttacttgactacatttttgatttttaaaatatttatctcatttccattttatatagcgagtaactagctatcataagtatgcattcacagattattacccaaaagttggcgacttaggcgctcggctaagatgagaaataagaggcaaaataaaaaatgattgatttagtctgcgaaagtgacgaaatacggacgaattgttaactcttttcactttaaaatttttattgttttagccaattaaaaaaaaacactgaataatgccgaatagtttaaggacacaaatttgggaaatttaaaacttgaatttttctgttttttcgaatttatttttttgacggaactttctttttttaatacgaactgaaaatcttttcacctgtttttcagggtccttgattacgaacatattagatccgttcttcggataacaaaagaaaaaaaaattaccgtaaatgctctaattatcgcccagtctctattaatcccgcccaattatcccccagtctaggaggtgtttgaaaaataatccctctatcttaatcccccagtctccaattatcccccctcccctttctgaggtgtttgaaaaataatcccccatgagcgataattagag

SEQ ID NO: 30102 - DNA, 1524 bp, Heterodera glycines
attttcaggaagccaaagggcacgacagtgacgcggcagtttcagcggtgcaaaatgagtacggaaacaatcggtaaaagtttctgctataactccaaattacaacaaattgggtcacatttgcttcactccctcactttcagtgtcgaaatggaagtgccaaagttcgtggagctgttcattgaacgtgccactgctcccttcttcgtcttccaagttttctgcgtcggtctttggtgtttgggtgagtgagtcaccgccgaccattgcccattaataaacaaattatgcatttatttccttttattagccctaaaattacacttcaaccttttggtgacttaattttttgaaattcagaggacatgtggtacttttcactgctcactctgttcatgttggtcactttcgaggtgcaaaatatgcaattttttaaaattttaattttatttttcaggcgaccattgtaaagcaacagctcaaaaatatgtccgaaattcggttggacttatttgccatttttctttgagttggccatgaaatttgcacacaggaacatgggctccaagtcgttttttgtcaatgtttaccgcgccaaacgatggaacaaaattccttcaggcaaacgaagcgataaaaaaagacattcgattttaaatttttttagaccaattggtctgcggtgacattgtgtccatttgttcggtgaaaggaagtgacgacgaacgggcgattccatgcgatcttttgcgtataaaaacgagtttattttttacaattttttttttcaattttaaagtcctccgtggcaatgccatttgtgacgaggcgatgttgaccggcgagtccattccgcaaatgaaggaacctcttgaggaggtgacggaacgccaacgcgtttttgagccgaacaccgacagccgactgcacgtgcttttcgggggcaccaaaatgttgcagcacacgccacccggtgagcagaagcaacagcgtacaactaatatttaggagtaatttccattgttttttattttggtaaattttatttcgaaaaactttttgaaaaatttcactgccataccttttgaaagcctttaaagggcattttaagtatctttttttcattttcagctaaaaatgagcccggaataaaggggcccgacaacggcgtggtctgttacgtgctcagaacggggttcaacacgcagcagggaagtctgctgaggacaatcatggtaagaacaaacaaagagctatcttattactggtagctattaataattgatgctacattgtcatagtaattggatcacagcaaattcatccacagaaacccatgttatggcatttttttatatatggatgagttgggtggtatatggcaggtggtgttgcttgtctcgtttcctgtattctcttattttagggcatctcatagttactttaatttttttgtccctcattatgggtattgtgtttaaccatcgactaattggattgattgtgagattaaaaagtctcatt

SEQ ID NO: 30103 - DNA, 1752 bp, Heterodera glycines
  misc_feature (1527)..(1527): n is a, c, g, or t
  misc_feature (1647)..(1647): n is a, c, g, or t
  misc_feature (1691)..(1691): n is a, c, g, or t
  misc_feature (1729)..(1729): n is a, c, g, or t
agcagaaggggcgactcgcgactccaattgaacaggtggacaatgtcctgtgaattgggggggggggggggtcattttgagagtaattaatgataagttttgatttgtctcgagttaatttgccaaatgccgccgctctcttttccggcatttttcagtgttaagcatccatcattaactaattagtcaatgccacacaatgctttccttccttaaattgcctttgcccacctccaaagtgtagtcgtcctccagcacattttgcagtgttccgtccacaaaatacactccgaaatggtcggtcatcgccaatttcatctccaaaagttgcttcagctgttccaccctcactcgggcagaacaacggaagaagcggcggaagaacaacggttgctgctgttttttgactttggcgggcgaagggacagcgcccccaggcgatgccgaaacggaagcggaggggacagtgccggaaggggtggcggtgccggcatttgccgtcgtttggtggtgggaacgatttgcggccaaaatgtgggccaatgggacgtagtcaatttggacggaaatcttttcgtcgggtgaacaaagcgaagcggacaattggagcagccgttgccttttgaggaggcgccgttcggtggaaagtgccgacgcattggcagaggacggcggaggacggcgacgggaacgcgcaattcgggagagacggcgccagaaaaggtcgggcaccaatttgtagaccttaaaaattgaaaatgccttcagtgcgaaataatgcggaaatccaccgggctaaaattctttaaccattttcccagggactaattggggtcaatgagcgtaattttgttcgaatttgggtaaagagtccggaattggtaaatggatgtcataatgaatctaaaagaccacgaaaatgcccctagaaaggtattttcatcttattttcacacgaaaaaactgcacataatcgccagcagatgatggattggatgagtcaagcggacaatccgtcagaaaattaatttttaggcatttgatcgaaagtttattcaaatgatagaaaatttcctatagaaaaatgttaaaatcgcaaaattcgaattattaaaatatattaattttagatttatcaattttaaaagatttattattatggaaaataggtatcttttcatcattttacacaaaaataaaagcaataaattattgttttcattcactttttttttaaatttggtggaccgtgaaaaccaaaactggaaaatcaccgaggcataaacaatttggacattcatttcataccaatcataaatttatttgtaagcaaacggcaataaatcagaagcagaagattaaaagtttttcattattttcgctttcaatacatttctgagaaatggctaatgagcccattaattaattaataattcattaatagtgactcacgagttcctgaagggcggaatcagggcgaaagaacggcttttcggggcccaattggacgtaacatttgggacaacnaatttggggagttttgtgatgaaaggtggcgaagcaaacacggacgacaaactgaccaatgggagaacgaataaataaccattttggatttacaaattcgaacaaatttgatcaattgtncaggaaaagcattttcccaaatatgataaatatttttattgtgnccacaaattaaattattttttgccggatttttcgcttnttatcaaaaaaaaaattctgttt

SEQ ID NO: 30104 - DNA, 1061 bp, Heterodera glycines
ggtgggtggtgttcaataaaaataaaagggcggcgaatgggggcatacccgagggaatttgggcacaatggcaatgtaagccagaacggcacacgaaatccggaaaaaatgggattggtggatttttaaaaagcatcccaaaagttcgtggattggaagaccaaatttgccactcaattttgagcccagatataaaagccagaataatgataagacttctcggctcaatttttcaccaatcccgcagcaacttccacacatttaaaatttaaagttctaaaaattagactttgaatatcactgtatcccttttttcgtttggttggcattttcacattcggttaatgccggtctttggttttttatcaaaatgccatccatcactgttgccgcttcttaccgtttatcatttgtcatcactaattattttttaaaatcgtctctgtcaattcaacatttttaaattcgtgattttcccaaccctcaattggcaactttccttttttgaaaaaatattttacattttttatgaatgccctcagctcctcctaatcattcaacattttatgatggcctaaaatagcaaaatcccctcagggcatggccctaaaataaaatttcctccctccccgccgcactgctggggagagagagagagagagcagcgcgaaaacagagggcaaattgtccactttatctgattacgacggcatttgtgtggatgatgatgggcacggcaaacaatgcaattttaaaaaatggtgataatgatggtgaaaaattgccaacaaaaaatgaacgtcatcatcattaggagaagcgcaagcctcaaaaaaaaatagagaattttctctaatctcgaggttctcgggagcaccaccaattattttattgaaattaaaatgcttcggcggcattgatttcttaccggagctcgttttcggagcgggcgttccgatcccattccacaatcccaattttcggtttttttttgcgctggcattaagcctcgaatatgccgtcaaaaaaattttctatcaaaattacaggctccaaatcac

SEQ ID NO: 30105 - DNA, 1948 bp, Heterodera glycines
  misc_feature (281)..(282): n is a, c, g, or t
aaaaaaaaaatttttttttttttataagggattgggttaatgggatctttttgactttgacctcatttatttttttcttggggattttatttatttgtgcttgtataatccgattcttttggacgattaatgtatgtatatgtcacaaagtaagtggattatccccttttgtggacttttcttttctttataaataaataaataaataaagtacagaaaaatgaaaaatcacagtaaaaacaactttttaaatttcagcataaaaatgtaaaataaacatnntaaaaataaattcaacaataattttaacaataaaaaatgtaaaaattaacagaaattcgcgggttcataaggtaatttggacaataaaacaaaaaatcacgggttcattcgatagttgcgagaaattccccggagaaactccaaaataaatgtgaaattgattttttgaactcgcatctccaaaattttgtcatcccatcagaactcattttagcgaaggtgtaaaggtggccttcgtaagacaattttactttttgttttttggttgcaattgggtaagccatttctgaaaaatatccaaatcagaatgtacatcaaattggttaactattaaaaaataataggatttggaataagtaaaattgtaaaaaatgagcgagtgttaattaaacctaacttatgccaagtggcgagggatccctcaggcttagtttttagattcttaatttttaaaaaagcacattttccgatttttgggttggggcccaaacgaccccggggcccaaaaacgggggcccaaacgaccccggggcccaaaaacgggggcccaaacgcgggggcccaaaaacggaggcccaaacgctctggtcccctaccctgtacgtttcattcggaagtcacaccgtcacttgggtacctctcctttgttagtaattttttccccaattttttcgtttttcgtgactataaaaatgtttgctttttccatttctctctcattatgaaaaaatatttctaacgcaattatttccctctttgtgacatccttcgaaatactgcgcattgtgctaattgacacaaaatgaaccgacggtaaggaatttaaaaaacaaattcatttaactaaactgttttccccgcattctatgttgggtttgtaacgatgtttggatggacattctaccagtttttaaccgtcttcaactcggcctcaaattggcacttctttcgccacgtttcgatgttttagtggacaaacattttgatggcaaaagcgaactgacaatttggagacatatcaatattctaaaaggcgctggaccagaaccagaattatctgtacggattgatcgcaaaaccatggtttccattgcccgaccgtccgctgcccaccaaaatccgcattaaggacattcatatcgggtaatttaaaattcaaataattattaaattacaaagcattcctttccaggtacactgaccattccgtcatcacagcaagctacataattcgacttctatcaacagaaattgacccagttgaattgatgaaccgaatggaccaacgaaatgctgacatttgagaaagatacgatcatgaaaatatggaggacgatgaaaatatgggacgaagatgcaagtgacgattggctgttgaagcgatgccaaattggagaaacggcgacgattcattgggtgtgggacccgaacgatggcaaaatgtcagccttacgctcaatagtgtcaggaagaattgcattgggtgaatggcatcagcttttgttttaacaacaaatttaaattgacctccattcaggccattgtctccacccaaggcggaccaaatgaatgcaaaaatcgtctgaaaatgagcgccgggcccagcggaagaaaaagtgaaagaattattgagaaatgacaaatgagtgatcattatgaatggaaa

SEQ ID NO: 30106 - DNA, 1263 bp, Heterodera glycines
  misc_feature (60)..(60): n is a, c, g, or t
  misc_feature (69)..(69): n is a, c, g, or t
  misc_feature (111)..(111): n is a, c, g, or t
  misc_feature (201)..(201): n is a, c, g, or t
caaaaaatccccccagcgggcaaaagccaatgacaaaaaagagccccaagtaataaattnaattatatntaatattgtgccaaatttgccaatttgaagccaaaccaatgngcagcagtgaaagccgtgccaaaggcggcggagaatgctcagaagggaccgtcgagtgcggaagtggtggcggaggaaaacaacttggancactgaggcggtcgacgacttgggggcggaagagtcggactttgaccaattggcagaggacgaactgctcgaggaggacgccatgggcggcgaggcgaacgaattggagggcatgggggaagagacggagatggacagccaaatggctctttgatggacaattgaggcaaattggacaaatggcaaacggaaaaaacgggacaaatgacacaaaaatataatttttatcatagaaattaaagaataataaatatttatttcatggaattttaatatttttggaataagatgattaaatagaatttattttgtattcagtgagcatagctttgatacctggaattttcttctacttacaaaaacataaatctcttcagttcagtagccctaaaacattttgttataaaaaatgattggataatttaaaatattattttgaatttgaatttcttcttgaattaattttgagtttaatctttttttattttaattttgataataagcaaattgcaaaacacctaaaaataaaatatatttcaaaaattgcaatttttattcaaacaaaaaatttaaaaattggaacgattaaaatgacataaatgaaaaaagaaatgttgccatggaaatgaaaattaatataaattataaattgtgtgaacccaaataattgtcaacttctgatttggccaagcagcgactttgcggttcacattttatcaccggctttccaattttggcattttcgttatgttcaacctatgaatttaataatatcattgataatgataaaaacaacaaattagtgagaagataaaaataaatatgaaaaaatatcgcctaaaagtaaaatatactttcaaataataaattaaaattttaaaactttttcacattatgtaacatttttctcatgaaatggcaaaatatttgataacatttgggcgtcaccttggcatttttaatatgaattcgttttttctatatacggtattgtttgagtttcttactgtaatatattgaactgcccaaacgggaatgttggagtgaagttgcacggcattt

SEQ ID NO: 30107 - DNA, 1031 bp, Heterodera glycines
ataaaggtataattcttgttgttttaggacaccatcgtcgctggggcggatgacctgaacgccatcaccggcagtaaaggccaaatctgaggcggagcggaacgtgctctgcaaccggctggcggagcgctcgctccgcgtcgccgctcatatgagacagttgcaggtctacgtatgtatttttttccaacaatacttccaacattataacattttaaagtatgctgagagttccaaagcaaagcatcgattgagctgggcggttgcccacaaggaaaagcagatcaatcaactgaagaaagacaacaaacaactgcgaaaggacgtcgagcacctggaggactgcggcaataaaattaattattttaattacttttatttttcatttcagttcctcttattgtaaaagaagagcccattgatgaacagttcagattggcagatttggagaaggaaatccaggcattggcgaaacgtctttcattgcttttccgtattgaaaagtcagttaaaaatggcatttgaattataattaacaaatttattaaataacttattttactttataattgacttaattaatcaaataaatttactttggattaacatcgataatttaatctaatcatttaattttgttccgtttaagcgatgtcttcgttttgatgcttcccactgaagaaggtgaccattggttgtctcgtcttttgatgcttcgcgatgacaacagctccattagacttgccgaattcaccggctcttccgaagcattcgcagaaaaagccgaacattggctgaaaagtgattttgaagggccgcaacaactgatggaagcggtacagttaaatcaattttgaaattgatcagttgatcgattatatcagtttttaaactgatcagctgatctgatcacttttataattaatttccttcagttgaatgcgaaatgtgtagaatactttcaacagcagaaaatggcacaggacgaggacaatctttgacagattaaaagggaaggaaaactctgatta

SEQ ID NO: 30108 - DNA, 1789 bp, Heterodera glycines
ttaataaaaactcattgatttttaagttcaaattatttagataaagctgacaatgaaatatattgtgaggaccagaaaactgcataaagaaatttaattgtaaaaaattaaaagcaaaaattctgactttattttctctttttccatgctataacttatttataaatttagtcaaaatttatttttgaacttctacattcattatttttacggagtatttttttaaactttcatttataagttttactaaaatgccgagaggaatgcatttattgatttagaatttttgtgaatgctttatctctctctgataaagttgagtttttgcttcataataaaagtttcgaaattgaagcaattccaacaaaaatacctataaccggggctcccaactgaaattaatcacacacacataaatgaaccaattactttgcttaatgaatttaaaagcaatcaattgaataaatagaaaatgtatatcaaacaagtgaaaattaaatggattccatttaattagaatcggaattgattgttaaattttcctccgatcgaaaactgagtgatcactgatcagtcgagtagcattgggcatggtgcattttgcttgtcttgtcaatgccgaccaaaactccatatgcttcagcacaaagtcaaaaacatttttccttaacaaatgttaaattaaaaaaagtcgttaaaaaaataaaataaatgaaagtgaattaatttgtgaggccgtacaacagggattaagccaacagcaaaaaatcgtaattcagcggcttaacgaatttttataaatacttaaatcagaataacccagatttaattttttttaatgtaaaatttaaatttgcaatatttcaagttggtcacaaacgattaaaaaagttattttccaaagtggagggttcctttaaataaagaaaaaacatacatttaaaattataaaattataaaaatattaaatatttattttcacgaattaaaaatggtgttggccatttaaatatttcctcaaattatttgaccggcgatttaatttattcctctgctcaccgccgctattgtgttgcccattgtttgcgcaagtgttgcatgtaaatgcgctgttgttcctccaccgacagtgtgcagatggcacggcatgccctccgggcgctgctttgccggcaaatgaagcgtaaatagacaagcaccgtgacgagaatgtgcagcgggagaaactgtttaaatttgggggaacaattttcaaaatagatcagaatgaaaatttcatatttaaaatgatgatcattgattgatgacggcatggcagcctgggtttttttggtcccgaacagttggctcattatgggattatggcagaaaagccgagaaaaatcttgggttggctttaaccgccaagtcatgtttctggttgaaaaatttttacaaaatcgaaaattcctaggccttaaatggcaggaatcgggcatgccaatttccaagcaaaacaaaagtggaattgatcttcgggattgtaaatgttttgaaattgacaacggaactttcaattagagtagagcgggaccgggaattttgggcaaaaccgggactgggacttgccgggatctgagaagccgggaccgggacctcgatttttcttcgggaccgggaatttttaaaaattcaaaaaaaatttttctttcattatttcaaagcattaatcatttgggctaaatggtcgaatattatttgaaaatttagatttatttatcaccccattttttttcggcgcgctttttcc

SEQ ID NO: 30109 - DNA, 1808 bp, Heterodera glycines
  misc_feature (60)..(60): n is a, c, g, or t
atggcctaattagcaccataaagatatttttgtataaaatattgaaaaattgactcattntggttcaaaatacgaaaattttcaaaaattcgaaaaatcaaatctcaaaattttgggcaacaatgaaatattattggcaattaagctagcaattcaaatttgtcactgtgaaaaactggttatcctaaaaattagtgatgagttctgccgattttaatgatccaattacgtataatctgctgccaataaaagaatgcattaaaatatattagtgaacaatgggaaaataaatgttaaagattttaaaaagacaaacatttaaagaaaaatgttattcactaattgaaaagataaatataataacttataatataattttttatggtttaataatggctaattctaacgattaattattgctgaataaaattttaaaaattagaagaataatttatttcaattcatttattttatccgaaataaaactcaaaaaattaagtgtatttttgaatttgtaaaaaatcttcttcatggttatctcaactttgatgaacaattattgtttcgtgcctttacaaatttccattcatttgcaagaaacttcgcctctcgtcgctcgatttatccattcacaaaatacggagactttgttgaaaaaatcttaataagaggaagttaatgagtttattaagtataattaatcgcgtaattaaaaattttttacaaaatgtgatcagaaacgtactcttgtttgatcgttctgattcatgtcccaatataacaccgatttgggtccacctaccattcagggttctgagcaatggacctccgctgtcgcccttttcagttaaagaacaaagtttaatttgattcattttaatataaaattacattttgaataaagatatttttgactaaattaattttacaatcactaaggattcgttttttaggcaaaaaatcgggaaataggcacctaaaaaggcagaaaaaaatcataaaataggcattaataggcataaaaatccccaaataggcattaaaatagaaaaacaaaaaaaaattaataacgctttttaggtagcaaactcgttaaatttaatcaaaaaattaatgtttttcaattataatgatatattaaatattttaagtttttttcgaataaggacaaatttttaaaccacaaaattttaccaagaaaaaatatattttatggaatcaatttttgtaaagataaaatttaagggggattgaagttttattcattttctctatacaatgaaaatttgtagaaaggcaaaaacctcatttttttgactaaattcattataatcatcataggaacatatacttagagtaataaaggaggcaaattgagtttgtttttaatttatcttgaataaataaaatcttagagacgattttcgtatatgcaaaataaagaattttgttagtgtttttaaaacgaacgtgcgtagtcttgtggattcggctgaattggctgcaaccgtttgaggctatctaattaattgaaattaattgactaattaagcctcattttgttactacatattgtaccttattccttttttcaacaaaaaattggcgcagccggggaaaaactttggatttttaaaaaatctttataagaaaattcaccaaattttcaaaatgttcttcttttcctcatagtgaaccccttacccttccctcttttaaagcccctttcctctctgcgaaacctaatccctcgtttttacatgagataattcaaatttatagaaatgcacctcctttcgtaagtcccc

SEQ ID NO: 30110 - DNA, 1694 bp, Heterodera glycines
  misc_feature (1498)..(1498): n is a, c, g, or t
  misc_feature (1526)..(1526): n is a, c, g, or t
  misc_feature (1637)..(1637): n is a, c, g, or t
agtaaaaacaataattttgattaaaataaaccttaatacacattttaaattaaaaagtatattaaattagatttaaattaaatttttttggacgataattttttttgaataatttaaataaaaaatatatttaaattcattagtatattttaatccttaaaaaataaattccatcatctttatgcgattctcaagtttaaaaagcattttattcattcattttagtacaaaacaaaattaaaaaaatgactttttttttggttgattttatgaatagattaatttttatatcataattttaaaaagacatttttgaattttttttaatattttgaattatatgtgcgttaattttgggtgttcttcacttcatttatttattcatactattaatttatgactaatttatatatatatatatatatatatatttcatgccttttaatttgatttcttttaaatttgatgtattagagtcttcaattatttatcaactttaatttggatccaaatgtttaaaataccggtttgacacgtgaataatgactgtaaatttaacgtacatgaccgtgaattaacacgtgaataatgaccgtgtattaacacgtaaatcatgatcgtgaatttacaagtaaatcatgaccgtgaattgacacgtgatttaacccgtgtattaacacgtaaatcatgaccgtgaattgacacgtgctttaagccgtaaattgacacgtgaataatgactgtaaattaaacgtacatgcccgggaattaacatgtgaatcattaccgtaaattaacacataaatcatgattttgaattaacacgtaaatcatgactgtgaattgtcacgtgaattaacccctaaattgacactgaataatgactgtaagttaaacgcacatgaccgtgaattaacacgtgaatcatgaccgtgtattaacacgtaaatcatgcccgggaattaacatgtgaatcattaccgtaaattaacacataaatcatgattttgaattaacacgtaaatcatgactgtgaattgtcacgtgaattaacccctaaattgacacgtgaataatgactgtgtattaacacgtaaatcatgcccgtgaagtaaaacgtaaatcatgaccgtgtattaacatgtaaatcatgcccgtgaatttacaagtaaatcatgaccctgaattgacacttgaattatgagcgtgaattgatacgtgatttaacccgtaaattgacactgaataatgactgtaaattaaacgcacatgaccgtgaattaacacgtaaatcatgcccgggaattaacatgtaaatcatgaccgtgaattgacacgtgctttaagccgtaaattgacacgtgaataatgactgtaaattaaacgtacatgcccgggaattaacatgtgaatcattaccgtaaattaacacataaatcatgattttgaattaacacgtaaatcatgactgtgaattgtcacgtgaattaacccctanattgacactgaataatgactgtaagttnaacgcacatgaccgtgaattaacacgtgaatcatgaccgtgtattaacacgtaaatcatgccccgggaattaacatgtgaatcattaccgtaaattaacacgtaaatcatngatttgattaacacgtaaatcatgcccgtgaattaacacgtgaatcatgatcgtgaa

SEQ ID NO: 30111 - DNA, 1877 bp, Heterodera glycines
  misc_feature (1145)..(1145): n is a, c, g, or t
cgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactaaaaaaatatgagtgatcaaactttcactaaaaagttaagcctaaactttttcccaaagttaaaaagcaattaaaattttattcacctccattattgaaagaaaaagcatcagagtgcctaaactaacatgtaaataaaatttggtgcgtttcagaaccctttctgaaaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaaagtaaagcctacatttttttggcatattttaaaaagccaattaaaaaaattttaaaaatttaataaattttcctgccaccggaagttactcactcggccttctttccggccctgggggggggcctttcccccccccccccccctccccgccttcagagcacgacaaatatttcaacaaaaattttgaaaaattgactagagcaatcgaacgctaacggacgacctaatggaaaaaaatccccgaaggagagaatntaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactgaaacaattatggggagcaaaaatccaacgcagaattaa

SEQ ID NO: 30112 - DNA, 1187 bp, Heterodera glycines
  misc_feature (34)..(34): n is a, c, g, or t
  misc_feature (92)..(92): n is a, c, g, or t
  misc_feature (130)..(130): n is a, c, g, or t
ttttgtcatattatatcatcgaatgatatttttntggtatagaaaaactaaaatttttatatgatattttttaatattttctctttttatgnaaaaagtgggaccagtttttttcataatttgtattatntaataaaatttgtatgttttgtgttagttttaattaatttaatttttcatcggagattattctttattataaaatttttattcttttttttcattctgtttcagcaaggatttacggcttctcggcgacagttaaattaaagttttttaagtaaaactagatttatcaccttttaattttattcacgtgcggtcgatgctattatcacaagcttcgaattgaatttaaattccttattacaaattttttatttcgttcgggtgtctttaaatctctttttgattttttcttcgaattaaaatttataaaaaatagaaaaagccctagaaatttcaatttaattattatttattagtatactaatccaataaattgattggttttataaattactagtttattcgttttaataaaaaattggtggttgttaagctactttttgagttagcaactatttctagttaattatttttagcacctaaaaactaaaaaattttgcctattttaacctatttttgttttgccaaaatatttatttattttcttaacatgaatttttgatttttaaattattaccttaatactgatttagccagattttagtttttttttaaatttttgtcattttacaccccctaatttaatgctttttagttcctattttccatattttagaacctaaaaactaattattttggcagtttttagcaactataaattggagtcctagttttaatctaaatcttgtatacacaggttgacgttattatcttttttttcaatcattaattttttttttttggtttaaaagaaaaaaataaattattatttttttctataaaagttaatttttctttcaattttcccatttctcttaaccccccccccccaatcttaacaaaatttcgtatctcgttacaaaatacgagatacgaaatgagcaaaatccctgattcttaccgttgtttttagtgcatatctaaacgaatttatttttttaattaaaatatatgggaacactatttccagcttgtttgaattaatttaaatgtcaatt

SEQ ID NO: 30113 - DNA, 1712 bp, Heterodera glycines
  misc_feature (1550)..(1550): n is a, c, g, or t
ctttcagtttcaccactgattgttgaggcaatttttttcgccaatttcttttgtctacaaacattatttattggcgtttcatcctgtagtgtgtaaaaaattttcagtaaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggccgatgaaaaaatggagttttatggatgtcaaattttgggacttttcttcgacgtggcccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcactaaaaaaaacacgttttctgaatattaacaacaaaaatttttagacactttctaaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaattttttcgccaatttcttttgtctacaaacattatttattgcgtttcatcctgtagtgtgtaaaaaattttcagtaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgngacaaataaaaattaaacttctattatgatcaaatttaatttcctatcagtttcgggtttgcttaaacacgctggcctatgaaaaatggagttttatggatgtcaaattttgggacttttcttcgacgtggccatcaagcgggtgtttcgtgacaaaaacaa

SEQ ID NO: 30114 - DNA, 2267 bp, Heterodera glycines
attcattgttaaaaaatttatttgtaaataactttttattaaaagttgggtataaataaaatatgagtttttattttaaaattattttgtttttagttccggtcgagtcaaattaaaagtctggtgttcattatacaatatttaataattcaaaaaatgattaaaactgcaccaacctggagcggaatcgtccctcgttcggggtacggggtaggcgggagtcggttaaattttgcatattagcatttttaacaaattacaactgttgttatagtcatatttaaaataaattcttagaaaatttttgaattttttggcctcttgggataatcaaaaaggaggacctcccagttcggcgccaacactttcggcaccgttgctaataatttttatcattattaagaaaattaaatattttttgtatcattcgatagcccttaatgttttctataagcctgcaaaatttaaatttttttatcagttttcaaaaaaaagttattgccaaaaagctcaaaaaatgacattatcatggctttttcggttccgtttgccatagctttggggccggcggtgccgataggcgccgccgggaaaattttttttgtaattttaatgctatttgttaggagattttgtctaaaaataccaaattttgagattttggataattttttaagaaaacataggcttttgactggccggcggtgccgctaggcgtcgcctggggaaatttttaaaaatttttaatgaattttgttaaaaaaatggccaactgatttgtcaaaaaagtcggtcgattgtttcggttaaaaaaaccgaccggtccggtctctactttaaatatgctttgtttcaatgttaaattattcttttcctaattttctacaaaatatttatattttttaaattgatttatttgcataattaaaagaatagaactaattaatttaaagaaaagtaaaattttaattgatacatcatcatctgaaaatcaaattaacatcagttaactgtttattgtatactgtatatcccaaagtttatttttgtattttcttttcacatcaaatgtattcttaaatttaattaaatttttaatttggttatttcatttgttttttttttaaatcttctatggcggttaccgcaaaatgtgcgtatagtacctttaattgattaaaatattaatataattatttttataaatgctcaaatgtcataattttttaaagcttttttcatagaaattttgttgtttttgatgaatgataattaaggctgggaattcttttagttttggctaacttttttaatgacttctttccattttaaatgatttttatgatttttttagttaattttttggcggatattatttgtttataatgaatccgagttcatgagaaataaattaaatgatgataaataataatttttgcaattggaaaattattttgacaaattttgggaggaaatttttaaatgaaaatgaataaattggcggggcgacggagcaatgggagaggggcaattaatggacagcacaaaagtcaattaaattgaacttttttttgcagatgtcgtaaaatttgctatctaataaaactattcaaataaatccccagggttccatttcaaatttaattaatgggaaaattggtgagctttttttaatcaaggatttaacggacaatagcaaaagcaaaaattcgattaaaattaaaataaatgtaaataaatagagtttactttttcaaatttaataaatatatatacagacaaataaatttttatttttttatattttgataattttcttttaataattgcactcaaatttcgtttttctttatgaaaattattcaaaatttgtttattttttaaatgcattcatatcaaaatattaatttgtagtgaaaaataattgcattatttattcgaaatttacatttaaaaataaattttctttctgctaaaatcattctttaaaattgtattttacctaaaacataaaatttattactgatctcgtttaaaacttaacaactgaaagtgttcttttaccaaaagattatacattttctttgacaaattatcaattcctttgttttttcgaaattgaattttatttttattttttttgtttttttctataaatcatatattaatttttttaaagagctattagatttattattcacagttcgactaaattatctttataaaggtttaacagttgaggcacttatctttcagcttgagttaat

SEQ ID NO: 30115 - DNA, 1507 bp, Heterodera glycines
tgtttcttctccttattaattgcctcttcgcgatcggctctcttctgacaatttgtcttaatgttatcaattgcgacatgctttttttctttgttttgcttaattatctctaaaatacgcttcatgaacaacaccgacttcatcacttcctgcaaatgaacaaacaatgaaaattgcatttgcatttaagcgtcactttaaactttaattatattaatcaattatacatttaataaaataaaatgaaaaatcaaataaatcaaaatcttcaaaacgttcattatttattctaaaagcctaaaatgatcagaaaatgagcttggggcgtgcttgccaattttctgaagaaaaaacccggtactgaagtgtccattttcaacgggattcgacgttttttcgtaatcaaatctctcgaatttctttttctcgggttactaatttattgaaaaatgaagcaaatccctaatttgatttgcctttaagtgctcaagttcggtcgcgcttgagaacatcatttgtccgacaatttcgccaatctttttctctaacccttctattgcacttttgtgactggtgaatttcatacaaagtttgccgaacaaacaatcgaaaatgccatggagaatccttttttgttccgccttataaatgggcgaggagggcgatggcattggctcatcaattggcggaatttgctgttgctccattggcattggcactacttaaaaatgggaaaggttttttgaaaatttctcatggatttttttacatatttggttaaatattttggacttttttcttatatatttcattttttacagattttgaggattttttacggaaatttttggaaatcatcaaaaaaaatccaaaatttcggcaaattttttgtatattttttcattttttatatattttgagaatttttgaaaatttgtagtgaaaaaataattttgaaaatgtacccctgaaaaataccaaaaaataatttttaaatactaaaaggttattctaagcctatttaggacgtttttatggcattttgtgcctatttaatccattaggaagaatttttttccaaaaaaaaagtttagaaattttatttaaatattcagtacatatttatggttttgtgtacatatttcgggatttttgttacatatttatgtacatattacatattttgaccaatttttgtacttatttttggcagccctatttattagcattttaaaaataaaaaaacattaataatcagtgttaaattagggacaaccattttttagagcacattctggcctttttttaacatttccagcaaataaagaaaatatttttcataaattcaaaattttcagaaatttttcctcgaaaatacaccaaaaacggatttcccaacaattagttattttggataaaatgtaaaacaattttgaatttttcaactgactattgtcatcatcatcatcatcagatattccgacggcgatgctaaaattctgcaaaa

SEQ ID NO: 30116 - DNA, 761 bp, Heterodera glycines
cctaaaaataattttcacttatttttaaaaaattttagggtgtgtgaagactccctttcagaacggagttctgaatttttttaatggaaaatcgaaatatttttgtatttttcatgaaaattcagaggttttctttaacaaaaatgcaataaaaaaattttgaggcgatgactttttttggcgacatgtataataaattacaaaaactttcctaaataaatctgtcgaaaactaatccccccctctccatttatccccccccgtatctattaatcccccgcccctttctaaggaggttgaaaaataatcccgccggggtgataattagagaaaaaacgggttcttatcccttttgtcaccccccccctgaaaattttttcaaaaaaaaattttctaggctaattttatgcgctgaacatgaatctaacattagttttggccgattccgaaccctggacccgaattcgaacaaaaagtcgaaattcaaatttttaaaaatttacttttatgttagatctgtacagaataaccggttttgatgtttcaatgatttgtgactaatttatatttagttttaatcaattttaaagcaatgctgaaaaattttcgaaaaatttgaattttcaactttttcttcgaattcgggttcagaattaatataaatggatgtcgggttcgtgatcggcgacctctaaaaccccggagaaggtgttttcacgacttttttaaattttattatttttttcgaaaagatggagggg

SEQ ID NO: 30117 - DNA, 1005 bp, Heterodera glycines
ttagttgagcgcactggcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcattatatgcagaaaagtcaagtgcatatatctcagcgcctagtgcatgaataggagcgtttttactgttttctgagagcgccctgaagcagcttt

SEQ ID NO: 30118 - DNA, 1120 bp, Heterodera glycines
ttttcagcttttttttcccagaaaaaaggatggggcaaataaaaaactaaacatctctcattcaccaattttaaattcccttacattttggggtttactttagctatgctggcccataaaaaaaatgggagtttttccggtgccaaaatttttgtgaattttcttcgggcgcgtcataagcggattgtttgggggcaaatgaaaacaaattttgtgttattcgaatgcgctagccgagctctacattttcaaatgtatcaacaaagggtctatctccactctctggcgagttatggccagccaaagcagagtgggggataaacacgaattttttaatcttggtatttcctctattttgagcctgctctacatttatgtattgagccaatatgcctattgcaactgaaatttattcatctttcccgacaaaattgttgagataattattctagacaatttttttatatctcagtgcttaaccattgccttttgtaatgataaatggtagatattgggagtgaaaaaaagtttgtttgtgactatttacaataaaaatttatgcagcatttctaaaaaggatgtaaaaataatttcttgcgtaatattttttacattatgttgttgaagaatttgagtctgcatctgatgcaattggaaaatttttcagcttttttttcccagaaaaaggatggggcaaataaaaaactaaacatctctcatcaccaatttaaattcccttacattttgggtttactttactatgctggcccataaaaaaatggagtttttccggtgccaaatttttgtgaattttctttcggcgcgtcataagcggattgtttgggggcaaatgaaaacaaattttgtgttattcgaatgcgctagccgagctctacattttcaaatgtatcaacaaagggtctatctccactctctggcgagttatggccagccaaagcagagtgggggataaacacgaattttttaatcttggtatttcctctattttgagcctgctctacatttatgtattgagccaatatgcctattgcaactgaaatttattcatctttcccgacaaattgttgagataattattctagacaatttttttatatct

SEQ ID NO: 30119 - DNA, 701 bp, Heterodera glycines
tttgctcaaaaaaaagcgaaaagagtcttaaaaagcagcaactttttctctagcgccaacatatgtatattatttaagccagagttcggatcgtaccaagtcactttccaggtacataacggtgggaaatttgttaagatgagttttttggggagaatgggtgttgttgtcattgacgccaccgggagaaaaattggaaattttgggccatttttttaaaacaaatttttataaaaattatttttaggtcaattctaacaaaaatcaatgtttacttttgacagaatgccaaaaatttgaaaatttttcataaaatggacatttcatacattcaaatgaaaaaataccgatttccaagtacaatcttggaaaaagtacagttaaaattttccaagcatgaagccgaaacccaagtacgtacttggtatccaagtacgaatccgaaccctgatttaaatcattttttattttaaaaatcacctagtaaaatataaaatgggtccattcgatgcagcgccaatgttcaaaagaattaaagtgattacttggccaaaccaagcagtgatcggagataaaattaagtgcttgatcagatcaacaaaaatcatgcagattaaatagccgcccacattcactgtgattattgaacaaagtgctcgaaaaacgcgctgattgatcgaatcggctgagggtaaacctaa

SEQ ID NO: 30120 - DNA, 1272 bp, Heterodera glycines
ttaaatttttatttatttatatttttttcccttaaattggtattcattttttctcttttttctttctaattaaattcatttccgccgataattttttttagccaaaataaattgtccgaacactttgccaaaaatacaagactaataattaaatttaatttttataagtattctgtgcgtgctgttattaataaagaccttatttgcatgtggtttttataattttttatttttcttgaaaaaaaaaatttttaatcggaaaaagaaagttccggcgattcattaatccagcagccaaataaaaagcaataaatgcccataactaaaatcaaccgtacccaattgggactcacttttcaatttaatattaaaaattaattatttttaactgaatgctaaactgatttacgagcatatataaatgtatgcggactctcaaatgacattgttttatattggtaaattttacaaatttagtcggattaatagtaaattgcttgccactttgttggtaaaaataataaattatatttaattcactcagattctctcgcttataattaaacaatgaaaaaaagtttttgaaataaatccgatttccacaaccgatggattgcactgatccatcttcttcgatcggtatcaaagggtatcaatgccttgatcgtaattatgggctgttttggcattgaaccggtctagtctaaaaaaaaaattagtttttgatacccaaattggagtgggggaggggggacgataattgtccgttgaaattcacaaaaaaagagactttaagaaaacccaaaatacaaaagttaattaaatctggttgaaaatggcttaagtgatgaaaatagttaccaaatttaaaaaaaaacgtttaaaatataaaaccttttctttgaggaaaaattaacaaaaaaaaattcactatttcagatgattttattccttttaatgaaatatgaaaagaattatttttcaaacagaaaatttaaatgaacttttcttttttttgtcctttttcaaaagaaaattataaaccgtgaaaaatagtttaaaaaaagctaaaaaggtcgggccttcgttataaagccaaaataatcaaatcttttcctcccctttcagcttccccctgcttttttcgtcttatccttaaattttttggtttctgactttgtaattcttctacaaaagctgaacatattcgctttgatcagcatccgtttgcacattgtcgcgttggctgtgaacagagcacatgccaatgtt

SEQ ID NO: 30121 - DNA, 1375 bp, Heterodera glycines
  misc_feature (1186)..(1186): n is a, c, g, or t
  misc_feature (1250)..(1251): n is a, c, g, or t
gaagcgccaagacaaccgagctgatgaggagatcctccaggtagacagtgctgatcgggagaagcgccaagacaaccgagctgatcgggagaagcgccaagacaaccgagctgatcgggagaagcgccaagacaaccgggctgatcgggagaagcgccaagacaaccgagctgatcgcgagaagcgccaagacaaccgggctgatcgcgagaagcgccaagacaaccgagcaataatgtattaagccattacggatgacattagattttccgacaagaaacgtctcgtatgaaaatgtttcaataatacaccgaaccttattatgtaaaataatcaaataaaattttaaaaaacataggcaaattcttcatcaaatgaattaaacggatgtctgtatcttagattcaattaaatttttgaaattggtccaccacatttatcggcaccgctggtccaagttcaactggtgaacaatatggtgccaaattattttctttaagaaagataataaatttaatgaactaaaattgcgtattttattatttttgtggataaatgcaatttgtcaaaagtaatgaatagggctcggatttttaagcgcgaaaaagataaggccttaaataagggcgaaaaagctctaaatttaggggtataatttttttgaatttgctgttttttatatgaaaataatttcaaattaaggcaaacaattttattcattgattacagttgaaaataattaccgtattttctctaattatcccccaatctacattaatcccccaatctccaattatccccctttacttcaccctgattccgacccatttttgtaaaaaaaaattatccactttaaaactatgtacaccagggctggccatgattgaatttccaatcacggatatccgtgatccgtgatcacggcacggcaccccaaaaactccgtgattcccgtgatccgtgatcacggccagccctgatgtacacccacccccgtttggtccgaattccaaaatgagttttattttaaaaacttactttaaaactatgataaaatataaaataaaataccccttgtaatgcaaaaaattgcagctttttcttgtgttttaatttgtgaaaactccctttcagaacggagttctgattttttttgaaaatcgaaagttcccagaatatggaaaanttttcatctttatttataaaaacccaataaatacaaaacttctcatggtttttattatttcttnnagcgtattccagcctgaagtgtattatgaatttccaaaaattagtttaaaattcccgtgctcaaaaaaatgaaaatttaaaaaaattcagatttaggcaaaaaatagttttttcaaaaattttt

SEQ ID NO: 30122 - DNA, 1159 bp, Heterodera glycines
gatggtgcgccgcaagaacttgccgatcgagtacaacgtctgatggaaggatgcttcgtcacctcaacatggacatgataggatcccacccacccaccgtcccaaaattgtcattttgtcccccatcatgtaaattgttgtatctgtatgtaaatttctgtgatcatcacttcaaatgaatgtatatttaattgttgcctatgtaattgtattgttgttgtgcttaataaatgttcatatgtgcttcaattcaaatgcttttgtaggaaggggggcggggtggtaaaatttggcgtctgtttggtcggagggttagctcgcgtagaactcggtctgctcactccttgtaaattcaggtcaaaatgagttttagacaaaagtggtccttcctataagtctaccagtcacacatttcgtttggaattcgaatgttagccgcccaaatttggagataaactgaaattcagagtgtgcccttccttctgtttcaattcctgagataggtaacactggtacaaaaatgacgaaattcacaaataaggacagaactcgttcaaaaaatcacaaataacaagccggacaatcaaatctttcctttgaaaaagtcattgcttgccttttattggaaaaattggccttttttggtctgttaacaaatcagttttccgccggaccccctcccctcgcccgttcaccagaagttttatggaaaaactgcacccgcaaaaaattgttaaaaatcttattgtttgatcccgatgcactgaaatttacgatttgcttatttcctccccaaaaatcgttaaattcgacaatcggaggcgaaaaaaataatacattattgatcgaataattttaaaaataactaatttggaggcagtttcgcaaaacaaaatctgttctgattttgaaaaattgtcgatccgagccctgggtttaacgactttttaaaattttcatttttttcgaaaatggggggaacaaggtaaaacaattcagggggatgacaaaaaggataagtaccgtatgtccaacggtttctgtgatgacccgctaataggggacgaatgtttaaacgccaaaaaactttatgccatccaaatgtctacgtcaaacagagagagggagggagggagaggaccaaatttcagttaataaa

SEQ ID NO: 30123 - DNA, 947 bp, Heterodera glycines
atggaaaataatttcagaattataagagaacaattctgtttaattccgttattggggcaagtgggttgaggaaaaaattaaaatgagtcgaattgatgggtgcataatcttcacttgaatgtcttaaagataattttattatcagccaaggcttttttgtcgtcgtggaaatattgattttaattcaattagagggctcttccgaaaatgagtatttcttcatcgcgatcgaaggcaatcagttgcgaatgggaaataatttcagaatttgaagagaacaattctgtttaattccgttattggggcaagtgggatcgaaggcaatcagttgcgaatggaaaataatttcagaatttgaagagaacaattctgtttaattccgttattggggcaagtgggttgaggaaaaaattaaaatgagtcgaattgatgggtgcataatcttcacttgaatgtcttaaagataattttattatcagccaaggcttttttgtcgtcgtggaaatattgattttaattcaattagagggctcttccgaaaatgagtatttcttcatcgcgatcgaaggcaatcagttgcgaatggaaaataatttcagaatttgaagagaacaattctgtttaattccgttattggggcaagtgggttgaggaaaaaattaaaatgagtcgaattgatgggtgcataatcttcacttgaatgtcttaaagataattttattatcagccaaggcttttttgtcgtcgtggaaatattgattttaattcaattagagggctcttccgaaaatgagtatttcttcatcgcgatcgaaggcaatcagttgcgaatgggaaataatttcagaatttgaagagaacaattctgtttaattccgttattggggcaagtgggatcgaaggcaatcagttgcgaatggaaaataatttcagaaattgaagagaac

SEQ ID NO: 30124 - DNA, 1081 bp, Heterodera glycines
caagagttgcggaaatgtgaaattaattctcagaaaaatggctatctcttttaggacaattttctatctcgtaaccccgatgctaatccgttccacagagactcttcaaaatttttccattaccgcaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaatttctatctcgtaaccccgatgctaatccgttccggagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccctaagagctgcggaaattgtgaattaattctcagaaaaatggctatctctttttaggacaattttctatctcgtaaccccgatgctaatccgttccgcagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccttaccctaagagctgcggaaattttgaattaattctcagaaaaatgggctatctctttttaggacaattttctat

SEQ ID NO: 30125 - DNA, 1338 bp, Heterodera glycines
ggaggagtctaataacaataagcgccttttcggagacgtgcaagtgtcgaggccagcgtgtagggtcttttgaagtccccaaattcaaaatggttgataaatgccaccctctctgacgctttaaggaggccgtcaatggcgaagaatgcacacaatcgacacccatcggcggaagattgacaaaacagcggcgtcgagacgagctcgcaatcgtttatctccgactcggaccggtgcaattatcagcctgaacaaaaacgacgagtcgctgtcctggtcgaacaccaacagcgaagtggggcagggcccaaatggggagaggtcaacgacaaggaggcgccagagtttggcattatagtggaccagcaacaagataaggtaatacgggtggtgggatagagttgtgactttttgcgattgttgttaattaatttcatgtcgcaggatgacatcagcacatgtgactccaatcgaaaatccctccccaccgttcaacatcccaaggcacacaaaaagtaaaaattgctgaggtttagtcccagttattcgaatgccgcagaattgagtcccagtgattggggtgcagaagaatcggtaagattgagttccgatgattgtaatgctaatgaattaagtcccagtgatttgaatgctggtgggttgagtcccagtaattggaatgccgagggttgtttgagaaattacgagcaacaaaaagatcagtagaatgttaaaaatgctgtgccataagaaggtgccaagagaagggtgcgaggccgcaaagcggccgagtcgagccataatagttggttttggggacaggtaaattggacaccaagcggaaaactggacaccgtcggaattttggacaccaaaggaaaattggacactggaaaactggacaccaaattcctcttttaaaaaataaacacaggaattagcttgaaaaataattggtgtggataaatggattaaggcatttagagtcgatcaaacattaaataggcacgattattgatcaaatgtggcaaaaagtgtacgaaattaggcgatgattggttaagatgtcaaaaaatgtagaaaattggcgatggttgttcaatgtgccaaaaatacgcaaaaaatgggaacccgatcaaaatgaaaacttttttcgttatgaatgtataatggcgttctgctgctgatgctaaaaataataataacattatatatttcaattaaaatttttgtttatttatttttaacttatttattttatgtacaattgtgtccaattttccggtgtccggtgtctaattttccattggtgtccagtattctagtgtccaattttcc

SEQ ID NO: 30126 - DNA, 949 bp, Heterodera glycines
gacagagtagcgaaaaaatgggcagaagaaagcagagcaacagcagcatgagaagccaaacgatcagacaaaacgccgaacaatttgggtgcaactgaacagtcggagggacgacgaagtgatcggacgcaaaggaatgatcggaacaggccgatcaacgccagaagtccctcccccccccccccacttttcttacgtttgtaaaagcaccgtcccttcgcatcgatggccttgcccctccggtgaagtgtcttttgtgcccggaagacattggcaccgaaagcgcagtccttccggcaaacattgtgcctttttgtcgcaattgttcaaatcgctctgttggcatgctccgtcggtcagttctgtgaatcgactcaaaattgccaaatgaaataaaatgccaccgaccggacactttcactttcatttctggcaaattgccgtgcgttttcgtcgcctcttccaatttgtccgtcgcgcattcgtccgcacaaacggaattcaccacaatttgtccatcgttcaaaaagttacgcacgcaaaaggactgatcagggagtgaatcgatcagctaaacaaaatgaaatgatcagaaagtggaggaaggcacctttagaatgatcaattgttcttgaagggacggctgagaagagagggaaaagtcggcaaaactatggccacaaagggaaccgattttggcactgaaagaaaacattggcaaaaagaaaaaatggagaaaaaacctaaaggtggacacagtcgagaagacgcaggaacctgacaaggaataaagaataaaccaaatcgaaagtgaaaagcaatgaattggctaaaagaatggcaaaccgtcggatgttcggaattggccgggaggacacgcgcaacggacagagacattcttctgaatggattgatggagttcaaaaaccacgcgcccttcataaaaatg

SEQ ID NO: 30127 - DNA, 1431 bp, Heterodera glycines
ccacacaaccacattgcaccactcacacaggcgccgctcctcacacattgaaaggtggggccgcccgcgacggcggtccgcaaacgctggcgcgacagcggcgccaacagcagcagctaaagaaacagcgtcgtcaccgtctccacccgttgctttctcaccacagtgaggcacagcagcaacggcggcgacgcccggaggcggtgccggcgcaacatccacgcgccggcggtgcgcctcaaagcagtccgcgttcgggaacacgaagcggcactgttggcagaacgtgccactgctgccgtcgccgccctggcgccggcatgggaagcgcagctcatcgtagcgcatgcacaggccacacacagcgcggcagcccagcggatgcgtgcgccggtcaaccggatgctcgcactcaacacagaactgcttggcctgcgcaaaaaaagcacgattaaatgatcaaaaagaaaaaaatgcatacgccatacagacttttttttgcttgttgtttttaattttccttaattttcaaatcgggatgattttgttcatttgattttccatttctctctttctttcattcatatataatcaatttttgcttttttcatggatttttaaatcagtttgcccttattttgattttaatttattttttttacttttttgtctttatttccttttgatgaaatgaattttgggtaaactatttgtattcttaacggttgcttgatttttctttattatttgtattttttcttagatttgtttgacttttcttaattacttttatttcacttttgcacatttttcttttcattttttcattttgtgtttttcttttctttgctttaaagaaatttgcgtagactttcctgtatttttagtgtgtgtgtgtgtgtgtgtgtgtgtttttttccttgacatttgcttggcttttctttattaattgcattttttttttcttgaggtttgtttgacttttctttattattcttttctttcactttggcacatttttccttttcttaagttttcaacgtggtgttttttctttctttgctttgctttgctttaaatgaataaaaattttaactacaaatgaataaaacattatcggtgaggtgagtatcattctcgagtgtatcttatctggcgcaagctctatccacttaaacgatttataagtttttggggtcgctgatcatgaatccagcatccatttcgaacttgtaatttgttgcaaattcctcgtagtaagttttggagctcatccattgattttgcaattctttagataccagcaattttggtgaaaaatgaattccgactttttggttcggggtttagaatggggcgaaatggatgtcaactttagtcaacgaccccgaaaaacatgtaaatttatttagaaataaaaaaaatttgggg

SEQ ID NO: 30128 - DNA, 1017 bp, Heterodera glycines
  misc_feature (968)..(968): n is a, c, g, or t
tcaatccttaagaaatttatgtaaatgaaaaataaacaaaattcaggagaaaagtcgaaaaaataataaacaaaatatcattagtcataaaataatttttaattgtttgaaaagggaaaaagaaaaaaataacaaaaattttggaacgcacggttctcacgaagttattgccggtgccagaaacatttagttcttttgttaaaaacataaaatgtacaagtatgtgattttatgttaacataattgtgcatataattaaatatgtttaaaaataatagaaaataaatttcattatttatattaaggtgactatgacgataaaaaacaataaaaatgataaaagagaataataagagaaaaataataatagcgaaaaaaatatttagaaaatttaaaagacttgattccagaaaatttcgtcaagttttaacaaagttatggacaaaagtactcaaggaagcattttttcaaacatttatggtcataaattttttgatacttagccaaattttggaattttacaggctattagataatacttaggactatcaaatgataacgagatttcttttttgagcatcaaaattctgatcaaaactttttgaaccaaaaaaaatcttgatatcaacttagcactgatagatggcataaattaatgaattaagtgcattttcatttttgcaaaactaggattccctgtcggatacaataaagtggaataagaataatatgtatactggctggtcttttaaatatatcagttacaaaaatttgcgaaataatatagtgtataaaaacaaagctaaatttaaagcataatttgaaaattaaaaaaatccataattatttataaatatatcaggcaaatatgaaaataacaaaataaaatagatagtaaacttaaagcgaagaagtaaaactttttatgaagaattgaaatattataaaagtaaaaattaattacgagnatataatgtaaacatcccatgaattacaaaaaaaacagctaaataaatg

SEQ ID NO: 30129 - DNA, 969 bp, Heterodera glycines
aaaaagttcttacaaaaaattcaaatttttttgattttcaagggtatatattttttaattctcaaaaaggtcaatccttggggggtttattttttatttttgttgcatttttcttatgaaaatttgccaaaaatgaccgaaatatgctctaaaaacgcaaaaatggcaaaatatgcatttattctcgaaaacccccaaaatatgcgtttatatgcactaaaaagcttccgtagaaatgctattttgagcttctttttttcatagcatatgcgtagaaagaatatgcaaaattgtacaatttaaccctagttattatgtattaaaaaagcatgggcactactgtatttgccatctgtacagctaacaaggaaccggtattctattgtacatatcagaattattatgttttattatggtcagctacagtatccgtcaatatgagtacagtttttgtttccaaataaactcactctttccattctcttccaacgattcgtgcatgaaaatgaacataaaattgttgttgctttgatttcgggcgccatgttcaggctgcacggacagtcggacagaatcgccatagttgaacagtgtcgacaattttattgtgaaatcatccggtattgttttattgtctaccgtggttttggctttgaccagaaaaatctgtaaacaaaaaaaaaagagaaaaaatagctaaacataaaaatgaaaagtttttacaaattttctcatttaatagacaattaattattaggggctgccaaaaatatgtacaaaaagtggtccaaatatgtaaataaatatgtaagaaaaatccaaaaatatgtacaaaaaaccccaaatatgtaaataaaatttttttaatggtattttttgggaaagaaattccccctaaaatatgaaaaaaaaaaaaaaaaaggaaaatatgtacaaaaaaattttgcccaaaatttttaattttttttt

SEQ ID NO: 30130 - DNA, 951 bp, Heterodera glycines
tttgacgatatcgggcagcggctgcattgttctgatcaatgatcataaaattgcatgaaccatttaaatctctgtcacatggttttctttatgccatttcgaatttagcgaaacattcaaaacgctttagcccggtaatttcaattcccaaggattaaaaaaaaccgcaaatctcgcgaagaatcccgtcccgggcccgactccatccaaaaataaaagaattttatgcttgttcagaattattttcaatttttaattaaattgaacaaaaactatgtaatatctggcattcaactttcgtttcgaacacaattcaaaatattctctgatcattccccttatcactcactcactgatcatttctccgactatcattttgatctgatcactatggtttttacctgttcccgcttccgctcaagtatctgttccgcattttccccatggctcatcacactatcgcattccgtcagcttcaaactcttcgatcgatgcttttgtttcgtggaaatcatcgcctccgccaggctaatttgactattgttcttcatcttaaaaatatgtccaaaatttgtaataaattgtttaaatctttaatcgctcgtttggcaattcacctctttaagaacatgcgcaacaacaactttgatcagtctttccaaatctaaagaaaaactggtgcctttgccggcgatcagctgctgctgatcattgcatgaaaatgtttttgtgcccagctccgatttctcagttcgcattaactgaaggattttaagtgtgatattcaaatagtttttaaagcatatcgtccaaaaatttcatagaaaatctggcacataaatttggagtaatttctaacaaagcctgccaagatttaacccccaggcgatgcctctcgacttccatcgggccattaatttcctttttttcattcaaaattgactctttttg

SEQ ID NO: 30131 - DNA, 1022 bp, Heterodera glycines
aaacccacttgaaaaaacgttgcactgcaattgctaagcaaagtgcagaagactgacactgtgccctgttggatcactttttcatccattgaaccttcagattgaaggtcgtcattggtgagtgcaaggcgatcattaagcgtcgcactgcccaacgctttgatcattccgaagaccctttgacggaatgaaattgcatgcgaaatattgataaataatttaaaatttaacatgttatcttgcaaaatattgataaaatgtataaaaataattattaaatagttacttttccatcaattggtcaataaaagtgccaaaatgggctgtgtcgcggcacagctcttgttcttcagccgacaaatcattgcgcgtcgctgcctgagtgcagtcctcgaccacaaccagatgaagcaaattgacacaaatctgcttgtgagaggaatattgaaaatttgcaaaaataccgttacttgaaacaccaacgaagacttcacaatgtcgttgacatcaatgcccggcagaatgttgttcagaatgatgatggcatgtcgtcgatacgatttgaggtgcgcgttcgcgtacccaactgttttcattggaactcgccgttcagcattgcagtggtcgtctcgcaccagcggaacacttttgagggaaatttaaactcataagaaataaatctcaaaaagaatcaaccaataccctcttttttggcccagggatgatcccagggttctccttggatgggaggagccccgacttttgcggccccgacatttgtgcctacgtccaaaatctgactcaaagttgaattttttcaaaccctgacagcctaattagccttaaaattaagaaaacattgtcttttggttcattatgttcaataatttgttgtttgaaaattttattattttttcaaaaaatttttgaagatcaaatgatcggatacacaatcactttcaatcgcttatttaaagttttttatgcgatcagggattgaaaaaacttaattttgaacccga

SEQ ID NO: 30132 - DNA, 1036 bp, Heterodera glycines
gactcaattccaccgaggccattgcgacaagtcatcatccgaggcggacttttctttttcgttgtagggtttttttaaattttataatgttttattttgctaatttcaatggcaaaattcatagggttgggctgctaaaattccactatttttttaaggacaaataacatacaaatacaattccattagctaaaatacaatcccattagctatcgttaattaacattttttaattgccacatccttttgtttaggccagcaatgtcttctcaatgattgctgccgttaatgactttgagatgacacagaagcgattccaatcggtgattgaccaggccatttacgaattccgtcgcactttttccttcactccgccgtataagcggaaaacggaagccgccaaattgatttggacaattatcggtgccaatgtggccatcttcctactctggcgagtgccaactctggtaccattgttgtggcagtatttctccagtggtgtcgcttcgagtgaggcttttttggggggaggggtgggcacagtttggtggtgccgatattcctatttttgaactacaaatttcaatgatcgagtgtttattccacttttcagaaagtctttgcatgccaatgcttttcagtgtgttctcccaccaaaatctcatgcatttgttcttcaacatgtacgtgttgaatagctttgctatcggtgcaattacccttttgggtccgtctcaggttttttttttggtttttatgaaatcattattaatggttgtgtccgaacccaaattaattcgacccagtcgttaaaattaaattcaaaacgcatatactcaaatggaattttttttggccatctaataatgtgtgtccctttcagttcttggcaatgtatttgagtggcggtctgttcagttcgtgggtgtctctgtgccaaaaggccgttatgcgcagcacaatgccatcgctgggcgccagcggcgcaatttgtgacgtggttggatacatttgcgcgaaattgccagacacgcgg

SEQ ID NO: 30133 - DNA, 894 bp, Heterodera glycines
ggcgcccggtaaatgcgtcagtgaaaaatgcgtcagtaaaactttaaaaaaaaaagaaatcctaagggaaaaccgtactctaatatgattgaggcggattaaaaaaccattaggaatattaaataaaacactaaaaatttcgccatattaaattgcgtttggcattctgtaagcaatagagcgaagatattccaatggctgtcgctgtgcacggctattaaaaatcgcaagtaatgccgcatcctgttcaacataaacactttttcgacccattcctttgcccctaattccattgtttggggcattgttaaaatcctccacaacatgttgccagtgcaggtcttcttgagacatcactttgacgaatgtactaagaggagggtgtgacgctcgaaacaaagcattgaaagagcgatgccacccctcagttgaattattagtcctgcagctttggttctcaatttgcataacacgcgaacaaccaacccaacttctcacaaaatatttgacgatttctttattaattatttttttaaatattaattttagggaactttttttaccgtaccttcgacttcctcttcttgaggtaactgtctaataagaacacacagataattatatagtggttcgcctgggggagtgaaagcgagactgatcagtgatttaatcagggtttttgtatcatccggatcatgcgggtttaaaaaccgctcgttgagtcccggcaaattttgaacctagatttttatgaaatttagcaaaaaaaaacaatgggctcggcgcaaccttttaattacttttaaatattatgataattaatttttttattactttaaaagtgccatccattgctatatgagatccgtagtttgtgatcaaattttggccaaa

SEQ ID NO: 30134 - DNA, 1422 bp, Heterodera glycines
agtaagtggatcactcactcccttttgtggactttttcttttttgtataaataaatcatggaggtcaccatttcgcccgtcataattcataccctttctcatgggtcctcccttttcgcaatttttataatattttcattaggcatttctccgtgccaccactacttcttttgccttctatattatcgattttttattgtttgcgtcaacaaaattaaaatcattttcaaaaaagaaattaaattaggcagaaattcatagctttttttattgagttttgcttaaagaattataggatattttcttggaaaaattgtgttgttttgcatgcctatgtcgacgttagcttgcttaggctcggattaggcataagcctaggaaaatggtagccaacaattgcttaattaatcgaatcaggatcactttttggcaattgtctaaaatccgaaaatttgtttgtttcataaatctcgattggatttataaaatgcattcgaacatatagaatttttcaatattcagttacctaattatatgacacttttgtctctgttctattcaaaatttgtgcttacctaatttcatttaaaatgcctttaaaattaaaaatttttcttaaatatttgcaggcgaaaattaattaattttaaatgggacgacaattgtccaccgccgtcatttcttctgccattagtgaaaatcagcagcagcagcagcagcaaccgttgtgttcatttgtgaaaacatcttttggaaggcgacggcattggtaaaaatctgtcactaaataataaaaatgcatgggtctgttaaatgttttaacagttttttatcggaattttttttttttacctttttgcatgtaaattttaaaaattttgtgcctaaatgtccgggatctatctattagattacaaatttttcatttaaaaattaagttttatattcgaaatttcattgcctttttaagttatcacatttttggtgtgattatgaaaataaatcaattagtaaacccattttgtgccttttttatatgttaattgcaaaattttttatttccaaggttatttttttcacaatttcagttggatttgcagcgatgttttgatggacattttcccctttttcgaccatgctcaacttggtctaaaattggcactgatttcgccacgtttcgatgttttagtggacacgcatttcaatggcaaaaacgaattgaaaatttggagaccaatcgcgattcacaatatggggacaacaacaaaaatagagaagcttggcatctttaccaaatttgtgcagttttcaattccgcagcgtccgctgcacaataaaatccgctttgaacttcttgaaattgagtaagttcaaaattttattgaccaatttcggtatactgtggtttgccccccccccccc

SEQ ID NO: 30135 - DNA, 1249 bp, Heterodera glycines
cggagggcgacgcgttggatcagttggggctgcgccgctactgctgccgtcggatgctgctgtctcacgttgacctgatcgaaaagctgctcaattatcatccgctggagaagtgatcggagagacagacagtgacaaaagcgacccattgaaaaaacaatcatttttattttattttgttttactgtttttttttttgcttaatatttaaatgaatgaattccaaaaatgtagattttttttctcttcagaaattcctgtggaaaattttaagaattcagtattggtgtcatggcaactcgtacaaaaaaatgtctaagaatttttaactaaaacttagaatttttagataaaaaaaaatctaagtggattttttggcttagaaaaacttttttaaaaattctttaaagttttttactaatttttcagttgatttttttaatttcttaaattttttgaaaatttaagtgttttaaaaagtttttctaggctaaaaaatccatttagattttcttttatctaaaaattctaagttttagttgaaaattcgtagaaattttttttgtacgagttgccattgaccattttttcttttttctcgaatgccccactttccccacaggcgttcgttggctcaaaaattttgagtccccatggatttcgctgtgtttggccaacaaaagccagctgcacaacgccaatcggcatgatttgattgacggtacgccacaattacaccaccacaaattggtgattcgccgtgtcacttgggacccgtgcgtggaggagccgttgttggacgacatgggcgcgctcaaagtgctctatttgcaggtgccatggcaaatagggtggtggcatattttgaaaaatcagagttcgacacgacacttataccccgaccgagtttttgaagttggtaaactgatttcctccggaccaggccctttaaccataaaaaaatcggatttttttttttttgctcattgaaccctaaaattttgtttattttttccggcctaattttttttaatccaaaattttaggtgccatgggtgaaaattttcgataaagcgaccagttttttgcagtttaatatagtcgaaaaaaatgcgtgggtcataaaccccaataatcgcaatgcacaggttttttaggctgtcagcgacattcaacgcgccattttcaacgtgtcacaacaattgcgggagaagctgcgctcgttgcaggaatacggcgacttcaagca

SEQ ID NO: 30136 - DNA, 1964 bp, Heterodera glycines
tttcattttttctagtctaatctactcaaaacggttctgatttcaataaaaataacattcacggtgcgaaaaatggggttttaaaagtttattggggaaaaaaagactttacaaaataatacccctgggagaagggagtgggaaacatgatttcattattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaaaggggtttgaaaagtttattttgaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaatttttgttgaaatatttgtcgtgctctgaagggcgtgggaggggggggtgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattccttaaatattttttcagaaagggttctgaaacgcaccaaattttatttacatgttagtttaggcactctgatgctttttctatcaaaaagggagatgaataaaattaataaaaatttttaattcctttttaaacaggccaaaaagtttaggcttaacttttttttcagaagctgatcagaagcgcaccaatctctgcagggacactgaaaggaagagaaatagcgtattttaaatattatatagtcagttcatttaaataatttctctccaaaaaatttttttttgtgttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccaaaagtgtttgcgtaccccaaacggacacttgaaaaaaccggggaagttgttttcggggcagtccccccgaaccgatgcgc

SEQ ID NO: 30137 - DNA, 1038 bp, Heterodera glycines
cgaaaaattccattaaaaatgcaattaaatcgaaaaaatacacacctaagaaatggcttaaaaaatgtcagaaaatacacacctaagaattgaaaaattttctcaaaaattgatcaaaaaaatttcatttttttcttgacaaaaaattttaggtttaaaaatttttcttaatcgaaaaacattataaaatatttgaatacaaaattaagttttttgattaagttttacgtgttttgctccttaaaaatccttacacaaaaatttttaaatgccttttttcatgaacgcagttttatatttgacaatgattttaagttatttagaaattttttcgaaaattaaaaattccatttatccccccggggtgataaatggagacggggggataatttttcaaactcctcacaaagggggggggggaggggataattaattggagacaatgggattaatggagacgggggataaaaagagtaaatacggtaatgatgcaataaaaattattttatgttctatgtcagaatttcaaataatggacttttaatttcattggaaaatttttacattttaatttttccattgatggttttttttagaaaatttcagctaatataaatttattgtttaaaattcaatgggaaaataacacatacaaaaaatggagaatttttttcttatattcagagaattttgaaattttttaatcctattagtagggatgtcaaaaatatgtacaaaaagtggtcaaaatatgtacataaaaatgtaaaaaaaatcccgaaatatgtaagaaatatgtataaaaatctaaaatatgtacgaaaatatgtaaataaaaattttttgattattttttcgaaaaaaatcttggtaaagggttaaataggcacaaaatgtcataaaaatgacctaaataggtttagaataacattttaacattaaaaaaatttttttgctatttttaggggtacattttcaaaaaaaagaatttttattttttcacaagaaatttctaaaaaaatttcaaaaattctcaaa

SEQ ID NO: 30138 - DNA, 880 bp, Heterodera glycines
tttatgtgcattaacaaatgagaaaaaatgaaagaatggaataagaaaatagcgcaaatgttgtttttaccttatcaaatgataaatcaaaacatgatattttgttttcatctcttggttaattggtgatctgaatgtcggcttccaatgtcaatgtgtcctcctcgttgtccaactcattagccacttgtaccaattccttaattagtttgctaattaattgctcgtgtgtttttcacaccataaacattaagccacggaatattttctttctgtcggaagaagtgtgaaagatgttgtgcatttcttgtaaagtgtaatctttttttgacttattttgtgccacaattcgcaattttgccgtacattcgtagcgccacttcgcttaattattgtttgatagattagggtaaaatggcacagtgtttcttggaaaagggataacaaaattatcatagaaaagcgctttacttggtcaggatcaggaaatatttatggcggagagaataacgccaaaattaccagaattttctagtattaattagagttgagcgcgacagggaaatttgacaaaaaccgggaccgggacttgccgggaccagaaaagtcgggatcgggaccgggaccaagttttttgtccgggaccgggaccgcgagaaaagccgggaccaactgggaattttcccaagagaaaaattttttgaaaaaattttaaaatttgagtgcacttggttacaaaaatttcctaaattcaaaaatgtgcccagaagattttttaattttcttttgggggaggaattcgaagaatttttctattattctctggaaagtttttaaaaattttcatttcgggggcgggggtcttggaattttctgagtc

SEQ ID NO: 30139 - DNA, 1365 bp, Heterodera glycines
atttatacatttttaatttaatttaaattcatattcttatatactattcaattggtaaataaatttccagagtctcatctggaaaaattttgctacataatctaaattcctcctcagaatttgggtgcatgttaatcatgagataactaaattgattattggtcgcatcatgatatgcatccatgaaataattcagtctttttgggaacagttgtgaccccaatgttctcacttgtaattggccggaagggttgcgcattaaaaccagataatgtgcgttggctcttgccgttttaatgtcccgaccatagagactttgggttacaaaaattacgcttacgttccaattatgggagcccctggtaaagagtagatcgaggaaagtattctgcatattaagcattaaatcatcaagtattaacaaaaggggtttttcctgttctttaatcttattcatgtccggaatcccgttaaaagtctcaacgccctccccgattaatcctaaaatactatcattcatctcaccataacaataaagaattttcttaggcgatggttcaattagattcttatgatgttttaaaaaccgtaatagccaacgggtcttaccactcccagtagcccccgagagaattagagtgaacggaccgcgaaacatttttaatgcatcttatttatttgacctatttatattttcatagggaacatgtttcgcgcatttggggcatagccagaaattatcaaaaaatgatgtaccgaaatgcaaaagactgtgctttttacatctgttacaaatctcgtaatgacagggacagtaatgacaacacttaattttatgtggacagttcatttttcaatttaattttatttttggttgctatttatagaaggggtatataaagggagtggaaggaccatttgattggtaaattgtatcaaaaatgcaaaaaccgataatcgtaaatataattgctctcgctaatctcggtaccggaattaaactaaactctctgacgatcaccgagtgtgaatttaagtataaccctagaaaattcaatgccgcggttatcaaatgtgcaagccccatcaaagccacggcattattatgggaatccgggaaaatgatatgtctggggacgaaaagtctgatagactgtgaaaatgctattaaaaattttatagaaataattaagggctcggggtgtccgggggcttcttacaccggacacacggttgaaaatattgtttcgacctttaaattcggacgtgaaattgaactgaacgagtttcgaaaaaatcgtcgtgcattttatgaaccggaaatatgttgcggtttaaatttcaagacggggtaaaagcatgaca

SEQ ID NO: 30140 - DNA, 1415 bp, Heterodera glycines
  misc_feature (1273)..(1273): n is a, c, g, or t
ggctcgtcgtcgaccccgtgggctaaggagggcggcataaggcgccggaggggcgccattaaacatgccaaagtgcacggtgtgcgcactttcccaccgttttttgaattgcctttcgcttagaaatccgaggccatcaatttgtggccacttttttccggcagcccactttctgctctttgtgcagcgaatttatgtggtgagaagcacaaaagggcggggaaggatctgttcgtttccctcccttttgaggggactgaataagcagggatatcggtgccgactctgcactttgggtacattttgagtctttaaagtccaacgaacaatccgattcattttcagcggttcacaaaaaatgtcacgaaaaaacgctaagtcagtgcccgggatcagccaaaaacagcaaagaaaccatcgtaagacggagcaaatggagcagacaaatggccaaattccccttttaagtacctcaaagaacggttcaaaatcgatgtgccgcacagattcaaacaggcaaaaagaagaaaagaaaagaaaaagcaaaataaaaaagaaaaaagaaaacaaacaaatggtaaatgaatgatttatttagtacaatttcaaaagtctgaccttctgcgaccattgcggctcacttttatacggactgttcaagcagggaatgaaatgcgaagtgtgcggagtgaattggtcggaaagaaaagcaaaaaaaggaaaagcaaaaacattgccaaataatttagtcacaatcgctgcgaaaggcatatgcccaacctttgcggcgttaaccaaaaacagctgtccgacgcacttttggagatcaaacgaaggcattgccatgaaaagcaaattgattattcatttgattcgcctattttcagcactccgccgggctctgtcggcggagggacggcacaacagcagcaaatgttcaacggaatgggcaacaagttcaaagtgggcgagtgcatgccgtaataaaccaacaaagtgccattgccccttaggccctcttccggccacaaacggccggcagtttggacattgtggggacggaaaaggacggcgccgaggagggcgcgggcggtgactcaccgcgacatttcaaattgcaaaacttcgccattcacaaagtgttgggcaaaggcagcttcggaaaggtgcagcgggtgaagtgaccaaaagcaaagggaccactaaatgcaaaataatctttaaaaaggaaaaagttacccaattaattgcccaattaattgccattcctttnaaaagtttgcccgttttaatccccaggttttgctggtcgaactgaagggacgtcagcagttcttcgcgatgaatgccttaaaaaggacgttattctcgaggacgacgacaccgaatgcactttcatcgagcgccgcgtgctg

SEQ ID NO: 30141 - DNA, 1122 bp, Heterodera glycines
ctgctgctgacgccgtcgctgctgtttcgtcagcgtggggcgatggccgtgggaggaaacgtgctggaagcaaaagcaaggaatttatgctgcaattcttccgaccggtacggctaatgaatgttatttttaaagaaatttgtttaaaattgcaaaaaaaaaaaaatatattcgccatcagaaatgcccaattttatgtagaggctaaattagtgtgagcggaggaattaaaaccaaatataccacatgaaatgggagcaatgcattccccgcacacaccgaaattaaaaaaaaataataattaatattgaaaattcttacaaaatttgagttttttacgcttttcaaaaaatttttcttttatgcgtttcaatgaaaatttcaaaaaatttgccatgggaggaagggtgaaatggtaccacttgtcattattattattaatagggaccagagcgtttgggcccccgtttttgggcccccgcgtttgggcccccgtttttgggccccggggtcgtttgggccccaacccaaaaatcaaaaaatgtgcttttttaaaaattaagattctaaaaactaagcctgagggatccctcgccacttggcataagctaggtttaattaacattcgctcattttttacaattttacttattccaaatcctattattttttaatagttaaccaatttgatgtacattctgatttggacatttttcagaaatggctaacccaattgcaaccaaaaaacaaaaagtaaaattgtcttacgaaggccacctttacaccttcgctaaaatgagttctgatgggatgacaaaattttggagaatttctcgcaactatcgaatgaacccgtgattttttgttttattgtccaaatcaccttatgaacccgcgaatttctgttaatttttacattttttattgttaaaattattgttgaatttatttttaaaatgttattttacatttttatgctgaaatttaaaaagttgtttttactgtgatttttcatttttctgtacttggggcccaaacgaccctggggcccaaaaacgagggcccaaaaactggggcccaaacgcgggggcccaaaaactggggcccaaacgcccccgactc

SEQ ID NO: 30142 - DNA, 1035 bp, Heterodera glycines
caaattttcacggacaaccccgtactggaaaattccaaggaagtattgggttcactgctatataatttcaagggccgactcagtccacaaggatagaaaaaagaaatagggattttggaaatatttttcaaattttcacggacaaacccgtactggaaaattccaaggaagtatagggttcactgctatataatttcaagggccgactcagtccacaaggatagaaaaaagaaatagggattttggaaatatttttcaaattttcacggacaaacccgtactggaaaattccaagaaagtattgggttcactgctatataatttcaagggccgactcagtccacaaggatagaaaaaagaaaatgggatttttggaaatatttttcaaattttcacggacaaacccgtactggaaaattccaaggaagtattgggttccctgatatataatttcaagggccgactcagtccacaaggatagaaaaaagaaatagggattttggaaatatttttcaaattttcacggacaaacccgtactggaaaattccaagaaagtgttgggttccctgatatataatttcaagggccgactcagtccacaaggatagaaaaaagaaaatgggatttttggaaatatttttcaaattttcacggacaaacccgtactggaaaattccaagaaagtattgggttcactgctatataatttcaagggccgactcagtccacaaggatagaaaaaagaaaatgggatttttggaaatatttttcaaattttcacggacaacccgtactggaaaattccaaggaagtattgggttcactgctatataatttcaagggccgactcagtccacaaggatagaaaaaagaaaatgggatttttggaaatatttttcaaattttcacggacaaacccgtactggaaaattccaaggaagtattgggttcactgctatataatttcaagggccgactcagtccaacaggatagaaaaaaaaaatagggattttggaaatatttttcaaatttt

SEQ ID NO: 30143 - DNA, 1370 bp, Heterodera glycines
accggacaattgcggacgacaattgcggaccgtacttttgcggacgacaattgcggacgacaattgcggaccgtacttttgcggacgacaattgcggaccgtacttttgcggacgacaattgcggacgacaattgcggaccgtacttttgcggacgacaattgcggaccgtacttttgcggacgacaattgcggacgacaattgcggaccgtacaattgcggacgacaattgcggacgacaattgcggaccgtacttttgcggacgactattgcggaccgtacaattgcggacgacaattgcggacgacaattgcggaccgtacttttgcggacgacaattgcggacgacaattgcggaccgtacaattgcggacgacaattgcggacgacaattgcggaccgtacttttgcggacgacaattgcggaccgtacaattgcggacgacaattgcggacgacaattgcggaccgtacttttgcggaccatacttttgccaaaaaattaactggaagggtgggcctcgtcagtacgatcccttccgtattacaaatttgaaatcctaagtgtgtttcggcccttccgtagacacaccaaataagaaagctcacagcaataaattaataaataacaaatagaaaacacaattaaggagaaaaaagcaaagcataggatgataaagctataatatgtttattttattggcttgctgaaggcccaacaacagcttctacgatatcaccaaaattattggccccaattatcgatgtgatttcccgctagtctatattgtaaagctctaagatggtctaaatactgttgatcggtcggttcttcaatctcatcgaataccattaccattcgtttaattgctgcatcattttctctatacttttttgctcttggtcgaagatttatcccccgtgtgttgtcaacttcatattctcttaatctatctgttgcaattctttcttcgctttttaagacattaatgagcctttaagaaatttttatattaaaatcttgacacatttttaccgtgatagagggggatgttctttggcaaattgtcttctcagtgccaaatgaaagagagccttgggcaatttaacaacgcaattagtactgattttcagtataaaaacactgtgtaaccaaattaattaattaattaaaaatgaaattattgtcaaaaatcctttttctgaccaatttatttgttgtgagcaattgccacccaattgctaccctttaccaagccgccaaaacactaaaaactctaaagagtgagcatattttaacaagcgcgacaatcggtgccctcggtggagcaataacggcacaattaatcgaggacttaatcgagatgct

SEQ ID NO: 30144 - DNA, 948 bp, Heterodera glycines
ctgcatttccaacagttcaacagtataaataaatattaggcaaatgaaaaattttttttccttcctctttagaaagtgtctaaaaatttttgtttttaatattcagaaaacgtgttttttttagtgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaaacatcagtggttaaactgaaagaaaaaacttccccaaaaaatcggagcttttccgacgcatcagctgcattt

SEQ ID NO: 30145 - DNA, 1501 bp, Heterodera glycines
aaagtaacgcacaagacaaaaaaaaaactttttttgatcatttttgagtaaaaaaaatccaggtttttttttcgtgttttgcctgaacctggggacctgggtttttcacatttgacctagacttggatttccggacaaaaatccaggtccaggaaaaatccaggcctggatccaggtccaggccgatctatacaagtgatgaagcaagatcccccacattcatttattcattcatttagactaattacctcactcccattactgaagttggcactaaatttgcccaaaatgcagcaatttggctgcctttccctgttccccgttggcatttcagccgggctattaataatgccaatgcttttgctgttactgatgccatcatccactgatggcattgaaattgtagtgaatgttgatgaaaatattgccaatgaaatcaatcagcagcaaatcactgtcaaggtcagggcttctaggggtacagctgcttatttgagaaagcttgctgatttttggggaaagaaaccttcagaaatggccatttttagcctgtcgacatcgccggccccaaatttccctaacattttcaaaatttgaccaataaattgccaaattatactcaaaatttccaattttttctcccggtgggcctgtcggcacccgccgggccccaaaaactttgttttttttttcttataaaattggttaaaaatggaaaaaatcgtttcatttttggtggaaatctgattagcaaaatgcattcaaattttcaaaaaaaaattttcccggccgcgccgccggcccactgtttccacagaaagttttcttggaaaaagcgcgccgccaaaaaacccttttattgatttttttttattattattataaaaatttttccaaaatgttgatttttttttgcctgccaaatgaggcttttgaaaattttcatctgggcgccctgctgttaaggtagatggctcaaccattgtgaaagagttgaaggaacagatcaaaacaaaggcaaaaattcaacccagcaaacaaatattgaaactcaaacacccaaatggcactttgactgtgcttaaagacaaaaaaacattgaaaagctatggcattgtaaaggatggcactgcaatttttttgtctaaaatttaaaatcacagtggaggcgaacacaatgataacaaagtggagcaaaatgatcaatgttgaggtgtatggaacggaaacggtggaagaattgaagaaaatgatcaaagccgagagtggaattgagcccgaagaacaaacattggtaatgtgcccgagtttttaagctatgtataactttttccattgtcaacaaaatccaacaatcttgataccattcgatagcactaagtgtcctctattaatatgtaaaattatgaaaaagttcgttaggtttgaaaaaagtgttggccaaaaatgttagaagaccagtttttttttttgaagttttctggccaataacttttttgaa

SEQ ID NO: 30146 - DNA, 1129 bp, Heterodera glycines
  misc_feature (1095)..(1095): n is a, c, g, or t
gagctgaaggctggctggcactggtgaaaagtgaacaaaaccgtcgtcttttatacaactttttttgctgcatgaatttttgcacccaaaattttgtatataagcagatggattttgcacattctcctcactaagcagcagcaacactttcacaaaaattttgatttgtcctttgaatttttgtttcaatcaccgcaaattttgcaaaatgaaaaaacacaaacaatcagaaagagggagcagctcggtgttacatatttatcatataaattcagaatacaaacttttttgtctgtaaactttgaaaacaaaaaaataatttaggactgagaccatataaaatgtaagattgtgagagagattggtgagagaacgcattcagagcgaagcaaagaaagaaagagaaatgtaaatgcaaataaaggcaaaaatgatcaacaaatactcaaaagcaaatacataaatggcaagacacaaatcaaatcggtgaccctttttccgatttgccttcattattgatattggtacgcctcttcggctgtcatcagttgaaaataggtatttatttggtgccgccaaatcgtccaccaccaaaacactcgcgttggccgcctcagccgcatcgtcgaaagtgaaagcggcgctagtctaaaagaggaaggcactgattacacgtgaaattgtttgttggaatccaaaagacaccaactttcccaaggcgttcgaagcggacggcttccccgacagtttgcagtgcctcgagaatcttcgaaatgtcaaaaccgaagtccagctgaaccaggggctgttgtggtttattccttttccctccccacgtcactcgcctgcgttattttcagcgtgtttttcacccccgcgccgccatgtccgtcccgatcctcagaaacggagtcttcgcgcgaccgcgacttctccctgtactgtgtgaaagacgagtccgtggtgcgtccgtcggatttgttcgcgccctcatcctcgtcggctgatggcgtccctttgccctcgtctctctcttcgacctcctcttttccctgctgctcttgcccaactcgtcgtcattttctttgtcaattncgtcgtcattctcctcattggcacctcccaatgc

SEQ ID NO: 30147 - DNA, 1695 bp, Heterodera glycines
tatttaaatacgaaagggtcggacgaaggcttccgccgccgcgctgcgttatttgaccgaccgcgcgacggacggtcatcgacagacgacggcagctaataaataggcaaaacaaatcgtaaattgggcgaaaggagcataacgaaagaatggactgaatgaatgacaatgagtcggtcagtgacaaaaggaaagggaatcacaagggaaatggccaaagtgagggcgaaggattcctcacaattttgaactcgaagatggcttattaattaggcggaagatgcatgttttgctgtctttccgctgtttgcccggggggggggctcagattgaacaaacactcgccacagtcatttcgtcgtcctctcctctcatttgaatatttgtgctgttccctccgctgcttctgctgtttgtctcttttcttaacttttgtcaaaacatgcgaatatttccgcgatgagaatgaattgacttctccgtgtccttttcttttcattcttttgcccttttttcactttttgttttgaatttcttttttcgggatttttacaattaatttatttaatttgttggccaaatggcggcctaattagccattgtttattaatggtcaatgatcatttgtcgttgatcaatcgcaatggtcgttccttcattcattctttggttgtgagttgcttcctctctctcactttggctgtctttttacaataattttaatttgtcgtcgtttctccgtttctttgcaaatcgcccaaatttcgtggcgtttggctccgatcatttttctttttgggtttccttgtggcgcttttggtgccctaaaatggcaaaatgaacggagaattctctcgcgcggcaaaagtcagtaaagagaaaggaaatggaccaaagagcagcagaaagtggggaccattcttatcggtaatcagatcagagaaacacttgcgcatcattattataagcagcggaattggtcgacttcatttcccatgttttcttcttttacatttttaattgcttttcttccttttcctttttccattgcttttgctcctttttaccctttcctttttctctttcctttgctcctttttctctttcctttgctcctttttctctttcctttgctcctttttctctttctgttttgtgcttttcctccttttgagcttccccctgttctgttcctccttcctcatcagacaacgtcaaattgttgttaaatttacccccccccccctccctccctctctttttgttaatgattttgtgcctcgggcaaaattcaaagcgtcaaattccttttagcattcattccatttatctgatcatatgttgctttacataatattctttcttatattcactaaatatttcataaattcatttttgaattaattcaaaaaattttcgttcgaaattttatttttatatttttaatttcctattaatttactgttgtttggtttcataaatgcacatctctaatcatttaattttgttgtttcatttggtcgcattttaaatttacccccccccccctttcctccaattcctatggccccccgctgcttttcatccgtcggcatttgttctcccaaattgctcatctttccgtccctgtcgttcgttgtttcgcattccgtccccccccctccccctgcgaaattgccgggggggggggggggg

SEQ ID NO: 30148 - DNA, 1253 bp, Heterodera glycines
taattaaagtgatttttgataggatggcattctgtgtttgcgaaatttcccatctccaaatgttgtcgtcccttaattttctactttgaaatgaaagtcaccaaattgggaaggtaaaatgacatttattaactaattaaattcacaaaattcgcataaaattattgtttttgtgcattttttgttaattttcatatatttacatttttatagttttgtctcgattggattcgccaccaaggaaatgccactggacggagcaatcggacagcatttgaacagttacgggtaccgaagcgatggctcatttggctgcaatggtatcagtcggccgtataaaatgggatttggcaccatgccaatgccattcaacgcggcgattggacaacagagggaccgccgctacgttgggagtgccaattggccatttccattggaatttgtgcccgtgccaatgccatcggacggcgcattggcattccaatcgccagcattttccaccggagatgtggtcggatgcggcgtttgtttggccactcgacagatctttttgacgaagaatggccgacgaatcggtgggccaaacacaaaacgaaaaagcaaataatttcaatttcaatttgtcagatgactcctcttttttcactacaactcccatcaattctctgtttccatgcgtttctctgtggactggcgacaaaattgaggcgaactttgggccaagtttcaaattcaatttggccactctttgaagaaagccgaagaaacaacggaaagggcgattactcatttaattaattaattaattcaataatctttttttctttattttatttttaattttttatattattttatgatgtatttgttaatcagataattttctgtttttttattcacttttattttctgtttttccttttttatgtaaagatttggttaaaaagagaccaccgaagaaaatcttgaagttgaagtaattagtaattttgaagaaattgctaaaactattaaattccccaaatttcctctttgttctttccactcattttggtgccattttattaatatttaaaatcgtttaatgggcctttttattaattttttcgcacttccagcagaggcaacaaataaaagttatttaataaagaagcatagatttttcacaaaatacaaagttataggaatatgtgatgaatgttaagcagataaattttaacaaaaataaattctttttcttacaaaataaaaat

SEQ ID NO: 30149 - DNA, 2109 bp, Heterodera glycines
  misc_feature (1288)..(1288): n is a, c, g, or t
cttcaaaattgtgaaaaataaataaaataataggagattcagaattttgaaaattttttataaaaaatgatgtcaagctaatgtgataaaacaggttaattcttttcctttcagtatgcctacaaaatttggggcgcttctgataagattctgaaaaaaaagataagcctaaacttttggccccgtctaaaaaggaattaaaaataaatcaaaatttatccatctccctttttaatagaaaaagcatcagagtgcctaaactagcatgcaaataaaacatggtgtgattcagagcattttctgaaaaaaatatctatgacctaattaggcaaaaaacaaataaacaagaaagactcagattttcgaaaatttttttgatccagctagctcggcgctcatttcagtgtaagttagtcctttatcggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttgaggtactcaaacatttatggggagcaaaaatccaacgcagaattatagtacaggctatagggaagctattctcgaaggattcggtctccccataaatctgggcgcatcggttcggggggactgccccgaaacaaaaaaatcgatttttcaagtgtccgtttggggtactcaaacaattattaaaaatttttagattnttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggtccgcttctgatcagtttataaaaaaaaagttaagcctaaaatctttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcacgttctaaaaaatatttatgaattaattttgcaaaataataaataagtaatgaaaaagtcagaatttcgaaaaattttaaaaacaacaag

SEQ ID NO: 30150 - DNA, 867 bp, Heterodera glycines
acctgcccctcgaggtgcgcgagcgaggagcggagcgaagcgaagcgacgagcgagtgtaccgagtcaatacgaacctgatcaattcttttggatgccgcgtagggtggggggtgaacggctaggctcggctgctctccggtagctgctgctgcacgaacaaccagccacgcatctgcgcctgagctgctactgcactaacaaccgcgacggtgcacacctcacacttctacccctcgtgtggcctaccagccgaccccatcaattgcccagccatctaccgggacgcctagttatctgtatataaaaataacgggggggctaaccataaaacgatttggcggcaaagaactacgcaacggatcgccacgagaccggtaccattcgaaagagctcggttttttctatcgttctatccttgtggaaaaatttacgataggcagaaaatttcgagaaaatcgcgttcgaacgaaaaaaacccggctttttacaactggccaaaagtgggttgtaaaatgtgtgttttcaccttatttctcgggaaccgtaagagctacgcttttgcggtaagcgaacaatttgtagagctcgtcgagaggaagggtgagaaaaaaaattcgtagctctacgacaaattcgaacaaagttataccccggcaaaggtcgaaaaaagccgattttttttgtgttttcgccttccggtttacaatccgtttacaattgtaaattcgtccggaatgtccggaatttcgaccgaccggatggattttgtgtttttgcatgtgttttcaacccggtttatatgtgttttcggcgtgcgttctttaaaccggttccggtttttcacgtgttttcttcacatttacgt

SEQ ID NO: 30151 - DNA, 1568 bp, Heterodera glycines
gccaattgaaagcatttagctgcaaaaatcaacaatttcaaatgagagaaacgacggtcgcaaagaatgtcatcaaaaacaacgaaaacataaataaaacaggattccgtcaacgtttaaactcttttttttgatgagcttatgtcttcattgatagatcagggtcttggaaatccaaaacatttaccagagatttttataaaatgtgaattttagttacctttttgttagaatattgttctaaatggatccatctgattttttccgaatttcacgaaaccaaaaaataacggactgatttccgtaaattttcaaatgccagtcaatggatggcctaaccaacggatgaataaattacggaaaagtgtcagtgttttggtgttcgtcatcaaatttggtctttcaaagcatcgattctatcaaagtgtcgcgcaaatcggtggaaattgcgctcggcgccgcgtctcccaatttgaagatggactccaacacggacagttcggcggaggtcgtgtcgaggcctgcaaatgggaagacggaatttacaattatataaaaattgttgattaaagtgacggccccgcccacatccgtcgccaattcctggaaaactaaacaattcgaccgaattcgcttgatgagtttcagtttttgggatttatgtcttttctgaatatagtttgcttcaatccgattaataaagttccgtatgagagcgttgaaaaataaagtccccaactccgagatttttgtttcatcgaagaaattatttaaaaatacccaaacagtgtgaaaaatgctggggaagtatttaatttggaataaaaaagccgaattgagaggacacggcacgactccaccaccccttgcctgtgaatgcgatccaatcagtaaagcaacaggcggccccaatcagttgcgagccgcggttgcccgtacaaaaaaaaaacaaaacatagaagagcgaggagaactctcgacacacctccgtcggtgtttttcccgcccacagccgcaccgtttgaggtaattgacggctaagattcccacttaattcctcttccggtaatcagtctaaatacagccatgttctcctttaaccctaggttctcgacccccccccccccccccccgcctcgtgcgttcgacaccctccgaccccttgcactcgcttgaataaaaagtttcaaaatttcttaaccacaattttcatagaattttttttcattttctcctgaaaatattgcactcaccggctctgagtgtcccgtcttgtctagagcgtctgcttcacctttccgtgccgaagcggcaagtgcaatttcctaaacattttgattgacacaatccaatgttttggcaaggacagagtccgaatacaaaggctaaaaaagaaaggaggggaataaaatttgtggagagagaaaaaagactttgttcggctgacagtcaggggagggcaattggcgaccaatttggacccgagaagtgtcctggaaattgctactctaaggggacgaatgttgagaaaggggcaaaggcatcccaaggggctgaagaatgggaaa

SEQ ID NO: 30152 - DNA, 1294 bp, Heterodera glycines
ttcataaatagcggcgaaatctttaatgacggactcagccgatgcacaaggcaaatttcattgaaatgcaagccgggagggccaccaaccagccgaaaaatgcaaaccacgtcccgtgccttttgcattaagacctgaagttgagaaggtcaccgataaaagatcaatgatggagtgttggagcaagtgacaaattctgattgggcgactcctttggtgattgtagacaaacgcggaaacaaaattcttgtgttgcgactacaaagtcacagtaaaacaatggctcgacatttatcaatacccgttgccggggctttgagagttgttcagcttgttgaaggaagttaaattatgatttcgaaatcgaaaattattcaacctgttgtgtccacaaggaacaacagaattaaatttattttagaaagacaaatgataacaaacaaataaataataaaaccaaacaaataaaataatgatgacgacggagtcagaggaaggcaaaaatggaaggagcaaaacagaaataatttagaactgaaaatgataataaaataataatgaatgaaacaaaacagcgggggagaatattgactgaagaatatggcgacaaaaataacaggaacatcatttctactgtattggcgctaattcaaataataattaaaatccatcatatccaacatctcccttcttaaattaaaatccaacatatcccttcttaaataatgttgtcgtcacggcgagtaacgtatcggcggacggcgttgtctctgaggacgttgcgttggttgaactggcaagttggtcggcggagtagtcgtgacagtgctgtggcaaggactcttttgttgcggaacttggtcaactgtatcattcggaaacgtcgtttctgattgataagggacaaaagaacgcatttggtttacatgtctgttgacagtaatattcaacaatggaattttgactttccaaatcagacctttaccagcgacgactttgccttcaagccagttaggcttgccagattttccgtagttcaacacacgaacagtgtcaccgattttgaaatgacggggacgttcatcaattgtgttgacttttgttggggcgcttgacaaatccaatgttgtcgcgatgggagactgcgtagccttctcaaacggcacaatccaatcaagtcccatgatgtttggagctccggtgttagctactgaacatttgagcttaaattcaacacctttaaatttcaccaaacaatggaattcgcccaacaaatttaatttatgcccggaaa

SEQ ID NO: 30153 - DNA, 2027 bp, Heterodera glycines
gattttcgtgccaacaataaatttcaaaaaatccaggtccaggcccggatccaggtctcgaggagcctggatttttcccggacctggattttcctggatttttgtccaggaaatccaggtccaggtccaacatggaatccaggtccaggcttttttcaaaatgttatctctaccaaatatgtacataaatatgtaagaaaaatcccaaaatatgtacaaaaaacccctaatatgcaaataaaaattttttaatggtattttttgggaaagaaattccccgtaaagtatgaaatagccacaaaatgacataaaaattacttttttggtatttttaggcaacattttcaaacttattttttctttataaattttcaaaatatgtaaaaaatgaaaatatgtacaaaaatatttgccgaaattttggatttttttttgaggatttccaaaaatttctgtaaaactcaaaatatgtacaaatatgtaagaaaatcccgaaacatgtaaatatcagtgattctttttttatgtaaatacatattttttcctggattctccatagcctaattagtaggaaaacactttcttttttgttttgcgaacaaaaatcgggacttttatttacatatttttacatattttggacttttcgtcattttttcctacatattttgcaatttttgaggatttttaaggaaatttttattaaatgccccaaaaaatccaaaatttagcaatttttcgtacatattttcattttttttttcatatattgagaatttatagaaatttcttgtgaaatttagattttttttgagaaatatacctctaaaaaatcaatttttttttcaaaaacagataccaaaaattaatttttaaagtactaaaatgtgattctagtcctatttgggtcatttttattgcaatttttccaaaaaaagtaaccgttaaaaatatttttatttacatattttcgtacatatttgggagtttttgtacatatttcatacatattttagcattttttatacatattttatttacatatttcgcgattattcttacataaaaaaagaatccctgctgatgacaccgaaattgtccaaacgtccgacaagcgaaataggcaacgaacaaaagccattcgaagggtgagaacgatccgtccaattagcccctaatgaatgccaaaaagagcatcaattcattagattgaattgaagcaccagaacagagactgcgtttatttacaaagggtttttgtcgcgtgtaataatttaggcaattgtgaagatcattttggtcctgaaattttttaattaatttttttttctaaaaattttttaaacacttttataggggtgttttgaggcgctgagcacgaatccggactcatttcgaccaattccgaatccctaacccaactcgaacatttttcgagatttaaattttaaatttttttaaaagtttctcttaaaacattgttttgtgttttcgggattgttaactttagacaaaagccgtttcaataccaaaaatggtcattctgtaaagatacgaacaaaaaaaatgaattttgtcagcgccttaaaacacccctagaaaagcgtttaaaaaatttttagaaaaattaattaaaaaatttcgggaccaatgatcttcacaattgccgggattttactttgtattagagtgaagcgggaccgggtcgggaattcccggtcatccgaggtccctgtcccgggttttgaaaagctcaggtcccggtagggcaaccgggaaaaacaagcactggtaagaatgggggtctgagtgaaaaattagtgatgaaaattggagttaaaaagaaaaaattttaaaaatatattaatatattatttaaaagtaacactggcggatggcctagtggctagtctccttgattttctacttttttcccatggttcaatccctctacagaaattaagatatattgaattttgtttttgtatactcatgggtttcctatcaacaaaatatgattgctcata

SEQ ID NO: 30154 - DNA, 990 bp, Heterodera glycines
tggggaaaaaaaatctttccaaaataaccccccggggaggagggagggggaaaaatttttttaaaattttttttttttttgttttatttctccaaaacggttcagaattcaaaaaaaaatcattcccggtgagaaaaatggggtatgaaaagtttattggggaaaaaaagcctttacaaaataatccccctgagagaggggagtgggaaacatgatttcaaaattttcaatgtttttaagtttaatctactcaaagcggttcagaattcaataaaaataacattcccggtgcgaaaaatggggtttgaaaattttatggggaaaaaaagactttacaaaataatacccctgggagaagggagtgggaaacatgatttcaaaattttcaattttttatagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtcgaggaaagtttattgggggaaaaagactttacaaaataatacccct

SEQ ID NO: 30155 - DNA, 2344 bp, Heterodera glycines
  misc_feature (1209)..(1209): n is a, c, g, or t
  misc_feature (2307)..(2307): n is a, c, g, or t
cccgcccattcaattagtagttcatacttgccagactaaccgctccagagaaaattccaaaaatttggaaccaattctaggcgaaaaaatgttatccacaaaaatgtaaattccaattatttattctctttttgggagccggtgaaatttttttattctttcaaattaaccatgatgtttcgctaacaacaactttgttttgctgctagaaaaactcaaatattcttgattttttcttcaaaaagattatttgaaaaataattgtaaaatcaaccttaaattttttttttaatttttctaataatattttgattttttcctagaaaaaattctaaattttctttgaaaattaaagagaaggcccaaaatatatggggatcgagagctgggagctcggcgtcgtggcttaacattaatacaaaaactcattaccgtatctcgtttttttcaagaaattctgattaactccgcattttccaccggcccatttccggtcacacaccgaaagtaatttacgacgaacgattagggtggggggggggcgaacagagctcgttttctcattaaataattgttaatgctttaattttttaacccaaccgccgtccattttaatcaacattttttgttttcacaaatatataaattaaaattgaaattttcaatttcatattttctgttcagactaatgctaatgacaaaaaatggttagccaattttaagcaagacttagctgaagttcaccatttgttgttggaaaatttgttagaaaactcgaaaaatactaattttgatactgtaccgatgcgaaaattggcagatattttttccaacaaaaaagcaatttgggaaaatgaattgacattccgtctacgaatggttgtttttttgaagaatgctttaaatccaaacttaatgaaaacgctgatcaaagatcggatttacgaaatatttggggcgaaaaatgccgaaattacgcaccaattgtacgacaaatacccatcattaacatatggaattggtgacttaatataaactataatttttttttaaattcagaaaatcaaatcatattaaaaattataaatatattttttcaaaaaaataataatattttcgccaaaatttgaatttttaaatgagtttgtgaaaatatttttaacatttttatgaggaagtttttgcttacaaaaaaaaaagaaaatttanatatctttcattcggttttttgtcaaataaatttttgctgaaacaacaaatactaaataattaaataaaataaaatttagatttttatgattggcatttgtatttatacaagcaattttttgcgctgcattttttggtagcagcaaaagtcaaaataaagatggatttttttgcctattttcatgccattgaagtgatttttgaacaaaaagaatacccaataagtgaatggccaaagcttcgaattcaatgtgctcaattaattgatacaattccattagaggtaaattttaccgaaaatgatgaaattatgaaaatgataaatgagctcaatgcaaaaattggcaaaatgcaatcatttttaaaggagaacaaaaattgcatggatgagaaacaaattgagaaaaccagcaacgaacttgagaaaaagattgaactgttaaagatacttaagcaaatttctaatgagattgatcagttgttagctagagaaaatcaggacgaagcccaggaggaggagggtaggaaattgtatgaaaaagttaaaaaaattcaatcagaatttgaagaaattgagctgggtgatcagcagaagcagcagcatttgttgtcagatgttgaatttggatcggaggacagtaaagaatttgaaaaggataaaacttttggattaggagaccaaaatgggcaaaacgttgagttctccggatcaaggcctgatcaaaacaagcaaactgacaacacagattatgatcagtatccatcatcatctaatgaaatgaggtccaatactgctgctgatcgtaatcaatcgtatgccaaatatggacaatttatacctgctgatcagcagattggatcagatgccgaaaataaagctagaagttcaaaaaattgtggcactgtaccaaatccaccgtttatcaatttgaagacactttttttgttgaaagcggacatggaaaagcttaaatcaaatgacaaaaaagaaaaggaatcgaaaaataagaacaaaagcaaagaacggaaggcaaattcaattgatgatttaacggcagtgcagaatgatttaagccaaatgcatgtgcaaacaatggnaaaagtgcccatggtcagggaagaaatttgccaaaaa

SEQ ID NO: 30156 - DNA, 1212 bp, Heterodera glycines
  misc_feature (20)..(20): n is a, c, g, or t
atttttggaagcgatcacanccgacgcaattaggttcttcacgaaataaacaaattcaattgtccccggcattcgctccgtctccccaccatttgctccccctcgtgcttttcctcctcgtcgccttccttttgttgctcctctgtttcatccctagatgatccatcctccgtttcctcttcactgtcctcggccaaatgcgcctcaaagtttccctcgtcatatgcctgtaaatcattcactgtgatggcacatcagtgccaaaatggaaaaagactttgttcaaatcgcgtcgcattttccgagtgaatccgctcgcctccaattccacgtccaaattgcgtcttctgaccatgtccccaaaacggggccaatcctctgactcaaacttaaatctccgattgaaaaaggtgcgtacacattgcacatcgcgatcaaaataaaagtcggcgttcggatggtccatgctaaccatttgaggaaaatcgatcagaatgggagactcgtcctaaagcaaaaagacattatgaccattcggaaggggagagggagtggaaattgggtaccaaaaatgattatcgaaattaatgactcgcttattttaacagtttagtgggtgggacccgttgatatttgatattaaattggtttcaatgaccacacaatggtactaatgcagtttgtaccccccttttgggtcaaattttttcaaaatttttttttcttttttattatcagaaatgcttttagattaatggaaacgcttaaaaatttcactcttgacgatttattcaaagtattggctcttcaagacaaagaattcgaagaatggctcaaagaatttaagcttctacacaccacccgtttttgtgactgtggcaatgaaatgagctacaaatgtattaaagactggaatcaaggatatgcaatgcaaagaagaatcatgacggcaaacgaccaactattgggttttacactggcactttttttgaaggagcccatttgtcgcctaaacaagttttttaaagtccaaaattgcatgttcaattgttactaaggtattcaaattttcttactattggcacgaaaattttcaaaagatgaaattatgtttcaaatgaaattgggaagtgatacagtgactgattggaaaaatttcatgcgcgacgtgacagcagagtttttcagcaaaaatccaatcaaaattggttt

SEQ ID NO: 30157 - DNA, 1274 bp, Heterodera glycines
tatcaatcgaaagctcttaacatactctattatccttaccaacaccgaaaagactttcaagcctgtaaattttattacgtaaaaacttcaaaaattttgacttttcacaattttcatgtataactttttttgtaattgtctaatcgcgaatcaatagcttagaaaaagcttctaaagacgttaagctttcgaatgataccaaaattgttggatttgaaagacatagaaaaaagttacagaaagttatagtggaaaaacatgctggcgcccaaaccacagcgcccaaacgcccgcgcccaaacgccagcgcccaaacgcaggtggagccgaaattttatagatgaatttattgcatttttgttaataattttggttaaaacgccaaaataggttttttcaaaattttttatgcttttaggctctaaaaataaaactccgacgggtcccaaattccattaaaaaaaaaaaaaaattaaaatttgtgaaacgaaaagacacactatggtaaaaatttgtcccattcagtttaggcagccagatgttttggcatcgtaaacttttatttatttcaaataatttcattttaaatttttcgaagaattttgaaaaagaatatttttaaaattaaaaaaagtattataaatagggctgccaattttatgtaaatacatacttttttttacatatttcgggattttcttatatatttgatacatatttttgacttttcttatatattttcgtttttttacgtattttgatgattttttacggaaatatttggaaatcctcaaagaaaatccaaaatttcgtcaaatttttgtatatattttcatttttatatatttatagcgaaaaaatacttttgaaatgtacctctgaaattactaaaaagtaattttaaaaatactaaaaagtgattctaagcctatttaggtcatttttatggcattttgtacctcctatttttttaaccaaaaattaacgatttaaaaatttttatttacatatttggtacatacatacagtgccccaaaaaagtcttgccccaatgaaacatatttatgtacatattttgaccacttttgtacatgtttttggcagcgctaattataaatgatgaatttttaaatatattttgaaaaagaatatttgtaaaactaaaaaaacataaatggatttttaaacacataaattaagattttttgaaatttttattaattaatatttattttttaccctcagcttctcgctgtaccaatgcttcttccact

SEQ ID NO: 30158 - DNA, 2349 bp, Heterodera glycines
  misc_feature (702)..(702): n is a, c, g, or t
  misc_feature (1597)..(1597): n is a, c, g, or t
  misc_feature (1603)..(1603): n is a, c, g, or t
  misc_feature (2342)..(2343): n is a, c, g, or t
ctagagaccggaaatttcaaatttgcggatcccgctgcgggactggaactcaaaattttttgcgggacgggatcccgcgggattaatcccgcaaatcccgcatttaaaatttgcgggatcccgtgcgggattttggaaaattcgaaaaaatttcaattaaattcaaaaaatttccaaaaatcaaaaaatgctgaaaaataaatttttaggggctagcgggatgcattaaaaggggctgatgggtcgactaagattttcgattggatccgacggtaaaaagttgatcggaaatcaaattattaacggttcataaatttgactatttttttcttttcaaaaccacttttttgcggtgcaagaaatcggaaatttttcaaaaaatatacaatataataaaaaaatttctaaatattttaataggctaaattttttaattcttaaccaagtaaaaggtatttcacaaatgtttttagtatattcgcttgaaaaaattattcaattattttatcaaaagctttttttgtcatttttcattattttagaacattttttgggaaaaggagtgactatttacacgttttttacagcgcgattttttcaaaaactttttgggaacttggaggagagtacggcggtgccgataggcgccgccggaaaatttttaaaaatttcagttcaatttattattagaaattgtacaanacttactagttttaaaaaaaaaaattaaaaaatttacgacttttcatcaaaaatttcggaagtcggaattccgacccccaaaaatgttggaaatcggaagtctttccgtgccatacctggtgcctatcgacatctgcaagaaattttatgaaatttaatgcgatttgttaacagaaaaagtagagcgagggaaaggtgggaaaatagtgcactgtctgattgtctatctacgcgggcagcggcgggtgagaggggcgatacgagtgaacagacgcgtgctgctgtgcagcagcgagtctgttggacgcgtgcgtgtgtgtgggagaaggagggagtgggaaaaaagagagtaaattgcaatggaaaagaaaagagagtaaaagaaaggaaaaggagagataatgggaaatttctctcacatcccttccttatttataacctattttttattgtataaaaaatttaacaaaagaaagaggacactcattagtttgttcactaagaaaatcctataatattaacattgtgttgtgttgtataaatgctttgaaaaatgaaatgtttttgttttacattttttttcttttgtcattttgtgtaaaaaacggtcttaaaaatgtttcttttttttctttgttgtgtgttataaattgatttggttttgatatgaaagatattgttttgcttatgtaaatggtaatgaaattttaaatgaatgaatgagaatttgtttgaaaaatttgtatagaagaaaaatgttgtgcgtaagaaaaagtcaagaaacaaggaagaactgttatgccataagaaaatgccaaaagaagagtgcgagtccgcgaagcggccgagtgagtacctttgacgcaaaaatttggtgagtggggccgaaggcccnccgtancggttgagtcccagtgattggaatgctggtgggttgagtgccagtgattgtaatgcaggagaattgagtgccagtgattgaaatgcaggagaattgagtgccagtgattgaaatgcaggagaattgagtgccagtgattggaatgcaggagaattgagtgccagtgattgaaatgcaggagaattgagtcccagtgattggaatgctggtgggttgagtcccagtgattggaatgctggtgggttgagtcccagtgattgaatgctggagagttgagtcccagtgattagaatgctgttgggttgagcccaagtgattgaaatgcaggagaattgagtcccagtgattggaatgctgttgggttgagtcccagtgattggaatgctggtgggttgagtcccagtgattgaaatgttggtgggttgagtcccagtgattgaaatgcaggagaattgagtcccagtgattgaaatgttggtgggttgagtcccagtgattgaaatgttggtgggttgagtcccagtgattgaaatgcaggagaattgagtgccagtgattggaatgctggtgggttgagtcccagtgattgaaatgttggtgggttgagtcccagtgattgaaatgttggtgggttgagtcccagtgattgaaatgttggtgggttgagtcccagtgattgaaatgttggtggattgagtccccagtgattgaaatgttggtgggttgagtctcaggaccnntgcagg

SEQ ID NO: 30159 - DNA, 1608 bp, Heterodera glycines
tttcaggtacaatattctctttctcttcaccattttctacagctccattcctcaatttaataaaatgaatttgactcataaaaattaaaaaattcaaacgccatagattttttttcaaaaaattcgaattttggtacaaaaatttttggaaacgggtaaggggttaaaaaccaattgctttgccctagaatttttcattaaaaaatataaatgctgccttgtggtacagctcgggcgccacgcgcaagtacagcttcatgtccaagtcgttgtggtgcgtggtgaacggtttcgcagtcgcaccgccagcgattgggttcatgatcggagtttcgactaaaaattccggaattttttttaataaaattttttaaaaatcaatttttcgtaatttccagttttggatcctaattgactcgaataattcgggtgaatttttttcaaacatgcaaattcggacatgctaaaagatcggagcatgtcacttccccctttccccgatttgaaaaaaaaattttcaaacattaatttcaaaaaaaaattttaggaaattttttcttaagaaaatttctagaatttcttttttagaaaaacattcagcgctttgcaaattaaaaaaaaaatttcggatggaaaacgacggggggagggaatgaaatgcactccaaaaaaaaacaaaaatttcttgtataaaattctaaattttcgcaaaaaaaaaactggaaaacaaaaaaaaccttcaagaaagccgagcgcgtccaaatatttgcgcaaaaatgtgataatttttgcgcgcgtcacgaacttgtcacgcacttccgggttcacgatcagatccaagtagcgcatacggtagctgaacggaatgaaaaataccgtaactcgtgaggaaaaccaacaaaaaagaatttctaacgtaagcaaaaaaaaaaaaaaaattttttttttttgaaaaaatctgcgaatcacttcgcgcgaataaaatgatcaaaatccaatgttcaagaggcaagtaaattgtaaaattaccgtgtctcgatgtttttgatgccaaaatgtgagcgcttaaaaacaaaaatttatttgaaatttatagagacgatactcaccgggagcatgtgcaaacagggggtcaacagcacgacctaaaaaacagagaaaatttaggtggaaaattttgtgaaaaccattttaagcgggtaggcctggaaagtttaaattggaagacagaaacaaaaaaaaaatacaaatctcatcatcatgccgtttcaaaaattgaaaattaaaagacgcaaaaaaaaaactattttttttttggtttcgggatgggagtgtatatttttgcaactaattttttcattagattaaaaaatggataaaatgaaaattctaaatgatacgtgaatgcctcacaaagggcaatttaaaggagagaaaaaaaaacggacctccgtaggcacaacagagagttcgccccgtttggagcgcgacgggtggcccacgacgccgatgatgtcaccgcgtttgatccgctcatggcacatcagaaaatcgtcaaggcccgcggcgtgggatctaacaatttttttggaggatagttgccattta

SEQ ID NO: 30160 - DNA, 783 bp, Heterodera glycines
aaaaatcgctaaaaatttctcaaaaatttttttttcttttaattttcctatgaaaaaactttctaagattttttctaagttagcaaattttttttaaaaaaatttctcggggaggggggaaacgagctgctcccatcaaaaatggccattggattgctgaaaaaaactggaggacgattaatttttcagcttaagagggtattgttgattaaacaaattaagcttctgattccaaggttgttttaaatatttttgaataaagatttaggtatttaaaataaatctggaaaagattcaaatcaaatgcattattttaccgctcctttaccctgttttagtgccgccttttactcgggcactgtcgatggttcgtcccatgttcatgtccgtccccgggtgaacgacagcacgacgaacaatcagtggcagcatcgcgggtcccaatttgtggacatggaaaaccaaagtgaccactcggccgggcacagcatcggacgctcctcctgcgcatcatcgacaaaatcatcaaacaaatcgacgctgtcattgggtgagtttttgttgtgttaatggcacaaaatgccatttttaaatcactcgttctttcagggagtatcttttcctttctgcgtaaccacctctttcaccacaagaatacaaggcacaacggactcggaagaccacaggacgacattctgatcggcatcaatcacacgcacatcacactgatcgacccacgacagcacaaactgttggatgtgaggcggacgagcggggctgggg

SEQ ID NO: 30161 - DNA, 338 bp, Heterodera glycines
tttaaaaagaaaagggatattaaaattggaacggatggacagtgagcaaagcgattgggagaagagattggaaagggatggcatggcacgaaaagaaagagacaaaataaagggaaagggagagggaagagggaaagggagagggagagaggggaaaaggggaagaggcggcggggggagggaataccatttaaaatgcttggaatgcaccaatcctcgcaaggtgttcttagtttcttcccttcatcttctgtcaatgactcgcacattcattctgcttttacatatcttcgtcaccacccgtgtcccttttgccgctgctcccttccccccccccc

SEQ ID NO: 30162 - DNA, 1262 bp, Heterodera glycines
taaaatacacaaaaccaattggtgaacaatgtgatagaggtcatgggaacactaaagagattcgaataaagtcggtttggccaatgattttggcgcgaggttttgctaaaactgaacagacagtaacagagaaaagctgtaggtgtcggattcagggaaatgtccaacttggtcaaattaatgtttctttatcttgtaatcaatcattgatcacgatcagtatctatgatttgtcattgtttttttcctcttctcataccttatgtacctttgcaactgttctctccccctttgtctgtcttctcacaaaacattcctccactctctctttctctttctctctctctatttttgtgatggtcactctctgctgctgtctctgatggtcactcgcttcttaaattccttgacggaccaacgaacgaaaaatggaagtgaatgttcggtggaagggggggggggggaattctgagggtgatgagatgagtgagttaagttggcgggcgtgcctccgttcgcccgtccgtccgtccctcccatcgctcgtccgtcgtcccaccgcgttcccccgcctcgcccacctttgacccctcccctccctcttcgttcgtccctctccgaataccacactgatttctctctccctcctctcctcttcccactctttttcatcgttttgtttcgtctttctttctgtttttggcgtcctttcctcgctgaccttcgacccgtccgtccgtctctttgcttcgtccaccacacatcacatcatagcggcaagaaaccaagtccggctcggcccacttccaacttatgtgacccaaatataattgtgtcgcctcatccctcctcaatccgttcatcctcgttctgctgagcactcctttcccgtcttgtcttgacctctggctgacctgaccccggctttgtgtgaccacgatggaccatcatcgcttcgcccctcctatcaaccattcccattcctcgtccaaaaccgcgctttctcctcccatttcatcggcgatcacatcttccgatacagcttctgtagcggcaccgtccttttcatcgctttcaattcgaatccatggcgatcagcaggcgcaacaacaacaacagcaacaactcagacattcttctcatctgttacttttggatgacggccttagggcaatttcaaatattaaaaaggcgaaagtgccaggcaaaaccgcgctgtccatcgcttcgacatttcacgagctgtcagagcttaagcagaa

SEQ ID NO: 30163 - DNA, 1842 bp, Heterodera glycines
cgcaaactgcgatagagccttgtcttcctcctcctccaccttccccggttcacctttgattgtgtcttcgtgctctttcgccccataaagtgccattccgcggtaaactttcggctgaattattaatttaattggtacatagacaaaatgtccgatgggctaatagtaattgtgaccacctgctgggaagtgcccggctgctccttgcgcttcgccttctccccgtatttcttcctgtcctcctcctcttccgcctccctcttttcccgctccattcgctctttcttcagcatttcttgaatccgttcaaattgagattgcgaatcacgtccatattcagtgtcaacctaaaaatgccattgaatactaaaatccgaaggttccgccggagtgactcacttcacttctcgccgttgcgcccatgtcactcggcccagtccgctgcgttccgctggatgcaaatttcacgtcggggtcaaacgacgtctgtccttctcgccccgacttctcgtccgattcgtcctccgaggattcctcttccgccaacgcttcaatttccctcctccgttttttgctagtctgaataccttttttatttttatggtgtaaataaggtccgactgtgtgcatcaaattgcggccccgcaaatgtttgcgtctctccacgagtttcatccgcgtcgcttccgccgctgctttcgccccttcgtcgtcctctgttgaagtgccacttccgtcgctttcttcccctctctgtcgctgcttttctcctttcccttccgcttccatcgcttcctcctcatcttcctcttccgccctcttccgttccctccgtttttcctcttcattttcgtcctcctcccttcgtttgcgcatcgtcgtcgtattcatcggttttcgacgcatgcgaaaaaaaggcacattcggtgcctgttcagcagaagaagcattattagcaggatccatttcctttgctgaataaattttcaaaaattaatttaatgaaaataaaattttcaagtggtacataaattcaaagcgagaatttaataatgatggttcgagccgggatttcctccctgctggcaaatgaatgaaaatccttctggcaaggccaggactgaagtgtccaaattcctcaaaaaaattaagttaaattttcaaaattttgcaatatgatcttttaaaataaaatttaaaaaatgaatgttttcattcgttttttcatttgacagacggatacatagaccaataattgtcgagcatttagccgtatctttaagctcaaaattcttgatgttttatgccaaattttctcggcatttttctccggctctgattgggcaactttctttgcttcggttggcccgttgcgctccgcgctccacgcgtctttaccatttgacacgacatttgggcgagtaacgacacaatgatttaatttaactaaaactatccaatttttggtgcatttcaggcggtgaagtggtcgaaatccaagggccggcttttgcggaatcgatctccgaaggtgacatccgctggaataagcaagtgggcgactttgtgaagacggacgacatcgtggcggaaattgagacggacaaggtttgggcatttggcctccaaaattacgtatgatggactgctttttaagacatcagtcgaagtgccagccccatttgccggcaaaatcgtggagcttttggtggaggaaggagcgaaagtattggccaaacaaaagctatacaaattggagaagggagccgaggggggtgaagggccggcgaaagaagcgaaggaggaaatgccgaaaaaggagggagaagtgccaaaaccgaa

SEQ ID NO: 30164 - DNA, 1689 bp, Heterodera glycines
gttttttacaaccacatattgccaatctaattcttgcagattgaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagattgaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgttttgtgataattgacttcctttttaatttaaattaattaatttgtggcattatgtttcgttaattggttttcctcaattcattttggtttttttctgagttcttcggattgatattttttttgctgtgaatgacttttttgcttctcaatttctctctcctccgatctttgaatattttttggaaataaatctctctcatctggtgaagtcgtttggattgtcgtgttcgtcttttgtttaattttgtttggacagggttttaattgttggaatttgccgcggtgtaattgttggtcaacgagcgaaaatttgtgcctgtttcagtcgaaaattggagagtatttgactcagctgtcaaagagcaaaaacagaaatccaaaatgcattcttgcccatggtttatgagtcatctaatgagcctacctcaggtaattaataaggttgtaaattatatggactaaaaacgccaaatatggacataaaatatggactaaaaactgccaaaatataagttttaagcgctcaaaaaatccgaaaaaatggatttatagtttttaaatgccaaattttatcaaattctagcttcacaattgaaaaccaaatacatttcaattttttggttaataatctcattctttgtcagcgaaatttttcttaagcgaagaaaaacccaaaaaaattttacaaaattttggagaaattctcatttctgggggtgtattttttaaaaatttcccaaaaagtcgatctttatgagtgtatttttctctttttttgcatttttttgtggaaatttgctaaaaaggcaaaaatggcgaaatggatttattcccgaaaacccccaaaatatggatttataaaaaattgtgactctttattcagcgtgaactcaatttcctcaaattttctcgtaaaaattcaaaaaaaaattcatgaacctagccaagggtatttattcagcttgaaaaataaaatatttaattggaccaacaaaaatgaacaacaattcaccggccttcagattgctgacattattgatgtgtttgttctgctgttttatgttg

SEQ ID NO: 30165 - DNA, 997 bp, Heterodera glycines
ctctctatctcaccatccctttctctctctttccttctctctcatcctcatcaacttccttacaccctccctttcttcccctcttccttctctctctttccttctctctcattctcatcatcttccttgctctctttctcaccatccctttctctctctctcttcttctctctcatcctcatcatcttcctctctctctttctcaccatccctttctctctctttccttctctctcatcctcatcatcttccttacaccctccctttcttcccctcttccttctctctctttccttctctctcatcctcatcatcttccttacaccctccctttcttcccctcttccttctctctctctccttctctctcattctcatcatcttccttgctctctttctcaccatccctttctctctctttccttctctctcatcctcatcatcttccttacaccctccctttcttcccctcttccttctctctctttccttctctctcattctcatcatcttccttgatctctttctcaccatccctttctctctctctcttcttctctctcatcctcatcatcttcctctctctctttctcaccatccctttctctctctttccttctctctcatcgctcatcaacttccttccacactcccttacttcccctctggcttctctctcatcttcttctcgtgcattgtcatcatcttccttgctcgctctcgcaccatccctagtctctctctttccttctctctcattctcatcaacttccttgctctctttctcaccatcgcttgctctctctctcttcttgtctctcatccacatcatctgcctctctctctttctcaggatacgtttctctctctctctctacttctctgtcatcctcatcatcgacctctctctcttactcaccgtccctatctcgctatccttgtctctcaatctcatcatctcccatgctctcatcctcacaatacatatctctctctc

SEQ ID NO: 30166 - DNA, 563 bp, Heterodera glycines
  misc_feature (48)..(48): n is a, c, g, or t
  misc_feature (54)..(54): n is a, c, g, or t
  misc_feature (59)..(59): n is a, c, g, or t
  misc_feature (65)..(65): n is a, c, g, or t
  misc_feature (86)..(86): n is a, c, g, or t
ttgtcacagccgcgcgtcgtttgatggccgtccgtcccctaaaagccncgaganggggngcgccncgggaacagaggtcctttatncgacgcgagcacaacgacagcgcgcagggcggcgcgcagccgcgccaagcaaaacacagccacggcgcctttcttctcgcatcgccaaaacttcaattctccgtcagcattcatcttttcgtatacgaacagatggccttcgtgctgcaattttagttttcctttttcagataaaatatcacacattttgcactaaattttgtaaaaattttagttttggatttatttagcatagagtataacaatacagatcaggcagaatttctaaccactcaatttatattgtatttttagtggttttttggaatttttttttgccaaattttctggcactgaattgtcaatttttcaacgtacactgaaacgtcgtcactgaatcgtcgtcactgaatcgtcgtcactgaatcgtcttaacactgaatcgtcgtcactgaatcgtcggcactgaatcgtcggcactgaattgaccggctccga

SEQ ID NO: 30167 - DNA, 1218 bp, Heterodera glycines
tttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccggtttgagtagattaaaactagaaaaaattgaaaattttgaaatcatgtttcccactccccttttcccaggggtattatttttgtaaagtcttttttcccccaaaaaattttttaaaaccccattttttccccccggaaattgttttttttatttaaaatttgaaacccttttttgaaaaatattaaattaaaaaaaaattttaaaaattttttaaaatttttgttttcccccccccctttcccccacggggggatttattttttaaaaaggttttttttttccaaaaaaaaattttttaaaacccccctattttttcccccgccggaaaaggttttttttttttataattttcaaacccctgtttgggaaaaataaaaacaaaaaaaaaaaaaaaaaaaaa

SEQ ID NO: 30168 - DNA, 942 bp, Heterodera glycines
ctccgcttattatcctatcctatacggaaaagagaattattattggctttttcagagatttattttttaaataaactatcggccatacaaatcgatttaagaaattgctttttcacattcttctgctggggaaaggagaggcggggaattttctccccgtggggacggacaaaaacggagagatgctgaagacggaataaattatttttaattgttgcaattgaatgggatcagaatgcaaaggctttatcatcaattatgcaggcctttattatgaatagtcgatgattcacaaaatgaaacaaattgaaaatgccaaaaaaattgggagggctaagctaagaacagaatgtgcgattgaaagcgtcattaaggatgcaaattacatgtaagaaaaatcggaaaatatctgtaaaaccagagttaccctttgtccttatttgtaagatttgtccttatttaagctctttgtccttattttcgtcttattttttggattcagggaaaaatttagattttaaatgataatttttgaaagaaatgttttttgaagcgaattaatatgcaaaatcttaacaagattcagttaaatattcaaatttttctctcagcggtttcttattctcttttaaaaaatggctcaaaatcgtaattttgtcattttttgaacaaaatcgttaagaaatcgaattaaaaattataactattagagcaggggtgtatgtatctgttcttatttttaagaaatgttctgatttggggtagtgtctttttcatttaaaagaggaaatttctgaaaaatttggctaattcccaacaaaattcattaaaaattcttaaaattttcccccagcggcgcctatcggcatcgccggccccccaaaacccctattttttcttaaaaattaacccaagatcgcaaattttggtcattttttggac

SEQ ID NO: 30169 - DNA, 1586 bp, Heterodera glycines
  misc_feature (1413)..(1413): n is a, c, g, or t
  misc_feature (1454)..(1454): n is a, c, g, or t
  misc_feature (1487)..(1487): n is a, c, g, or t
  misc_feature (1558)..(1558): n is a, c, g, or t
attccaatcactgagactcaattctcttgcatttcaatcactggcactcaacccaccaacatttcaatcactggaactcagcccaccagcattccaatcactggtactcaacccaccaacatttcaatcactgggactcaacccaacagcatttcaatcactgggagtcaacccaccaacatttcaatcactgggactcaacccaccagcatttcaatcactgggactcaattctcctgcatttcaatcactgggactcaacccaccagcattccaatcactgggactcaattctgcatttcaatcactggcactcaacccaccagcattccaatcactgggactcaattctcctgcatttcaatcactgggactcaacccaccagcattccaatcgccaggactcaacccaccagaatcaatcaccgagactcaattctctggcatttcaagcaacgcgactcaaattaagcaattctccgatattcttccagtctctcaatcaccagacaaaaaattgtgccaaattcatcactgcaatataatatcgtgtaattttaggtctatataaaaaaataaatgcttattaacaacacaattaataaatataaaggtaaaattgcaaattcaacaaaatagaaaaaaatgttaagatttatcaatgaaaaaaaaattgatcaataatcaaattatataactaaccaagaacttaaacagacctgttcaacgttaatttttaaattttcttattaaaacttcattaaattacgaaacacaattaattgtggaaatccttaagccacattataaataaaaacaaaacaatacaccacataaatgaacggacacaaacacatacataacgttttaatatccaaaacaccacacaaatacaaacatagaactgacaacacttttaaattcatacaaaaatctagctaaacaccatccaaaataaattcacaataaacatacaaacataaacattcacttatttatatgtagataaaaagaaaaaagcaaaaacaaaaaaacacactatttcttagccgattgcggactcaaattgcttcatcactctttctcttgaccggagtgaccaacttatcaccaatcgtcactttacatccacacacattaacatcagaagccaaaacattaagctgcatacactcatctacaaaataattaaatcatagataaacaaaaaagcaattaggcaaaaaccttcaattttgacaaaacaacgttttagttcaagctggtccttgctgtccaattgcccaaacatttctgggagtttttcgcccgaaataaataaatccgcgcgcttcccacagaaatcgccaacaacagcagcgaacatttctccaattaatgaaaacggagtcgttaaaacacacttaatttctnaaaagaaaatttaaaagatttttatttaatgcattactatnaaaacggcccgccacaagctgcgtaaatttctncgcccgcaaaacttcagtcttgacccaaacaattttcgagtgctttgtcacaaacaactcaaacggaatgnagtctgaaaaaatttttgacatcaaatt

SEQ ID NO: 30170 - DNA, 730 bp, Heterodera glycines
aaaaaaatttataatacaaaagggggtaatttaactaccctgaaagttcggtttggaagttccaacgttagttgagtacctctcctttattaggcggcggcagaccacccaggccaacattttgggaagatttctggtcaacagtttcgacggtgagtgcggttttaatcgaagagtaagaaggcctatcaaaaactagagggcggcaggagtttaatgggagtcccactcccggaagattccggattcccgctcacgtaaattttcacactaagtacgggagtaaaaatacactggtaataattgagttttttgataaaatataatttttgattgaaaatctgttaaatatctaggcaaaatttcaaaaaaattcccagcggcacttatcggcaccgtcggacccttaaatttaattttcttaaaaatggctcaaattcgcataaattagtaatttttagacaaaactgataatatattgcactcaaatactacatacatgaaaggggggggggtcgaaaaaatacttctttgactaaatctttttttgtgtactaaatgtgttgcccgtcattcgaacaggaagaacactgctgatgtgaccatatatttttataaatgtttacatttgtacaataaagtctgattattattatagattaaagcatatttactcctccactattgtacggaggagattgattcataccaataccatccatctataggg

SEQ ID NO: 30171 - DNA, 1255 bp, Heterodera glycines
taatgttatggtggttatatatattatatccaattatagttgttaattctatcttatttattttccataatagccatagccatagccgccatagccacaataacaactgcgatatccgtagccgccaccccagccgccatagccgtagccgccccatccaccgtagccgccatagcgtctaccgtagccgtagccgtatccgtatcgtttatggcgtaccaaacttaaaaacacacgtaatttcaaggaaatttcgaaccggatttgagttcaataaaagacccgggtctaataatcgaagaaatttggtaattatactattaattgtcttgtatcgcatttcatctcaccttgttgcttcatccgtgccaatggaagccgctaatttgccattgtttgcttcaacaatggcatttgcttcttcttcaatcggtgccgaaactgccagtgccacaaaggcaatgacgaacagcagaagaagcacagtcactttggcatgggacgaggacattttgtgatttaatttgggcaaggctatgggtttttgtttacaaaattaatctgaaaattaaaacaaattatagtaaaagttaaaaaaatattttaaagaaattaaatttagtaaaatttttttagtgtttttgaaggcattaaatttcatttttggccaatgacaaatcaaaaattaaatttataaagtgatttggatttggaattgtctgtcgttaggaaatttgaccttttttatattgtgtgtttgggtgttccattaaaacaaagtcagctgcgaaatttaacgaacaggttttcaatttatttatttttttcttcgacaaattgggggaacaaaactgacagaaattaatttattttaatttcaaaaaagaaatggtctttttttttgtctttgagattgataattctcaacgaatttggcgaatttttgagtggaattgaagcggaactgattaatgttatacaacaacattggccaaataattgaataaaaaaaaattaaaattaatttagggcgtaaaaaaattcactcgtgaatttctgaaattgaatatggtcatattactttgataaaaccatggctaccaaatgtgatgcttaatcataattttgttttttggtgcttttttcaaaaaaaaaaaggttttttcccaaatttttattatttattagaattttggtcaaaatctattaaaaaaatcgccttaattaaaaaaaattgaaaataacatgaccatga

SEQ ID NO: 30172 - DNA, 857 bp, Heterodera glycines
  misc_feature (174)..(174): n is a, c, g, or t
caatgtctgctgacaagagcaagaaatgtttgggcttttttatcgaatgcaataaaaatggtaaaaaacaatggatttaaattcatttaaatgccattcatccaccggcttaatcggcatcccgtcacgcttttcttgggttcccgagccagactttttgaaaaaaaaatgccnggatcagaattctggcagtgtatcctatcgcgcgactttcccaactttttttttcaaaatgccgtgatttttccaatgaaaaaaatgccggaccgacgtgttccgccagacaaaattcagaatgtccttcatttatttttttgaatcacattttaaaaataaaattttggataaaaaaaatttttccaaaatccgaaaccaccaaatgcctatcactaacaattaattaattaatgtttttttaattgaatttgcccattttgttgtacccccgatgcccattattcacagaacccaattggtgctgtacatgttcagcaacactgcaaattgttgtgcaaaggaaatacagaaactctcccggcgccaacaagcagttcaaggatgccaatttcagcgccgaaaagaaccaattgggtttccgagacttcgtacctattgaggtgtgtgtgtgtgtctggtcagggatcttacaaaatcacagttaggtgctcgggatgatgtcgatttcggccctccagaatgcttggaattttttttttgctatgccaaaccgtggattggcattggaaattttagtctccactcactgtggtcgggttgttgtacttcagtctagggttgaccggtagcggttccggtgctggccggtaattaccgccttttttggtaccggttccggt

SEQ ID NO: 30173 - DNA, 986 bp, Heterodera glycines
ccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggttcaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggttcaaaattggccgaaaaagagatagccattttctgaggcccgaaggaaaatttgagagggctaatttatatgtaatattcgaaagtgccaagctaattagcgattcaggcgcacattggggcctaaattaagccattttccctttgatcggtacaaaattggccgaaaaagagatagacattttctgaggcccgaaggaaaatttaagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacatttgggcctgaattaagccattttccctttgatcggtacaaaattggccgaaaaagagatagccattttctgaagcccgaggaaaaattgagagggct

SEQ ID NO: 30174 - DNA, 1756 bp, Heterodera glycines
atctccccccaaaatgccctcctacccttttggctccctctccaaaaatggtcaatcttctgcccccccccaatttcccccttctcctccatatgcttgttccagtcgcttttgtaattgacaacatcaaacattggccaatatgttttttgtggtccaactttctttcttccaccgcaatattttcctcgcatcgccgccactcccccaggcgatgagttcccttgacgagtgcgaatcggaccccattttgggccgtccgatcattcgcattcccattattctcgcgtacatcgccgtgtttctgatctgtctgatcggtcggtcggtcttcgcttttctatttgacccatcgctcccaggcaattcgttcgcaattctcgtcatttgtgcccaccgttccatgcgcaccgccaccaatttctttttggctaatctcgccgttgcggaccttttggttgccattttttgcattttctaggcaaactcttctccccgaagcaataggcattctcactttgttgtagaatatgttccatttggttggcattgtcaccaacgacggacgttggcttttcggtgagaatggtcaaatggcgtgccattcactcatccttcgctttgaggtgccactttgtgcaaattgtacgcgttcgtacttcacctcttcccctgcaccagcattggcattctcgtctgcgcctctgtcgagaaatacatcgccggtttgctttccaagtgtgccttccccttttaaagtgaacattcgttttggtgctccacccgcttttggccctcaaagtgttcaccccgcgcttccgcgttttgctaatggcctccatttgggccatttctctcctgttcagcttgccctattacattttcaccagttacatcttttacaagaatgttgcggtgtgtactcggttgatgcctttgactaattcgacaaaaaggtcgaaaaatgcttaaaaagggaagaggggcgctttttgtgccaaaatctttgataagctttaaaattttccccggatttttttttggcttgaagaaaagtccttggattctattctctctgcgaattatttctggttccggcgttggccacagttatttagtggtggggagtgtttcgaattttgttgtttcatctgctaactgattggaattgtcacaggttaacaatgtcctctccttttgagcacgcgttaccgaattttccattattattattattaaattttagctgtcattgtgattccaattcccttatctctaaaaaagcaatgtgtttgtttggaagggtttgttgtgaaagatacgataaaagggcagatgaatggtgcaaaactggaaaattgattagcaattagaattggacaacgacaaaatgggaaaaatgtgcccattgattgagtgaaggggcgggggcggcaaaaacaatcgcttcattcgccgctttcactggcattctccgatcagtctgatgagcacccgaaacatcgtcacctcctccttcgtcctttggtactgcgttccgttgctgatcatcctctttctttacactcgcaatggtttggtcctgtggcatagtgcgccgctgaagaaactgacccaagtgggcaaattgcgaacaaacagcaacggttggttaagagaagggaaagcaaaggatcagcacaaaaaggcgattgatcattgatcagagacgacgacaattgcctcggggataggcagtgccaaaacaagagccaaa

SEQ ID NO: 30175 - DNA, 1483 bp, Heterodera glycines
attaaaaatgaaatcaaaaattcactccaaatttttattcccatcacattaattctttaaataaaaaatttagttttattcataaaaatgaagatccactcttgaacaataggctccattctcgccgtaaattgagatgttttggaaggcgccacaacaatttactgggccaccagcaatgcttttgtcttcctaaaattgaaaaaaaagaaatttagaaacaattgagatagaaaatcttaattttctcaaaatccgtgaatttttgtgtgtaaaaatccgatttttatttattcattaattacatcattgactgaagcagaaattagtgccgaaacgtaacatggtgggacaaaatgtgttgatgtaagtgcccgaattgccgaaaatgttgccgcaaatcctcccaaaagaccgaatactaaattattaaaataaaattatttataaaaaaaaaaattgtgcaaaattgtcaccgctaataaaagtgcagaaaaacaacagtttaggttccgtaaaattgatcacactaaagcaattaggtaattaaattaaaatttactatttatattttttgattaaaaatattttattttgatttattttcgttgtcactcagaaatggtggctcgttgttgaaaggattcaaaatgcttctccttttgcttgtcagccttatttaaccatgctcggcgcatttccgttttcatgaaaaattcaaatatataaaaaaaattaaaataaaaaaaaataatatattaatttacttttaaatgtaaaattgctgagtatttatgcaaataaatttattatcagttattattgtaatatttaaataattgtttctttaatacgataattctttgttattgaagatattaatttattatttattatagaaatacaataaatttatcttctttaaaattgtttgaaaatttaaataaatattaaaaatgtaaaattatttttaaaaataaatgaaaaattttttaaatgttattttaatatctaaatttttattatataaaatttatttttattttctttttcatacttctcagcggcgttcaaaaacaaataacaaattggcggaaatatcaaagacattgagctttgcgttgagcctccactcaaatccaacaatgggccaaatgttggcacagattcggccacaaaaattgccattcccatcacaatggcacggaccaaaatacgttggatgccaaattctaattaaaaaaaataaagttagaaaaaatacaaaaataaattttaaatttacttggtggaattttgaaaaatttttcagcggcctgatttactggatttaggacaatgattatgctgaatattgcatgcccagtaataaatgaatttgcaagctaaaaaataaattttaaataatttttaaattaaaattttaatttattaatttaaataaaatattaaatttaaatattaatttattacttgctgaagc

SEQ ID NO: 30176 - DNA, 1700 bp, Heterodera glycines
ttatttcgcttcttctttgtgttttttgtgattttcgacagtaaattgaattcgacaatgagtgatttcgacagtgaagttcggctccgaccggttcgtccccgttgctaataatttttctcattacccatcaaattaaatatatgttggtatcattcgagagctatataaaatttaaaaaattttggtcagttaaaaaaaaagttatggccaaaaacctcaaaaatcaactttgagcttgttaccagatttgctatcgtgaactgacaaagaaaaaagttatagcatttctaatttgttggcgccgaaacgggccgtgccgaactgatctcggccctattttaagggggggggggggggagagaccgaattatcagggctgctgctttaatttaattgatgggcacactaattaggagtttatacaatatttgttttccaactagtccaaagagaaggggcagatttaatttggatttttgttttgaattttttatgaaaaatggtgaaattcaaaaattttaaaaattaaatggcttttgtatgtgaaatgaaaattttcaacatttaagctcacttgtatgatttatctgagtacggtttcttcactgaaattttcagttgattgttagcaaaaacatttgtcgaacaaatgagtacaagtgtaaaaagaagaataatattcattgatctttattaaaattttgcataaatattaaaattattcattgttattttgattgcctaaagcaatatgtttcataatgttaatgactacctaaattcgtaattacctccccataaatgccacgaacacaaattgatttattttatggttttgtaaaaaaagccaatttccgatttatttggcatacctatgtttacgtttgtgacaaataaattttaaacaaaaaaaaataagtaaatatattttttattttattaaatcctctatagaattgaagaatgtttctcggcacaaatgtaattcatcagaaagtagttgatgttagtcaaaaaccatcaaatgcaaaaaaaaaaaaattcatatatagagaccggatttctatattttttttctacggcttagttatggcgtgagaagcccacaatagcattttctccgaacaatttgatttagagcgacttaaaaaacatattaaaaatacatattttggcgttttggcatatttgggctattttggaatttttagcacatattttagcatttttgaaaaaaaatcataagaaaaatacaagaaaattgaaaaatacaccccctaaaaaccaactttcttgtcattttattaaatattttcaaaatttctttttttatttcgaatcctgagagtaaccaaatcgaattcttaatttgtcaatggattacgaagttccctgctggaattttcaatttgaaaaataatttttcagaaaaagaaaaaaaacattttacccccgaaaacttggaaatgtatttgatttgcaattatgctggcgaaaatgaaatgaatgagatttttctgatatttttatgcatacagagttccggatttttccaatatttaatacatatttcgcaaatattttggcacttttttttttggtttttagaacatattttattacatatttcaggattttttaacacaaaaaaatctttttagccgagactcgatatatggtcaaaaaaattttttggc

SEQ ID NO: 30177 - DNA, 985 bp, Heterodera glycines
aggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgccctaatgcgcaccaaattttatttacaacttaattttagcactctgatgctttagtatcaaaaaggaagatggagaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaaatctctccttcggggatttttttcccattaggtcgtccgttag

SEQ ID NO: 30178 - DNA, 724 bp, Heterodera glycines
atgccacaaaggcattctgatcggatttgagattggatttctgaaagataagggccgtccgacttatgtccccctcctcagcagtggcttacaatgtaaaagcaacattttcagcgagtaccagcagcagtgccatcggaacaacatcattaacagcggcggcagctgccctttggcactttcgtcgtccgagcgaatggtcagcgaactgatcgcagcggtcattgagcagagcagacaaaggcaacagctgcagaaacaccagcaacagttgctgatcagtacgaacaaagtagaggagaccaataacagcggaggaagcgaaaatgaggcggagggggaggaaagaggggacgaaatggcaccggaggagggcgggagcatttggcaacagagtaagggcgagaacggcacggtaacggcggaagctgtgccgaaccatccgacgacggcaaatgccgggggagacgaagcacaacagaaaaaggaaatgttcatgagggtacggcatattggacaatcattatcagaatgtatgctaattggtcaattaatgtcccctttcagtgggtccatcagcacggcaacaacatgtacccgtcccgagaacagaaggaacggttggcggcacagatggacaccagctatgagaaggtgatcagaccaaccaaattattaattgaatagtttggttaatcttttttctcattttctgatactttta

SEQ ID NO: 30179 - DNA, 1476 bp, Heterodera glycines
  misc_feature (17)..(17): n is a, c, g, or t
aggtagatggggtcganctcgttgaagtggttgaactactcggagttgatgaggttgaagttgacgctgtcgaacttgtagaaatgcttgaactgctcggagtcgacgtggttgaggaagatggagtcgaatccgttgaagtgctcgaacagctcggagttgacgaggttgatgatgctgaacttgttgaactgcttagagtcgacgaagttgatgatgttgaactagttgaactgctcggagtagacgatgttgaactactagaggttgttgacgttggtgttgttgcagttgaggtacttaaagttgttgtggaagttgatgaagtcgatgttgaagatgtgcttgttgtcatgctttctttgcagcagcaaatgtaattagtgtattttgacgaaaacggattggatggttgtcttaaatacggatacatcgttgcgccggcttcatggcactgatggcaacataatgcccgaatgcaagatcgcatttcctctgagtctgcgctggggttactattgggattgatatttggacaatcactcgcttgtggtggtgaattttcgtcatatgaacattctaaaaaaataagaataaattcttgaaaaaattttaatttctaacaacaaaattaaatataaatattgtattgaaaaaattatttgagaatgaggaggggtccgcgatgccaaagcgccgccgggaaattttcgaaattttattgataataatcagattttgcggttttgtgtaaattaacaaaaaaacaattttagccgtttttgtttacagattttggtaaaagacattctcctttttactttcttatccgcccccaccataaaactaatgttttaattttacaaaaatccaggaatctccttaaatccgaaatcctaatcaatcatatcaacaaaaaacccaaaaaaaaatgtagaaaatcctcaaatttcacagccctatcttaagagatttgaattataaccaaaaaacatcgtgatattttgctattcatttaacttttttctgaaatttacctttaaccatttgtaagccaaaaatgctttgacatttatcctcagaaagcacattcctgtatgtaaaagtcaagatgatggcaacggtagcaattttaaaatttaaattcatttttgaatcaaattgaattattttcaatccgttgttaactcaaacttttgatgtaatttggataaatttatatgaaaatgtttccaaaaatgaaatatggtgttagttttgcgctgattaaacaataaatctttttttgggtcttaggtttggatttatttaaattacccaataaatcttcaatggtttcaagctctattgtgtattcagtggcttcaaaatactaaaaattgtttgaataagattttcacgattcggataaagattctaattaaagattaaatttgtggtcgagatggaactcgataattaaaatattgataaaaa

SEQ ID NO: 30180 - DNA, 1008 bp, Heterodera glycines
  misc_feature (992)..(992): n is a, c, g, or t
aaataaatacaatttttagaatttgattcaggttatctctcgccgtccaacggcgacgccaacgaggagtaccgtatgcgcaactttacatcggcatccgccattgataaggtaatgatgggcccaccgtcccaacagcagttggtggccgcgcggatgcgtccctcctcctccacgctcggcttttgcccaacgccgccatttgtgcccgtttcggcgctgggctgtaacaacattggcaccacacagcagcagcagcagaacggcgcaacaatgaatggcacaagcagcggcagcagcacaagggtgggtgggcatcaattaattgacatgactaattattttggtcatgctcggctaattagagggcattggcacggctatttaggggaacattagggctaattagggtattaacaaggccaattaattatagggtattggcagtgataattagtgggtattataaggacgaattgggtcattggcaggattagtaggaccaattaaagggcacttacaaggataattagagggcattatatagggccaattaaagggcatttacatggataattagagggcattagtagggccaattaaagggcattgacagggataattagagggcattagtagggccaattaaagggcatttacatggataattagagggcattagtagggccaattaaagggcatttacatggataattagagggcattatatatggccaattaaagggcacctacagggataattagagggcattagtagggccaattaaagggcatctacagggataattagagggcattatatatggccaattaaagggcatttacatggataattagagggcattatatatggccaattaaagggcatttacatggataattagagggcattagtagggccaattaaagggcatctacagggataattagagggcattagtagggcccattaaggggcattacatggatantagagggcattatata

SEQ ID NO: 30181 - DNA, 1361 bp, Heterodera glycines
  misc_feature (1350)..(1350): n is a, c, g, or t
agtttttagcacctaaaatcgtatccctatttcgagtctcggggtcaagtctctgtatgggaataaaaatttagcggaaatttgtgtaaaaagacaaccattttttgctcgtatttgaatttatggttattcatatgttttagatatgtcacgatttagtccaaaaggcattatttgttttgatccacatctccactttattaaattggcccaaattatgtggatttatctttttgcttaccttttaatagtattttcttctcagacagatagtaagttgttaagttttcgtcattgtctgctccttttatctcaatgtctttagatggttcagcgacagcccattcgtcaccgccccgttcactttgggcccaaacaagaaatggatgagcccgtggaacagttcaacagcacaacacaccatccatcggctcttctccccatgacgaacccatctgttcattcgtcccaaagtgatcaattaatccatctccaaattcgtcaatacaattaccaaagccgtcctcccccgtcgtagcatccaccagcagcgccatctccgctgattgtctttcccaacaacagccgatggatggtcaactgattgcttctgatcagaaatcgctttcttctgtctctggtgcttcctcaagtgggactcagttgacttgtactgtttgcggagatgtggccaccggtcgacattatggctctgtaggcaaactctcaataaacaagaaattcttgttggttaaggtggcgtgcaacggttgtaaaggtgggaaattacggcatttggtaaaagcgaaggacatgacacatataaccaacttaggctttttccgaagaaccatccgacgcggctacaaatacacgtgtcgtttcaactcaaactgtcagattgacaaacgtagaaataaaaacccatccagagttattgaatgaaaggcaattcacagataaccgtgctgtttgtcgagcttgtcgttacgcgagatgtattcagttcggcatgaaagtggacggtgcgttcgagggaatgttctgtcatttataacgggattgcgtttgatttagcggtacagagtgagcgcgatttaatcggaaaacgctcgcgtactttccccacgacttctccttcagcagcctctactgctgctacggatgcacccacagaagaagaatcgcagggggcgttgtctccagagcctaataaaaatacaattgttcaccagaaaatggaggagaggcataaatgtgagggaaaatgaacataatagtgacatttaaaacggtgtgaaattaattgctataggaatgaacagttgttttgttattttggtgtgccantataatgatta

SEQ ID NO: 30182 - DNA, 1036 bp, Heterodera glycines
ttttgttgtgcttaatcgttgttggtccatttaccgcctttatctgactgatgtttgctgttcttattgttctctcgtttatttacctattttaactcaaataaatcattgttttctttttttaaaataattgctcaataaaaattttgtttgtcaattcaaagaaatgcttacctaaattgttattgaaatcacgacttttttgttgccatttttcacagtgtccatggaattgctttttcttccccgtcttcggcattgtcttttgttgcgacgacctttccgaagacggctctttctcggagtgcgtctacaacaattgtcatcctccacgtcgacgtccaattcggcctccgaatgtgaaggggaaacggtggcggaggcccccttcggctacgaccccaatttgaagttggtcgccggccttagcggccccgtggacgctgatgacgtgtccatggaacggccgcccttccgcttggacggcgtggagaaagtcccctcccccctgaggggtcgttttaaaccccgaaattcccttgcagaaggactatttgcatttgtacgacgaacagttgcgctttgaggagaccaatttcaccgccgtgcgcaatttggccagacggagcagagaaaagtcgatggaggaactgatcgaagaatgggaatggcaggccgaaatcgaacagaacctttttgcggcgttggagaagacgcgcaaatggacaggtgggggaaatgagtgaaaaaactgccaaaacggcggggacaaaaaacgtttttcataactctaaaagtgtaaattaattttttaaaaaagagaaaatagtttttcgatttttaactttttttaaacacgtttttccattattcgtctgtcggtctgtaaggctaagaatggcaccttcaaattgttttagtgcgtgcctgcctgaagcagagtttggtgcgcgagtgttcccgccagttggtcaaactgacacacgccattctgtgccgaggccaacatgccattccgaccactgagctcaacgac

SEQ ID NO: 30183 - DNA, 1633 bp, Heterodera glycines
  misc_feature (1619)..(1619): n is a, c, g, or t
agcaagcattggacaacatcgacgaagacaacgacaccggaggatttgggacatctcatcgtcgatgtgtcattgtccaagtgcaagcatccatggccgttgcaatgctgaagcgattcaccaagaattgcccttggtttttcggtatttccaacgaaattccgacagggagtgatcgccgtctccgactgggtgacgaagtcgaaattgtcaacttcgcttggaaaagtggctacgaagtcctgcggcatctcgaccaggacggcacttcttccccgtggatcaatgccggaaacatcaacatccaagcatcgcaatcaaagccaacatggccaatccgacgagcatcattcccaaaattggaattgtgctgaacgtcaaacgccgtggaacgcgcaaaacgaacgtcattcaaagcctaacggttgtggcacctggaatgaaagtggcacaaagcttaccaggctgggctcttggcgagaaggattggtttagaacagggcaagccgtgcttgtcgaaacggttgagttaatgagacccaatttgtggaaagttaattcaatttatgcactgccaatcaactgcctatttggtcaagcaaatgatcggaaagcctatcatcctctcgtggccattggcattgatcagtcaccaatactgcacaaattcccattcaaaagaggggatttggatgccacaattgcgcagggcgaacaagcaattgccgcggcagtcagatcatgcttggacaagctggaggaggacattaagcggtttatcatcactgccgagcctcaagtggaatatggagcggaagccgacactgccataatcaccatttgacatcgcttagacaacaagcaggaaatggtcgacatgtcgaaaatgtggactgaagaccagccaatccatgtgcgtgtggcagccaaaggggccaaaccatgtgccaccggcttcatcatgaatgttgaacgacaggaatcggaaacgggactcagcattgtcgccaaactcttcctagcgtaccaagaagccaagaactacgattgtgaggaggcatgggaccgaataatggacggggaattgaccgaaattgagcctttgcattctaggaaaatcctaatgcaaagggccgaaaaattttcagttaatttattcactgaaatggcgaaaaacacaacgacgggactcggcacaattatgtccattctaatggcacgccaaggggaacgaacgcctccacaaaattcatgggatgagctattcgtagctacgtctgctgatgttgaccactccgaccgggaattgctgctgctgcttggttgtcgtcaagaagactaaaagcaaatttaaattatggcaattccatgttataccatcggagagtgcaaaatggaggtggaacaaaatgctgatcaaattttaaaattttacatttagctaaggatgggactgaaaggaccgtcgctgatacggtggccccaaatgtgaacaaaatgttggtaccgaagcgaaaagtcactgctgacgcattgttggattcttttcggagagaagacgggtgaatgatgaagagcaattaatctctttaatgggccctatacatatttagtgccanaaaagcataaacaa

SEQ ID NO: 30184 - DNA, 1132 bp, Heterodera glycines
  misc_feature (1043)..(1043): n is a, c, g, or t
gagcatcattttttgaaatgccgtcaatttaattttgaggtgccaaatattattatcagtcgcttaatttgatcatttttatttgattttgtgacgcaatgccatttcccattcccccacccgcccaacgtttggcccaacgcggccggcggatttgcaaattgggcaccatccgaaaggccaacgcctcttttatagggctgatgaatccgatcattaaacttacaaaaattaaatgccaaaatcaaaaaaaatatattagatttacgaccgttggtgcgcaattggccaaatgccgttataaaacaacagcaaattgatttataatcattgataattattgtcatttcttgccattattttattgatgccattcaaagtttgattatatcaattattagtgtcactattccagaacaaatcaacgaatttgaccatatttaattttatatttgaataaaaaatacggatctcattagtccacccatatttaatatataattaaaaatattggagacttttcaattatcgagaaatttttggaattttttatgcaattaacagattttacaccgaaattgacagtcttcttgatttttagggaaaatttcgaaaatttccatgtccggcggagaaaaaattatacgttttttaatggaatttgctaaaatttctccgatttgtctcttttttgttcagccgctgtttccgttggtatcattcgttttaattatgtaattaacgcaattttccatcaaatagtcactgatgaatcccttctccgtcactctgttgtgaatatcttttttggccaaattaaatcggcaaaagaatgcgtctaattggtcaatactttcatcaagaaaagccattaataatttgatcatcagcgaattggcctcacaattaaccaattttttggtcgcacggaacacttccacaaaaactttgccgatccgtgcagttttgaattgttggtcatttgtaccaaattcctcattacttaattgcattgccgaatttgaaaatgcgacgaacgctgngacaataacaacgctaaaaataccgaaatatcttctcgtttcaatgaaatcttaatactttttgaacaaaagatcaaaatttatttttt

SEQ ID NO: 30185 - DNA, 515 bp, Heterodera glycines
tttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaatgttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagggcggggggggggcgggggccgaaggctcccgcgggggggggggggggg

SEQ ID NO: 30186 - DNA, 1850 bp, Heterodera glycines
ttgcttgcgcaatcccacaattggcccttaatgtatactttccgttaaaaaatcatttgaaataatactatattaaaaatatatgaattttccttttatgtatatgcatttaatatattttagcaattaaaaagctaaaatctctaaattaacttcaaaagaactaaaaataagcattaaaaattttagtaatcgccgaggcggacaataaatttctgaataaggaacttggaatgaatttaaaaaaacctttttaaaataatatttttttaaaaagatagtctaatttaactaaaaggaaaataaccaactttatttttattggcataattctaataaataattgcatccaaaattgatcagaaattgagaaccggaaaaaagggtataaaatgcttcagaattcgggatactcaaatttaaaattatttttcaaaatttgtactggtcccctcatttgaatgcttatgatttcaaatcctatttatttatccaaacttacatagagcgggtaagcggcggtcctttgatcgtgactcatctaaaacaaaatttattaattaattttaaaaatgtaaaaaaattacatcctgggcgcacaccaactcatggtcagctgcgcaacagccatcgcctttagttccgttcgccgggaaacatttcccagagccacggacgcatctttttttcagaaggtcacagtccgtttcctttttggggatctagaatttccttttttaaatgggtattaaataaatacgatgttaaaaatatcttttaattttttacctcttcacagcatttgaacccatagccggctttgcagcattcgtctccgatggcgccttcgtgaggatggcacgctccccaggtgcagtctttcgggcattcgctttgcattttttggcagcctttcagcacaggtggaggctaaattcagcatttaaacatgcgaatatatatatatatatagatatatttaatggcttttccgctcgctttatactcaccttagcgcagcattgccacgcgtagcccttctcacagcaatcgccgatccgtgttttgaccccagctgacgggaaacagcttccccatccgcagctgcatcctttccggcagacgtcgatgagttggggcgcataaatatagaaatgattcaaaatataaccctaattccccatatttttctaactttttcgcagcaggtgtacgagtagtcctccctgcaacaggcgcttgcgactgctccgggactaatgtggcaggccccccagccgcaggaggtacacgcctttgcgaccgattcgcaatctgtggaacaaattatttatagaaaaattacttaaaatggtttttaatagatactcgtgcaatttttatttttttactcaaattctgatttatcaattcttagtcccaaattgttgtagttttttgaatttattttcatggtttttcaaaaaattataccagcttttttacaattttcgccattgcccattttagcattaattaaaattatttaaaatttaaattgggttacccttccggaatgcttgttcgagcagtttttccgttgcggttttggcgaccatgatgatcaggtctttgccaagatcgagcaggaatgttccgattccgccgaggcctttgagcagcgagaccagcacgttcgtccagtcaaaggatcttttgtggcggatggcaacagcagttgcgttgctagcaatgggctcattgtccaggatgggattgctccgaaataaaaccattggccaggttccattggcaacgttttttccgtgggcattgttcggggcagtggcatttgagccttaattgcatgc

SEQ ID NO: 30187 - DNA, 1110 bp, Heterodera glycines
cccccccccaacccccatccccgcgaaaagccacccctgcccacggggcccgaaccctagtttaatgatcaaatgctacaaatttattttattattatctgtatgtacagctataaaactaatacattgattatgtaaatgacacaacacaaaatgctgagaaatttgcgatattaaaacataatttcaaaatgaggagaccgaaaatgaacgaataatgccccttttgaagtgttaaaaacaggaaataaattgattagcaattcgcacttatccaaaaacccaaaaaggaccaaataataatattaatatttaggtaattgtattgaactgataaatgaaagcataaatatgaaaaaagggtgagattttccaaaattggcaatgtttggtgtaaaaattgagggggccggaatttgaggagataaatgtgagggcttggggcttaggcattcaaaacgcaatttggaggtaaacagtcatttcggcagaaggacgggacgcaacaaagaaaaagaaaacagcgaccgatgatttacggggctaacataacaaaagacaacaaatcgaccaagggacaaaagggcgtgccggtcagaaccgatgcactcactcaatggctcggactgacggggcatcacataattgaactgaaccaaacaaatcattatggacccttcccccttcctaatatctaattaatacatgatgcgcccgcgggcaatttgttcagaaaagtgcaagataaatatcattaaaagaaacacattcacacaatgaatgacaataaaaatgggcctcctgagctgacgttaaaaagaaagaaagatcttatagaaagaacatgtgaaaatgggaaaacagaaaatgaaacaagaggaaaaggggacaatttggggagaaacaaaaaggaaaaactgcaaattatgtaagaggggggggggggggggaaaatgaaaaatgaaaaaaaaaaacggtggacttgataagaaaatatgaacttaaaaacacttgaaaaacaataaaaattcgaaaaaatccatccattctggaagagatgcacattcggaaaacggaaggaagcaaaggaagtcgggatttggtgccgtt

SEQ ID NO: 30188 - DNA, 842 bp, Heterodera glycines
ttcgcttcttcatccaaattcaatcatcctttccccatccattccatcccaggcaaaagtgccaaaattgccaaagtccgagactcccgaatatttcttccatcgcccccatattcgtcctcccatcacatccatccttttcctccttgttcatccctcctttcttccacacaaattcacccatccataaagtatttcatcgttgtgcatttccttcgtcaattcatccaatattttcctcaaagatggaaatgaacggacggcgattccgatggatgggatgaatggggagaggggaggggggggggggacggacggatgaattgaaaatttaaattggaggcggagtggggggaaagagttgggccctgcggggtcggtcggtcgaattgtccttaagttgtaaatcgttggctccaaatttctttcaaaaaataaacaaaaccgtttaatcaaaattcaaatttaagctattaacaatttctttattggccgcccccattaaatgaccgcgccgatttttttaaaaatttccttctcttcctttttcatttcatcgtcatcttctttttcctcttcctcctctctctctcctcgttttctttcttcttccaccgctagttcttcctttctatcttcctcttcccccctcccccttctctctctcttcctcctctatttcttctctttttcctccccatgttcttcctttcttctcttcctcctcctcccctctctctcttttcatcctcctcttccctttctctctctcactctcttcctcctcctctctcttttcttcctcctcttccttcatttcgctctccctcttcccctccccc

SEQ ID NO: 30189 - DNA, 1446 bp, Heterodera glycines
gcggccttcttcatttttgaattgaaaaaaaattggtaattactctttctttttctccatattgaccatcatgctcatttaaaaaacaccctcttcttcttccgccgccctcctctcttgctagttttccctgcaggcggggggcgccactctgaaagaatcaagccaccctccccccccccccccccccataggttttcaccattaaatttcacctttatccctgcgttttttcacctcttttcaccgcttttttcacctcttttcaccgtttttttcatctattgaagaaaattccggccccgtgtgtacaccggtttcgcgcgatggttcgtggtggggtgggcggggttgggggttggggcaattttagggcaaaaaaatgtactaaccactactaatgacattgaaaattgatcaaaagagcattttaaaatggaagaagcaatttgggatggtcaaataattatgtaaaattagaatttaaatattctatgaaatttttattatttcttttatcttcttcaaaaaaagttttaaaaaaattttcccattttgaataattctcaaacaaaatgttgattattgttttttaaataaattattgatttttttatttctgttgataagttgtatttattttcattcattaatttacttatttaaacttggataaatgtgaaagactatccaaagcctaaacttatattagccatttaaaatttttttttaattcattaattattttctatcaaattatcatgatagggcgaggtacgtcagcaacattataaaatagatactaataggatgtagaagagcgtggtcaattttctatttatgttattggctttttggtctgggcgtcaaaatgattataaccaatcgataaaataaataaaatgctagcatatgttaatatgtagcggaatttgtaaagaaaatcagcatagatttcccattaatttcgctctcttctccctttgccgacgaccccgcccccacctcttttacagccactccccttacaacgacttaaacttttttttatgaaaattctaaaaactttttattcatcgacttttcgggtctttgattgactcgaattcgaacaaaaatcgaaaatccaaattttcgaaattagggtttttggttcaaaaccggtttaaattcacggaagcaacattttagaatatttgtgaagaaaatgaaattccgcctattattctttccaattatattttttattatcaaaattcatcaaattaaaatggaaaataaaaaattaacgcaaaaatcatttgatgaaatatttggagaaaaatgggaggaaaaagaagaagaagaaagacgaaatgagcaaaaaaaaagagaattattgtcaaatataatgaaataaaagagaaaataaagcaaaaagtgagaaaattctcaaaaaaagaatgg

SEQ ID NO: 30190 - DNA, 1441 bp, Heterodera glycines
aaaagtctgcccttttttcgatcggaaattcgtccattagtcggaaatggcattgggaaaaatccatcagatatcccatgacaatttggaagggaatggaagtgattaacggcgatcagttcatcttttgataaaacaccagatggaactaaaaaactggattttaaaacttataaaaaattataataaaataaattcgttttttataaaatcggcagctgctcatcggaaaaaattcaaacattttggcttggttatttttaccaattttcttcgaaaattcctcatttgggatcaatggaaagcgaattttgaacagtgccggaccgagaacgacacgacgattccctgccgagcgttcaatgcaattttgacggcacttcgcgtcggcccaacggagtgcctttattaatgagaaataacaaattaattagaaatattacttatttatagtaaaattacagcgttccaaattgaaatttcttcacggattttcaattcttcacgtcccaaaatttcacacaacaaattttggtcaatttgcaaaaattcctccgatttgatcaaatcgtccgcattttcatcaatgtaaaacaagcaatggtaggcaaaatggtctttgattaactcataaatataagcgggcaaagccgcttaaaattcagtaaattcactatttcaatctgtccaacccacctccaattcataaagttcggcctgaacataagccacgaaaacattgcgcagtgatgaaacaggaacttgcaaagatgcgtctaccaagcctgggatattgtactttttggctaattaaaaaaaattaataaattaaatttaaaaaaataaaattcaccggcgtaaagtactgccattgcattgtctccgttcaattcagccaattcgcccgtataaatgaagctcaacatcactttgaacgctgctgcttcaacatcggggacctctacaggataatcagtggtggctaattgaaaattaattaaggtaataaaaagaggctaattttaacttgctgaaatatgattaaaatatctaaatatagaaaaaatggtatgtgtaaaactgaacataaaatacattcctaaacgcttcaaactaagctaaaaaaaattatttaaattaatttttaagaaataaatgtgaaaaaatggaaatacataaaaatccggtccctcattaatccctaattttaataattttaatagattaatattccaaatattttttaccattttctgattttgcattctttgaatcaaagcggaacattgcctcaaatacttcggacgcgtgcttcaaaatgagtttatgtgctggcacaagcttaaaggaactaatgtagaaaaaaaataaaatacataaaataaaattaattaaaattatatagaataaaattattcattcttcaaaactcgcctctttt

SEQ ID NO: 30191 - DNA, 1018 bp, Heterodera glycines
tttgttatatttttataaaattttaattattttttccgttttacgcacatccgaccaaactgacaaattattgtagaagatattagccgcaagaaataaaaaattaaaaagttaagaaatttgtccgaatgcgggttcgggcttcgaaacatggattttttgcacaaatccgaccaatttcagtcctaaacaggtactcacgcgaaaacgtaccccacgcgaaaacggccacgcgaaaacgtacccacgcgaaaacgaccccgaccgattttgtctgacactggggcggtaggggtcaactccgtctggccaactccgtctcaacatcgttcaaaaagctataacttttatctttgttggccaaacttcacaatcatggtatcattcgaatgccctagatgtttagaagatatttataatctatttctcagtgattaatccgctctcaaaaaagttgtcagttgaaaaccgcaaaaaaggcagaattttcgaagttttttatttcaatctttttttatagttcgaaattttctgtaatttttagtaggctaatagagcctgtgaagagctttcgaatgatatcaagattgtttgattcggtcaataacttcaagagttatattgactaaagtttgctcagacggagttggccagacggagttggcccgttccgcactgggcatagcggtaggggtcaactgcgtcccgccaactccgtcccagacatgtttaagaagccataacttttttttcagttgaccaaacataacaaccttgatatcctttcaaagctctggatgtttagaagatatttctaagctattactaagcgattaagcggctcacaaaaaagttgtcgcttgaaaaccgcaaaaaaggcaaaattttctaagttttttatctccatctttttttacagtgatatcaagattgttggattcggtcaacaatttaaaaagttatgctgttcaaaacttggctgggacggagttggcgggacggagttggcccgttccgc

SEQ ID NO: 30192 - DNA, 791 bp, Heterodera glycines
cccccccccccccccgaatgaaaaaccaaaaatttttcaagcaaaaaagggcaaaatttctgaaaattttacacattttcttatcatattgcatttaattttccaaaaattctttccggcggcgcctatcggcacggcaccgccgggccccaattggatcattatttttttgaaaatttgagcccaaaatggaaaatttgttgatttttcggcgcaaaaccgataataattcctgttttttggctccggcgctgaagaatttgaacataacactggtgcaaaaaatttttgttgcaaaaaaaagctcttcgcgtgccctccccgaaatttttttctggatacgggcctgagcacaaccaattaattaatgccaattaattaattattattgattgattaataattagtgctcgaaattatatggttttacatattttttctgcgcatatgctataaagaaaggggctcaaaaatagtatttctacgataaattttttgaattggtgaaggcttttagtccatataaatccatatttttggggttttcgggaataaatcaaatatatttcgacatttttgcgtttttagtccgtattttggccatttttaggaaattttctcaagaaaaatgcaataaaagcgaaaaataaacccctaaggatcgacgttctggaaatttaaaaaaaaatacacacacaaaaaaagaggaatttttttttgaaattttggcaaatttttttaggtattttgttcgcttccgaaaaattttgctgacaacaaaatgagattat

SEQ ID NO: 30193 - DNA, 1076 bp, Heterodera glycines
ataaatgcagagcatttgatcgtatgcaaaaattcctgaaatttttgttgaaaattttaatcaaaaagtgctacaaatgcaaaactactaccaaaaaattctatattttgataaaaaaaattatgatttcattgaaaaaattcattaaatgaatataagcaattagaagcgaaggacttgaaaaattataaaaagtacatcaaatgcgtaaccaattttttctaattagccaattaacctaaacaaccacctgcaataaagccgacggcgaaatgggcgcgaaacagcggcaaaacgttcaaaactcatcactgtcagaatggcgacggacaacagcttgttgatgttttccaccgtaaaaaacacctacaaaaattgaatttttcagtaaaaaatattttggccaatgttttatgtcaaaaaaataataattttaatgctcactttgcaaccgaacagcccaaaacgccaatggccgtccagaaagtagccaagcaacattggcaccatgcacaacacctgcggagacaatgaataacgcaatgccaatttaaaaaataaataaataaattattttcgccaaattacattgacttccttttctcgattatttatccagcaaataaagtatgaactttatttgattatattaaataaacaccaaaataattttgtttttttaattgaaaattttctgaaattttaaaaacatggaaaattttcctgaattctcggatctttctattttaccgccggatatttggaccccccaaaaattatcaaaaatttaatttttcatatttttggctggcaaaaccatattcgatttggtcaaattttcatatttttttgacaagaaccctagcttcaaggtgattaaaagtatcgaaaactgtttaaatgtttagcggagacaaatttccgggattataaaatgctggggactcaatgtcttgcgtccaaaaatggcattaaatgcaaaatatatatatatatatatatatatatatatatatatatatatatatatatatatatatatatatatatatatatatatatatatatatatatat

SEQ ID NO: 30194 - DNA, 1083 bp, Heterodera glycines
caactgttgcattttcgggagtcggcactttcggtggtgttgtctcaggtagtcctcggctcaagaaatccgttagatttcggatacttttgttcaaacataagtccggtttcaaataagaaactggcctaacgcactgcaggtggtcggggcaaatggaacagtcaaatttagtccagcctttcattttttggtgaggaattttgaagaatgttgtccaaactatgacgatctgggccatatccccccccccccccctccccattggtacaaccccctgaccgttaatccgcactactttcctaacaatttatttattcacatctgggcattttcgctatgttattattagatgtttatcaacacatagtaaaacggccgggtgtccaacccagagtttaagagagatgcccattaaggaccatggaggaagtgcagaggaatggaagagggaaagagaagcgggaattggtgggtgaaaatccgggccctggactcccaacctcccgggtcctaagcccaaatccgtccgcgtccggaccaataataaatcggcggagaatgatcaatgctttattggaatagcattaaaatataatggtcgacggataatgcacaagttggccaactgatcccgagtgtagaaagtcatcagtttaaatagacaaatgtgaagggaaaaggcaaaggggcggaacaacagcagaaaagaaattggttataattgaaacagatgaaacattgtggaatttgcaatattatggcagaattttctcaatggaaaaatcatctgatagggaaaagacacagaaacgcgacatccaatctcatttatgacttgacaagacaattaagtggtgaaatagattaaaattggattactaaattttgatattcgcttttgatcaatatgtgaaattgaattaaattatctggattttttatcgacttcattttttaatcattcaatttaatagacaaaatgtcattagagccgacttcaggaagtgccgagcaagaaatgccaaatgtaacgacagaagggacaacatcaggtcgtacgaggaattacacaggtagaca

SEQ ID NO: 30195 - DNA, 1342 bp, Heterodera glycines
  misc_feature (1287)..(1287): n is a, c, g, or t
aaaatggaatttatttcaatttccatccaatttttaattgttgcttcgcttttatgcgttcccgcaattatgccaatacaacaaaaacaccaacaagttgctcggaaactgaacacatcaattctaaagtcgctcaatgagcgtttatacccgcaaccgtgggtaagaagaaataaaacaaaatgccaaaatcaaaaatcaaaaaatagtggatgggaataggccgaaatatgcatttatagccccatttattactaattaacttcaggaattaaaatggcgcaaggtgaatgtgtcagaaactgaccaaaacggtttcattttgacacgtaagaatagtttttttaaactaatatgtcgaattttctgttatattttagcgtgctttcatgatttggccgaattccccgcggcaaatttgttcaacaaaaaatttcgaattcgaatgaaggccgaacttgagcaggagcagaaaacatgtaatttagtaatttaaaaaatagaaaattaaaaataataaaaaaagaaaaataattaaataaaacaaacgcttgaaagacattgtaaaattgaaaaaaaactattattgtttttccaattttaggtcaaattcgatttccgactggcgttcgtctccgttatcggtttcgcttcgttaatcccaatgtggccaatttttttattttacttattttttaaaaattctaaattaaatcacgtaaatattcaaaatatttttgtaattcatcaaatttccattttttcaaattttccatccattaattttcccgagttcgtcagactcaagtcttttttacgtatggcagctcaaaggaacgaatggtgttcttttcgcggaaaatctcaacttttgagccgggacttcccgataatatttggaagggtaattaattttaaggataattaattatttttaatttaataaatattttcaaaacatttttaggcattattcacatcccatgcaaattttctctgctgatttttaacccatttgtggccggcgaagtgttcgaatttcatattctcgacggcgttgaacatttggacaaatgctctgctggttgggactaaatgggaaagaaaatcaaaaatttaaaaaataatataataattttaagtgaaggaatgaaaatgcaattaattttaattatttctttttaatgagacgggtgtaatggttaatgaacagagtgtgtttgatgttaattgaattatgaagaactgcgcatttatttgttcattaattattttgctccgcaccanatattttttctccaaaaataaaaatggaaatgatcaaatttattttttatttttt

SEQ ID NO: 30196 - DNA, 1065 bp, Heterodera glycines
  misc_feature (976)..(976): n is a, c, g, or t
  misc_feature (1034)..(1034): n is a, c, g, or t
agtgagtaccttcggtgcaggaaaattattaaggaagagagttcattatttatttgttttttgcataattaattcataaatatttttttcagaaactgctctgaaacgcaccaaattttatttgcaagttattttaggcactcagatgctttcactatcaaaaagggagatgaataaaaaatctaaaaatttttaattgctttttaaatatgcgaaaaattttaggcttaactttttttttataaactggtcagaagcgaaccagattttgcgagagcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattttttgcaaaattaattcataagtattttttcagaaagtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctngaaaaatgcccacgcttgttgtttttaaatttttcgaaatctgacttttcattacttnattattattttgcaaaattaattcataaata

SEQ ID NO: 30197 - DNA, 1475 bp, Heterodera glycines
tcaaatcgaaaaattattatgtaatttaaaaaatggatttgttatttttttaatagattagaaattttttatttataaaaataaaattaattgtccacaagattatatccgtggtgtcgatgaagataacgtatatagcaacattttatttgtttattttaaataatgaaaattttaacttgaattaaaaaaatttaaaaattttttatttaatgaaccataaactcatacatatatgataaagattgaatgtcaatcatattaattttaagagttcggtttaaatcatattattaattcagcaaacataatcgtcgatcaacaaaatatttatcaatttatgcgtaaatgatttgttaaaaaccatatattttctttctcctgtattatttaatattataacctaccattttaactcaaatttatttttgaattctttattttcttatggtagtattccataaattttctttgcagtaatgataagcataactttaattttgtaagaactgataataataaaatggtatgctaattaagcaattgtgattgtttgattaataaataagtatattttaaatgggtttgataggatacatgaatagtgaaaatttatttagctttatgtttgtgaaaatttaattgaaaaatatttttgtgaatgtttttacacataaatgtttttttttataaattgccatgagctatcaattagagtgccacgggaccgggaatttttgccaaaaaaaaattatttatttataaaataacctttaattcattgctttcttatttaagtaaatggaaaaaatggtattaaattgtaaaacaaaaagccaaagtagtatttgaaaaaaaaagtatttcaattttctattcttgaaataaaactattattttaaatttaaaacatatattacagcttcgaatccttctgcatgagttgttataatagcattaagcaaaagtccgaaaagagtgaaataagcagcacagacagtcaacgaaaaaaggttggattttgcagattattaagctcaattcggcaggattttcatttaaaaaatgataaaatatgtatcaatttaaaaaaaaaactatgaggaatcatattttctttataggaaacccacgagcatacaaaaaaaaaattgaaaataatctaatttctgtagagggattgaaccaggggaaagaagaagggaaagactagccattatgccatttgcacacttgggcaatgttacttttaaagaatatattaatgattatcttttatttttccctttgactcccaattacttaaataatttttcactcatgacaccattcttagcagacgcttgtcctctcatctcaccgcatgccctacccaaacattgaccgggacctgtgatgtttatgacccgaaaacgacaatcggaagtaaaaattttgaagaattttcctgagcacaatttactgtgagctaccga

SEQ ID NO: 30198 - DNA, 1719 bp, Heterodera glycines
ttgtacaatatgaatcaaaactaacaaaaaaaggttatgcctttaatgtccaatggatgtaccgataagtacaacacaacaaatatttttctgttagcaaaatatctttacgcataatcacaaaacaaaaaaggcaacaataaatggagaaggcccccaccccattcatatgatgattgaaagcattgaaacaaaaccgatggcacccccttccccaattagtgccatccttcccaatcaatcaatccaatcaaacagcacgtccattgccatcatctccagcagcaaatcagtgcttccgcgcattgtcctcacttccgacctcgtcgctgtccaattggacgtcgcacaaaatgggcaaatggtcgctgggcgcaattggagacggaagtgcgtcgtatttggtgaccagccgatggtccggcattggccaaatgtgctcaatgcgcagcggagggtgggcccaaatgtaatccaagcagccgttgaagcccagggaggagccggggggacacgtgaagttggtgtagtcgggagaaccggacagaagttggcttttgaagggcgctaaacagacggaatgccaaaaaaattcaaccacgacaggggaggaagggccagggtttcggtgctaatcactcagcttggccagtcacctttaactttcagagattcagcgttagtttcgtagtttttttcgtctggtttcatttccaaagtttggtcgtcgccaccaatcaatgcaattgggcgactttcgggagtgctgaaaaagggcgggacaacaaggaaacgaaacttgcatttaaacaaaatgaaaaacactcaaaaaaacgacgaacgaactgttcgaatttgacgatgcccaattaagcattcgactcacctgttgaaatcgccggcgaatatcacttggatttggcacgacgaatcatttgaaagttgcgcacggattttgtcaatgtaccgaagacagagaagggtttgaatgattttcttaaaaagaacgacattttaagaaaacaaaacttttaccgttttcttccataaaaaaatgaaatatttaaaaaaaatttaaaaaatgagcaaaaaagacgaccatcaatatgggaaccaaagattttgaatttttttttattcaaagacaaattgaagaagcggggaatgaatggaaggctaacaaagccaaatgaaagcaccgcccactgaccacttcctcgtatttcgggtcataatacaaatgcgtgtttgcacacaacaattgttgtcccccatgtttagcacgtagtcgaaccaacttaaaaaaagtggagcaattttaatggcataatccgagatttgatcggacttcacaaccaattttatttccgttagatgatgaaaaacctgaagaattgtcggacgtgaggtgattttcttgcgcagcatttccctatgcctcaaatacgagcgaatgtccgaattttcggtgtcctcctccaaaaactgtgacaatttgaccgtaaaattgtccccgtcaccctccgccagcgaatggaaatggtcgttacgaaaagcgatgagaaggcctagcgaaaaagcaaacagtcaaaagtgaaaagggcaaactcagtgagtttcaacggcacaccttcgttcacttcgttccctttgcaattaaaaacggaagaataattctaaaaaacaaaacaaaatcaatttaaatgcacaaaaagccaa

SEQ ID NO: 30199 - DNA, 868 bp, Heterodera glycines
attagtatggtagtccaagcctattattattttttttgactagtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaacctatttttattttttttctatctcttctctgaaaggagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaccctatttttattttttttctatctcttctctgaaaggagttataacaatttttcacaacatttttgcatttaacagacacattctaaaatttctaattagtatggtagtccaagcctattattattttttttgacttgtctctgaatggggttatcccagttttagtatcctttttgaaaaacaaaaaattttaataactgatacgg

SEQ ID NO: 30200 - DNA, 184 bp, Heterodera glycines
cggggacctctagagtccgcgctaccgggggtcggggctgcgccaccaccagtcgccaaagccgccggacggaacgattacgatcaagtggcagccggacggcacccacgcctattcactttcaggctcgtacgcgttatcgcgacagctcgccgttcaggcgttagtcgaggtaagcgctgag

SEQ ID NO: 30201 - DNA, 938 bp, Heterodera glycines
  misc_feature (882)..(882): n is a, c, g, or t
gttacggtgtacaatcaaaaaatttcggtctcccagaggaaaattatttattgacctttatgcacaattttaatcataaattaggatttaattgtacctcattactaggacgctaaggttctaaaaccaacaaaatcacttttctagtgtcgaattgccacaaatgccggcgaaatatttcgaaatgtttgcgtaaggctagaaaaacaaatctatttgattctttagtggttaaaatattacgagtttttactccaagacgttagagggcaatttgaataacgaactcataatctaattgcgaatgctatctaattaaaggtagcgattagcagcagaaaaggttcgtaaatactgataggctaattttgccaaggattatcgtcctattttggacattggacttaaaagggttacggtgtacaatcaaaaaatttcggtctcccataggaaaattatttattgacctttatgcacaattttaatcataaattaggatttaattgtacctcattactcggacgctaaggttctaaaaccaacaaaatcacttttctagtgtcgaatttccacaaatgcaggcgaaatatttcgaaatggttgcttaaggctagaaaaacaaatctatttgattctttagtggttaaaatattgcgagtttttactccaagacgttagagggcaatttgaataacgaactcataatctaattgcgaatgctatctaattaaaggtagcgattagcagcagaaaaggttcgtaaatactgataggctaattttgccaaggattatcgtcctattttggccattggactttaaagggttacggagtacaatcaaaaaatttcggtctcccacatgagaattatttattagactntatgccgaattttaatcataaattagggattaattgtacctcattactcggacgct

SEQ ID NO: 30202 - DNA, 1193 bp, Heterodera glycines
ccccatcaaccccaatacaactgacgatcgcgaagcgacgcacgcacgcctctcctatgcatctacccgtctgccaatgacctattttctgataaaaaattgcttaacttccatagaagggctgaatgaagactaaaaagtgattcaaaacaaatttacaaatatgaaaaaaacaatcattgtattcaaatttgaatgataagtaaaaatagccaaataaaaatgaaaaatgtctgaccaaattaaaattgaaaaagcgaccaaaaatttaaaacattttcacaactttcggtttcaaaactaattaatcaatatttagttggtgaaaaaaaacattaattaatgattacaaaattcttaggcaaatatgaaacgaaacattcaatgccggcctaaaaaagacacgtggccagcgatttcgcaattgtctcgagggtgaatgaaaaggggtgccactccggtgccggtacggtataaaaaaaggcacgtgaccaacgatttcgcaattgtctagggggtgaatgaaaaggggtgccactccggtgccggtataaaaaataagcacgtgaccgctttttttttggttaacagaaatggtcattcattcggtgccaacctaaaaataggcacgtgactgctatttcgaaatatctggtcacatgacccggggacgcattcggtgccagcctaaaaaataagcacgtgaccgcgatttcgtaatgaccacccaaaatttaagtgggcgtttctttcggtgccagcctaaaaaataagcacgtgaccgcgatttcgtaatctttggtcacatgaccacccaaaatagggaggtgtgtcatagggtaccattataaaaactcgagatttcgtaataactggtcacatgaccagtgcagtgtaaattggtgcaaatataaaaaatcgtctcgtgttttaatcacgtgactatgacccgccctatataaagcgatttgagccagaccgaaagttctttcaaaatttcattttagccaagccccaatgttttttcaaaattttcccttatctaattgcaatcctaatgaatttggaggccgtcgttattaacgacaaaaaattcaaaaatttgaatgcgataggcaacaaaattgtggtccctcttcaaggctactttttatgtaagtttttttttacgcgcactgccaatggacgcctgc

SEQ ID NO: 30203 - DNA, 1046 bp, Heterodera glycines
acacttccgacaaagaacaattgcgaaaggggaaacccgttggagcaggaacaacggtacttgaccagccaaattcgcaacatggaggacatctgccgcagaaaaagaaagcgaaacaacggcataaaagaaaaaaaagaggcaaaagaatggaaagaattttgggtacttttggctcaagacttaactcaatgttttttcctaattttccaaaaaaatcatttttttcaaaaattttctggagaatttatgtagtataaattttacattttcttaaaaattggtaggtttgttcaaaatatgtaaggaaaaaaatggaaaatttcaattctttagttggtttcactaaaaatactgaaataaacttcaattcgggaaatttaggtcgcatatttttcaattttgtgtgaaccggttatgcggaaaatgaaaagcgctacgatatatgtgtacgatacggtagtgcttaattgtggtattaagcgatggtttagaaaaaaacattttcgctgatgagctgtgcaaccaaaaccctccattaaagcgtcgattgctgaaccattggacgggttatagcaaaggcggggggggggggggggaaggaagcgggtgagcagagcacgggcatcgcatccatcaagggaatgcgcagcttcatcctaatccggttcaagcccctaattgttgaggcgcataaaagggttggcggagaagccgtccttccagtccgtcctttgcttttgcttcgccgccggcggtgtctctccgccgatttttgcctccctttgcatttctccccattaacagtccgctgattactcccctttatcgcagaggcgagaaggccatcaccaccgcattgtccttccggctcgatcttcgtccgcctttcccactgcgactgactctccgcccacagaccgtccgtcgtctgtccgtcgcttagccaatggactcccagcagtgaagcatgaaagagacggatgagcaccgtcagatgcgccgaaaggcttcgttgcggtcgttgtttcgacggtgcgaaaaag

SEQ ID NO: 30204 - DNA, 2331 bp, Heterodera glycines
  misc_feature (2244)..(2244): n is a, c, g, or t
  misc_feature (2308)..(2308): n is a, c, g, or t
ataaaaagtgtattatattttaaaaaatgaaaaatataacacatcgattttttatctattttgaataaaaacaattccttaattaccgtaaatgcaatatttgaatgcccactttctaatctctgttgtacctcttttaatctctgttgtacctcttctaatcactgctgtacctcttctcatcattgttgtacctcttctaatcagatttgtaccccttctaataatgctgtacctcttttaatcactgttgtacctcttttaatcactgttgtacctcttctaatcactgctgtacctcttctcatcattgttgtacctcttctaatcactgttgcacctcttttgatcactgttgtacctcttctaatcactgttgcacctcttttgatcactgttgtacctcttctaatcactgttgcacctcttttgatcactgttgtacctcttctaatcactgctgtacctcttctcatcattgttgtacctcttctaatcactgttgcacctcttttgatcactgttgtacctcttctaatcactgctgtacctcttctcatcattgttgtacctcttctaatcactgttgtacctcttttaatcactgttgtacctcttctaatcactgctgtacctcttctcatcattgttgtacctcttctaatcactgttgcacctcttttgatcactgttgtacctcttctaatcactgttgcacctcttttgatcactgttgtacctcttctaatcactgttgcacctcttttaatcactgttgtacctcttctaatcactgttgtacctcttctaatcactgttgtacctcttctaatcactgttgcactcttctaatcgctgttgtacctcttctagggcgcgaagcgcccgcccaagcccaataaaatttgaaaacgggcgcgaagcgcccgtctgagtccaacaaaatttgaaaaacggcgcgaagcgcccgtatggccaaaacaaatttaaaaaacgggtgcgaagagcccgtaagaatccgactacattattatgggaaaggaataaccctgtacctctatctgatccatctgaatagctacagaaggagcatttactcgacaacccttgaatattgcactttgacgcactgattgatttgatattgaaaagcaaatcatttagagaaaaactcacagaaggtaaaaattaaattgccataattaaaaaatatataattttttattgtcaaaaaggctttgataatgatgaaaatacaaaacagcgctttttggaatttgtcctgccaaattatcaggaagcggtgctgaaactgctcaattctggtgattttgctgaatttgagaatgaaattgcattgaaaatggagcaggaaaatggagaaataattgaaaaaatggacaaagaaaaagcaaaagccgatcagaaaatgaaagaactgatcggggaagaaaaaaggacaaaaaagaaaaacaaaagagcaatgaaaaggaaacaaaggcaaagatcagcagctgatcagaaagagggagagagtgagcagaaggaggagaaaggaaaagaaagaaatagggaagagagcgagcagaaggaggagaaaggaaaagaaagaaatagggaagagagcgaaaggatcagtgaagagagtgagcaggaggaggagaaaagaaaagaaaggacagaagaagagagtcaatggaataccaaagagagtgagcagaaggaggagaaaggaaaagaaagaaagggagaggaaagtggacaggattttgctagagaggaaaacgacgtggaaatagtgaatgaccaaaatggtggtgagagaaagcaagcaaagaaaaattgtgaaaacaattcaatggagttaagagaaaaccaagagagaaaaattagaaaagaaaagaaaacgcaaaaaagagagagtgcgcaaaaagagttgaaacgaaaaaaagacaacgatggaaaaagtgagagaatcagtgaagaaaaaattgaagaaaaaggcagaaaaaacaacaatgagagaaaggagagcagagaaaaaaatgaaggagagagtacgcaaaatgagaggaaaagaaataaggaaaaaagaaaacagaaattgaaagcattggaggaaaataatgaaataaacataaatagttggaataaaacagcaacagattcagtgacaacagaagaaagtcaaaaacagggacaagaatatggagaagagacaatggaaaagggaggaaaagcatncgcagagaaagaaagggaaaatgccatcgaatgatgggagcgaaattggcaaaagtcaatttgngaagtaagtaattacaattaaaa

SEQ ID NO: 30205 - DNA, 1172 bp, Heterodera glycines
gggagaggaagcgaatggcgcgggctcggcttggcgtgatgcttgcgtagacggaagagttcgccaccgctggctgctgtttctgctgctggtaccccaccccttgggcgtcgttgtgccctccccacgcccaccgcagctgcccccccccccaggggtttgcctttctctcccctcttcccccaacttctcccccctcgcccccccccccccaattccgccccgagcactgctgctccgctcttctgctgctgaaacaaccaaagaacggtgaaccgggggttgggatgggtgacgacggaaggggaggaaaggacgcccaccacccatatttggggtgggggacagcagcagcagcgggaggggggaatatggaaagggtataataaatataatatggagatgatgatgatgatgatgaagaggaagggaacgtggaaacaattatgggggaaggggcgaggaaggttgaagagaggagaggagagatgctttggtgatgattataattaataatgatgataataggaaaagagagagagaacggggcaaaaaggaagaggaaagcggagagaaaggagaaacaaagggggaaaaaggaagaagagggtggagagaaaggagaaacaaaaggggaaatggaagtgataataaaatgagggaaagtggaagtgataaatgtgataatggaaaagcagagagagagagagagggacaatgataaaggaagaatgggagaagcagacggggggggggagaaacaaagcgatgaaaatgtaatgataattataacggagaaaaggaaggttaaaatgataagagagagagagagagagagagagagaaaagaaagagagagagagcaagatagtgatagcataaagagagtaaagatagagtgataaaagaaggggaaatgccgaaaaacttgaaagttatttgaaaaacaaagtgtttggatggagtacggcatttgaatcaaaaagtaagcaaaaaattaaaaattgagaacggcactttgcacaaatgcaactttaaaagtcgtaaccgtgaaaataattttggccatgaatcaccaccacactatcattcaacaatgtctagcatagcaaagaatctcccccctccccctctttttatgctttgtgtttgtgatgagtgtgacgcgttcg

SEQ ID NO: 30206 - DNA, 1142 bp, Heterodera glycines
  misc_feature (486)..(486): n is a, c, g, or t
  misc_feature (501)..(501): n is a, c, g, or t
  misc_feature (504)..(504): n is a, c, g, or t
  misc_feature (510)..(514): n is a, c, g, or t
  misc_feature (516)..(517): n is a, c, g, or t
  misc_feature (531)..(531): n is a, c, g, or t
  misc_feature (533)..(534): n is a, c, g, or t
  misc_feature (537)..(537): n is a, c, g, or t
  misc_feature (539)..(539): n is a, c, g, or t
  misc_feature (542)..(542): n is a, c, g, or t
  misc_feature (544)..(544): n is a, c, g, or t
  misc_feature (546)..(546): n is a, c, g, or t
  misc_feature (551)..(551): n is a, c, g, or t
  misc_feature (554)..(554): n is a, c, g, or t
  misc_feature (565)..(565): n is a, c, g, or t
  misc_feature (578)..(579): n is a, c, g, or t
  misc_feature (584)..(584): n is a, c, g, or t
  misc_feature (587)..(587): n is a, c, g, or t
  misc_feature (595)..(595): n is a, c, g, or t
  misc_feature (622)..(622): n is a, c, g, or t
  misc_feature (635)..(636): n is a, c, g, or t
  misc_feature (643)..(643): n is a, c, g, or t
  misc_feature (1134)..(1134): n is a, c, g, or t
gggggtatcgcattacaaagcatcaaaaaagcaaaaagggaaaagccgaccaaaaaaaggtaaaatattcaaaacagcgaccgactctcattaaatgataaaaaagcaaaataaaagcgaaaaaaagtgtgaaaagtatttgataaagtaagcacaaatgcataatttgaaattgttgatcactcggaattaacacgaaaaaactcatattatttactaaaatagagccaccccccaaataaagccctaaagcgcccttatgaaggaaacgggggatttattttatagaacacgtcaaataacaaaacaattcattagcatgaaaaattcacattcaacaatttaaccattgacaaaaattgtcaattaccgtatatgctctaattatagcccagtctctattaatcccgcagtctccaattatccccagtctacgaggtgttttgaaaaataatccctctatcataatcccccagtctctaattntccccccttttctgnggnggttgnnnnntnntcccccctgggctntnnttngngcntntncggtnttntttgtcccttntttctcttggccnntcccncgntccgctgnctttttccctttgctctgttcctccgnttttctgccggcnntggcccnttcgccccctttgccccctttcgcttcactttttctttttcattttcttttttccgtctttgagtgatgtttcattttgagattgtttctcaataaatgtttatcattttctctttttgtccactgtctttggctttccgttctgattggattgataagggaaaatgcctaattgccttggtagttcagtggtaatgaactgccatatttgggcggatgcgtgagttcgattcccacccgtgtccttacttttttgtttttgaacttaaaactgtgtcagtgtccttattaaattgggagaatgtcagcttcttccactttcactcttttcctgttcaatggaattggaagtatttattttttaaatcatagggacagacaaagcaaatgccaacgaatgatcagtcacctgatcagtcatcagtcattctttctttctttcccatttctcttttatagtgcccccttttccgtgtgtttatattccccgngggattct

SEQ ID NO: 30207 - DNA, 949 bp, Heterodera glycines
cggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttgggtatatcgttttgcttttggtggggtgcttggaacagtggaatcatgcgcacccgtccgatctggcaagtaagcaacgattgctgactagccaaaaggttcggtgccgtgatgaaacggaccagcactgcttacccccgcgcacccggcacggtcccc

SEQ ID NO: 30208 - DNA, 1167 bp, Heterodera glycines
ttttggattcggaaccaaaggggggtgcacatgttttttgagtggaaaaattttttcacccaaaatcttccaaaaatatgtctttaggggttatttgggccgctgatcacgaatacgtgatcagattttacttttgacatcgttaagccctcggaatccccgtttgattggggattctgaggcatcatttgaggggggaggggggggcaagttcgaagccgggcggtgtacattatttttctgtgcattttttgggttaattttcattacttttaataaatttaaatgtttggttttattaataataaatttttttagtttaattaaattattttttgatgaataatgattttcatttaaattatttattatatttaattaaagaatttcagctattattttaaaatttaattgtaaaatttttttcatttcaatttaaataactattcaattattatacatttcataatttgtttttcattaataaaaagtgtattatattttaaaaaatgaaaaatataacaaatcgattttttatctattttgattaaaaacaattccttaattaccataaatgctctatttgaatgcccactttctaatcactgttgtacctcttaatcacttttgtacctcttctaatcactggaagcggcctaaaatcgcggataattttttttaattcccaattttggggggggggcggcagtttcgaatccggccagtgtaaattattttctatgactttttacgttattttcaatgtttttaactaatctgaagatttgttgtagattatttttaaaaaattttttacattttgtacctcttttaatcacagttgtacctcttctaatcacttttgtacctcttttatcacttttgtacctcttttatcacttttgtacctcttcatcaaatttgtacctcttcaatctctgttgcacctcttctaatcactgttgcacctcttttatcacttttgtacctcttttatcacttttgtacctcttttatcacttttgtacctcttcatcaaatttgtacctcttcaatctctgttgcacctcttctaatcactgttgcacctcttctaatcacttttgtacctcttttatcacttttgtacctcttttatcacttttgtacctcttttatcacttttgt

SEQ ID NO: 30209 - DNA, 1075 bp, Heterodera glycines
tatgagatcgaattgaaaaatagtcaaatgagtcaacaaaaaaagaatgattggggtttgtatgtgttgaaaaattttgtatttttttttgaatttggggttgcttacacaccagggttgttccgggttacccgaaacccgatacccgaaacccggcctttttctcgacccgaaacccgacccgatgatttttcggccgacccgacccgatatttttctcgacccggaacaaccctgttacacacaaaccccgaaaaccttgaaatcagtgaaaattttggttcatctgtcgtccaagttcatgcaattgggttgaaatggtgttggcattaggcggatggttggtcattccgttgcgtttggcctgtctttgttcgtattccgcctggagttgttcacggctgagagacgggcgaatcagcaaacggccccagtttggcagagaacggaggcgaatgcgctcctttttccagccgccgagggcgatgtgctgatggaccgacgcgggcagcaccactttgagcaggcgtggagaggcacggtgaacatagggtcggcccattcggtaggtcgtcgttggcaccgccacaacacccaattcgtccaaaatccccgagacaaccttttgatcctcgcgaacacgctccgaaggacgggttgaagcgttctccggaagaccgactatgaccaaggaacggcggcgttcctgttcctcggcactgttgttgtttgcgttgttgttcagaccatcgatgacgtgttggcacgtgtggagggtagtaagcaaaacgccaaactgaagtttgacggcctgtgaaatgtcgtcctgaacaagcagtgcgttgactgcagcagaaagtgagtcgatttgtccagccaaagcgtccgcggaaatacgtgtggttttggaagaaggcggagttgctgttgagtccattgggcgtttcatgattcgatgtagaacaaaaattaggaagaaatgaaatgcaaattgtgtcaaatcttaattggacaattacttgaataggcacaaaatgccataaaaatgaccaaaataggcttagaatcaccattt

SEQ ID NO: 30210 - DNA, 1069 bp, Heterodera glycines
ccctatcatgctcgagagcatttgtatgtgtactatatttatcaaaaaaagagatagccatttttctgggataacctctaaatataaaaatcctctgtgaaataaaatggcgattgtgcacagccctccgtctctacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctctacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctctacgcaagcgcttttgtgaggtataaaatttctcaaaaaaagagatagaca

SEQ ID NO: 30211 - DNA, 1159 bp, Heterodera glycines
  misc_feature (21)..(21): n is a, c, g, or t
  misc_feature (39)..(40): n is a, c, g, or t
  misc_feature (46)..(46): n is a, c, g, or t
  misc_feature (64)..(65): n is a, c, g, or t
gaggaaatgaaatggaaacanttgtcgcaatattacacnnatcganaacatcaataaaattacnnaacaaattacattttttaagtcataataagtccattaagatgaagatgcaaagttgaaaagtcgtcagtttgacattgaagcgatttcaacaaattcgacgacgactcgcgaagatgccatttccgaagaacaaaaagccgaatcgcagcccctagtggctaagaacgcttcgaaaaacgatggacagaaagaattacggtccgagcatttgcttctcttggacatcgattttgcacaaacaacggcacaaagtccgaatgaggagggggaggacaaaatgaaggactaaaagcacaaaagcaaatgcttaccaacaaaaatatagaatttttaacttccagttttccattgctaatgtgatcttacaaattattgcagttaaatcatttgtgttttttctcttctgtaaaaatatttaccatattttttcgattaccatactccgttcgattagaagagaacttgttcaatgcaattttattttaaaaatgacattacctcggaaatatatttttaaactttttggtttcatagctagcgtacagtcaacagaacagcagcagtgtcacactgcataagaccttcgaaaaaacactcattgtcaggtgggtacattttaatgtcactacaaaaaaaaggaaggattgggaaaaacataagatcggatattaatgcgcaattgtatttttgtgtgttggcatcgcaaaaacggcacagtcaaagctggccattgcaattttcctcaaaaatttggcagcaaagcgtaggcacatgtgggacagaagcgagcaatttgcatgcctaaattccatttatggaatccattttcatggcataattgaaaaattggttatcaaaaaagttaattattgcgaatgtttgacaatgtccgtgcgaagttcgcttttgctacctttccgagttgttgctccatacgttcgtcatgtttgtcagcccattcgcgtactctgcccaaataattgtccatgtaactcttgcaaatgggcaagtcgggcctcaatgtttcgcatttgccttgggaagttgggagaagagtgttcactgatttcaatttgcttctcactctttgcca

SEQ ID NO: 30212 - DNA, 2066 bp, Heterodera glycines
  misc_feature (1968)..(1968): n is a, c, g, or t
ttaaaataatttttttgggtggagcccagattctccccttttaacgaatttaaatgaccatttcttgttttgtttttctcttttaaccgaatctcttcccacaaacactcacttggtaccccgccttctcccgatggtccaaatatttcaaagtgctttcgatgttcttcctgttgattttgtacgcaataccccagcaacttccactgacatcgggaaacaaactcacgacacggccaggctgaaacaaatttatctgaatgatatttgatgaagtgttacgttgtcgggggtaccccgatggtcaggcgaaagatgccaaaatctgcgaacgtatccaatcacaacgccttgaattgcttcgtcgtaaaggaaatttgggttccagagaagacttccatagccaaatatatacattatgaaaagagaaagctaaaataaatgtaaatggaaattaaaatcaaaaataaagcagcattaaaccgcttttcgttcaatacgagtgaaagataaaagcaataaaaataaaataaaaacataaataacgaaaagaagttaaattcgaagaaaaagcgtttaagaagacgcattttcggaggagtatgaatagacagcgtatttgtttttgatgtcagaggaaattatcgatgctatcatttgaacggaggccattgcgccgtatcccttgtccccacacatcatttccttctcaattggtgggatctccttaattaaaaaaaataaaagttcaatgaaaccacaaaattattagacaaatttaaatctcaaagaaaaaataaactaaaaatattttttttaagttaaggaaaaaactgtttttagtaacctcttataaaattcaaaaataccctgtacaggagcagttccttcagcgttttcaagtgttgatatgtcaatgggttctcccacctgtaatttgttaataaacattggcacttatttaaaaattgaactctctgaaattattaaaaaccaaaggggagaggcccttttgtttgtaattttttatattaataagtcgtgaaagcgtgtttcataaaggttttcgaggtaggatcacgaatcggattaactatttccgaatccctaacccgtacaaagtttctcaagtctcacatcgctgtgttcatcgcaggagcaaaataaagcggttttcgctgatcccacgctcgtacgacactcgtcaccaaattgtcacaaattccgtttgctatcttagcgagagaattcgcatccaaaggtgcgaccagcatcgaatcagcccattttcggagttctttataaagttgtatttgttgagattcgatcataaaattgactttaccaatatggagcactgggtctccgcgcttcttccacatattccattcatctctgtcatcgtaaacaatttcttgtgtgtcagccgcgtcaaagaagttcagagcactttgggttgcaaccacctgaactgtggaaaattagacggaataaaagaaagtgtcgactttaattgctaaacggttctcgggtgattgcttgtacaattcggcgatcagttcattcacttttattgaggccacggagcccgtcaccgctaataaaacatggtattttccaccaaggcgatttatgcgatgggtcgcgtcaaagggagccctgtgcgaaacagccgtggttttggcactctgaatttattttaggaatgctaagtaaacaaatcaaaagcacactttcaatgtaaacaggcaaaaattctttgttacctctgaacttccaccattcgcgctgttatttttttctgctgacgtcgttaaatcctttttgtcattttcccgtggccgcttctgtgggatttcttcactgtctgtgtttgatagtgtggccatttgagcaaaagaaactaaggaacaaaaataaaattataagattgtaaataaaataaatgaatgagttagatggtgatgngtagggcatccaaaaatatgcacataaaatcgcaaaatatgcgcataaaatatgcaccaaaaatggcaaaatatgcacataaaaagtgaaaatatgca

SEQ ID NO: 30213 - DNA, 1146 bp, Heterodera glycines
cattttcacagttacatcgatcactccgtcatcgcttctcttcgttcaaatcaccaaattttcgacaaaagaggcaccaatttatatttgtggctttcatcaccacataacacggatggccagcagctgatttgggacatttttgttcgtgaaatttggccaattttttctgaaaacattcgccactttgacttttcccgtggtgatcatttggacaatttgcttcgtcaaatttcgccgacaattctcactgatctcaaccaattgacttcaatctattcctttgatttgttgcccgctgcgtttgatgatgattttgatgtgccaaattcaacaatttctgctggccaagcattgtccaaatggttgcactctccgagaaaagatggccaacccaagcgattgcgttgctataattacaacgcacaagcgaacactgattggatcaacaatttcaaggaggtgtggtccgggggggggacaaaatgtcgccgcaaatttttattttaattaaaaaaattatttaaaatttagttacctagcctaaatcaaaaaaaaatagataaattcgaaaaaaattattaagaaaattcaaggaaatgtaaaaaagtcgttttttatttttctggaaattcagaaaattagtttttatacgagacggcgacgttttaggggcgtacccggtctgtggatggcattctgagttattttctgaaacccgaccccaaaaaagttttaaatcgaaaatttttgaaaaattccgaattttatcaaaaatttcggaaatcggaattcagtgccatccctggtgtgttccaacatttttggcaaatcactgatttttgttttccaaattgtttagcattttcttcgtgccaatgccatttcttccgtcagttacgaaattcatttttatgttcatgtgccgtcaatgccaatggtgccattcgaattggtgaacgaatggacaaaggaaaagctgacattggccaaaacaaatgaaaatgaattggacgaaagttggataatgaaacgatgcaaatttggggagacggcggcggttcattgggaagacggaaattggaacaacaattgtaacaatgtatccattcgtctttttagttgctcccaattgcattgggtgag

SEQ ID NO: 30214 - DNA, 926 bp, Heterodera glycines
aaatttgaataaaatttgttaacagattttcaccaaaaaaattaccaaattttgcgattttgggccatttttctaagaaaaaataggagttttggggcgcggcggtgccgataggcgccgccgggggaaaattggaaattttgatcatttataaagaagttttcactgaaaattagcccatttataggtaaaattttgaaaaatttcaggggaatttaatccaattcttaggggtgtaaaagtcgcgtttcgcgccaaaatgcgaaacgcgaaacgcgaaagcaaaagtgccaaaaaagcgaaatatgcgaaagcgaaacgcgaaagcgaaagcaaaagcccatccctggtatagagttaagggatgtgtacttttttttattaatgtttgttttattgccttattgtaattaattattctcttatatagtttatttttcgacgatgctatattaatacctattcttcatattaacaatcaataatttgttttcattttgccttttatataaaattattttaattaaattttatttattaagcctcacagaactaaagggacgatctttttagatttaaatttatgtgattatagtaataatatatcaaatttgtagtttatctttcaaattagcctttaagttttatttttaactgcgttttttctctttaatctggttgcaggcagttggatgatattgaattgggcattattagaatacgtgtcagtattttattttattaataatatttaattttcacttttttctatggaaattattttctcgaatttttgaattatgcattttatttccataattattctcgccatcagatagccttttcgcaattgttttcaggaaaaaaattcgaaactaaaaatctaaaaaggaatatttattaattatgtattcagatttatatta

SEQ ID NO: 30215 - DNA, 1133 bp, Heterodera glycines
tatatatatatattgtataaatccaaaaaaatagaaacatgcatgacttttgaacaaaatcttattaaaaattgtctacaaaaaattgggtaaacaaaataagctaattgtaagacataaaaaattcatcccttttccgatttttattttttcatgtttcatttctaccttttgaagcttttgttttctcttgagagatgactccattttcaccccccccccccttgggagggggcggcggctttattggaggggggttataatggaggcggctggcggctatattaggggaaatacggtctaatcctcacggcacattttgcttcaggcggttcttctttttttcgctttttatatttttaaataacttataaaatcatttcaataaacaattaataattattttactctgacaattaattccttttttcctctctttctcatgccgtccgtcggctggcacattgtctctcgtcataatttttttttcttttgtcttttcgctgctgctggtgacaatgtccccccccccccccattaccgtgcttatcctgtattctccccccttgtgcggaggcgccgcgttttcattccatataattatattgccacggccgcccaacccccccacccccccaccatcaaactggggtatttggtcgtaaattttatgatggtaggcgagaggggttcaaacattggagacattgttcaaaattttaggataacgggcggggggggggtagaaaaacggcggcatgcggaaaatgttggagaaaattgtaggggggggggggtagaaaacggggcacgggggaaatggtggaaaattataggaggggggggggtagaaaaaagcggggccaaggcgactaattatgtgtaaaaaatgcttttaacgccaagagtaaatggcattaagaaaacgtaatgtgtgtggtatatagacaggtgcttggagtgctttaattgatggtggtggaaaaattgaaaaaaaaaacaattaacgaagctaaaagagaggcggtgccattggtgtagggggggggggggggacaattaagtgtgacgcactactaatttaatgctttaagaaaactgattagaagggacgatcaaattttttttatttt

SEQ ID NO: 30216 - DNA, 1699 bp, Heterodera glycines
  misc_feature (38)..(39): n is a, c, g, or t
  misc_feature (51)..(51): n is a, c, g, or t
aaactttactggaaattttataaaaaaggagcgtgacnnatgagattaaantagcaaaaagagacaaaagataaggcatattttatattaacttgataaaaagaatttttccattaaatgtaaatttaatcagacataaaaacttttagaaatttaatgttgagaaaaaatataaaataaaatcaatttaaattcaatcattacgaagataatttatatatattatcctaattttttattaagacaaactaacttaaaatcacaaaaatttgaaaatgtaatgttgagcattttatttaatcaattttttaggaaaatttttttaaaataattttaaaaaacattaaagaatagtaaattatataatttgaaataattatttattttttaaatacttgagagatttttttcagaaaaatttacaaattttatttttcttacaatttttttaagtaaaatgtattgttgctaattttgattttggctttttaataatgcatatggaagatttattgccggaattcagtatataaagatataattattaaaattttttacgtgaaaatttaatccatttttcgatttttctgggtttacatattctgtccaattgatttccgtaatttccgtactctccattcattcactacaagtagcttatatttttgttttttattagtgtaatgtatgaatattatgaaagcattttttattttcttttttttttaaatttttattaggcaatttgtgaaaattgtcggtgcttttggcagcgccaggggcgcagcggcacgccctggtaaaagtaagtgttattttttattcctttaatttccttttttcatattaaacgaaaacagtaggttcttcctttaaattttattaatattttaagtcatcattagggcgaatattattaggctctaaaaactcacaaaaggacacaaaaaagggtataattacaaaatcatgttttttgtgcgtttttggccactgggtgctcagaaaaaataaattaaaattaaattacaaaagttttcaaattaacgtatagataaaaaagcaggcgcaaaatcatttcattaaaaaattaataacagttaaagaaaaaatattttaattaaaaaatattaataatacgtaaacaaatagactccaccatttaacaaatcaatgtgagtacctatgtaacatgagcatgagatgaaattaaaatagaaaaaaatggtaagaaaaacaaacaaataacaaatataaacaaataataaaagccctttcacaaattatatatccagcaaagaataacatgagattaaaagagaaaaacataaataaaaatatataataaagactaatcgagaaaacaaagagctaccgaaatataaagattttaaaatttattcattttcactgaagttatgataatttcctatcaaaatttttagtaataattatagaaaattttcagatttttaaattaaaatctgctaaatataaattgttttaaattttaacttaatttttttttttgtgttagaagaaaacatttttggtaaatttattttttttttattatttcattttttaaaaataaatgaataaataatttaatttattattatccgttactgatattttgatttcaattgattcaagtaatatatgtcctatcgaaatcatgctgatatgaattacaaaa

SEQ ID NO: 30217 - DNA, 1431 bp, Heterodera glycines
  misc_feature (45)..(45): n is a, c, g, or t
  misc_feature (79)..(79): n is a, c, g, or t
  misc_feature (151)..(151): n is a, c, g, or t
ttataccatgttttctcgaaaaaaaaaatttttggggggtataanctggaaaagtatctaaatttctaatacaatttcnccgcattttcagttggctgtgcaacgacatttggatggacattttgccgctttttcgttgtcctcaactcgnccgcaaattggcacttctttcgccacgtttcaacgcgttggtcgacaaacatttcgacagcaaaaacgaattgatcatttcgagaccaatcataattgacaagatgaaaacaatgccgaaactatgtgtagttaagaggggcattggaatttttaagcaatttccaataccagaccatccgatgcacaacaaactccgttttagcaaccttcagattaagcaaatcaaatcgctgacctacaaaatgtccaggccacgaaatgtcgacaagagtaaaaacccacgaaatgtccagaaaaaaacaaaattaaattttataaaaatctggaaaataagttcaccgactccgaaaaccctaaaatagacttacagacttatttttcggatttttataaaatttaatttcgttttttctggacatttcgtggcttggacacttactttgtgggggcgccaatcaaattcaaagaataaagcattcatcattttttaggtacattgaacattctgtcatcacatttctctgtgccaaccagcaaatttttgacaacgccatcaatttggatttgcacgtgtcgccttcctcctatacccccaagaatgtgcacccaatttggagtgtttttgcccgcaaaatttggcccatttttgcgccaaacattcgccatttgaactttgctgatggtcgtcaacttgaaaatttgcttcgagcctcttcgccgacaattctttgcgacctcaatatcaaatcaatcaattccaattatttgttgcccgcggtgattggtgatgatgcaaaagggccaaatgcaaaggctggccaagcattgaccaaatggttgcacactccgagaagcgatggccagccaaagcaattgagttgtcgtggtgatatgtcaagagccattaaattggtcaacaattttaaaaaggtgtggccaggggcgtatctagaaaaaattttcggggggggggggtggacccgaccgatctaaaggccctttttttgccgctgctggataaaacggtattttttacgttctttccaaaaaaaaagacccgattttggctgttttaaggcaaagtccggcggtgccgataggcgccgccgggaaaatttttttaatttgagaccaatttgcatacattaattagtagggggagtcgacccaacttcatactccaaaaaacttttggagaccggggggggggggagtccggcggttccgataggcgccgccggaaaaatttttgaaaattggagtacaatttgtaaaaaa

SEQ ID NO: 30218 - DNA, 1364 bp, Heterodera glycines
tcccatttgttagtccaccaaaagtgccacctcatcgtcagaatgtgttcgagcgctgtgcgagcgtatttcgatggtccgattctccgggtcctcctcctcgagtgggtttcgcgtgacaaatgccaatttgagtccgaaacttcgcaacgcttctcccgcactttgtccgttcaccgtcggcccagccgacgacgcaccgacccgactctcctcccaactcagccggtgcagcatattctcccgacggaggtgcaaatcgcgtcgatattgcactggaaagagaaaagaattcaaaaatgttgaagataaatgaatgaatcaattgaatgccttgcaaattgaccattttcccggcttgtttaagtgcacggacagctgcaaaagagcaaattaattaaaatttggcatgaaaatcacttccaaatgcaaaacaaaccctcgtcatgccgcgcattgactaatgactcgccattgacctcaaaaatgatggaacgcttcttcccttttgttgcgaaatcttacggctaaaatgatatcgcccacaaaaagtgcgcccgttttatccgcagacattccgggaaagattttactgaaaggcaaatattttatgttcttaagttggagagacctaaaattccgaaattgcatcaatttgaaaaaatctaaactttcaaatagggttgagcggtaccggtaccggtaccgaccggtaattaccggtttttttggtaccggtaccggttttttcaaaaatcaaagtatcggtaccggtttgtctagtaccggtaccgccggtaaaaatttgcactggtaagaatgggggtctgggtgagaaaagagtagggaatggtgaagaatgagaaattttttgagaaaaaattaaattttgtttcatttagtcatgggattacacacatgcacatgtggtgcagtggttaaactttctacctttcataatttttcgcctgggttcgtttccccacttggatagaatattcctcacattttctttaccattattttaattaaaattttaattttaaaaaatattccaacttttttctttcatgttaagcatcctaaaaacccaaaacttaatcaattggtcatttttttacaaattctgttaacaaatcgcattaaaaattacaaaatttttcccggcggcgcctatcggcaccgccggccctccttgtcccccaaaagtcttggaaaaaacgtgccgcgtaaaaagcggtgttgaaagcaaaaaaggtaattgatttacattaatttacatggccggagaccccttcgcaaaattggaaaatggctgctgaccccttgttttgcataatctgaattttgaggtctacatctga

SEQ ID NO: 30219 - DNA, 1102 bp, Heterodera glycines
cccccccccccaaattccatttgctataccacaaaaccccacttaactcccccctccgcccgcattcttcactactgctgtggtgatggtggtgatgcataagttcattttcattccattccccccccccttttatggaataataatatgtatgagaaaattattttttattaatttttattgagttttttttaattaaaaaaattaaacagaaaggggcttgagttttcgatttagattttgactccaaaattctaaaaaattaaaacttttctaggcatgggtaaaaattattactttttttgagaattttattaatttactaacaaccaaggattttatgattaaaaatctgagaaagtaagtcaataaatttgccaaacaatattaattttttaagaattttttaaatatggaaaatattttcgtatattttcaaattggtaagccaacggagattttcatactggaaaatttttaatccctttaattacgggacaaatttaattaattaattttatcatctcatcattttacattttttctttctttcatcacttatggtccgcaacttgaggccaatctctaattcgaattaattataaaaatgaatttttttatttaagaattaattgaatttcatctttctaaccctaacctgttttatttcaaaactttctttaaaaaacaaaaaacaacaactaaacagcccattcttattgttgtatgttgacaaaagagtgcttttttgtgctccagtgtgatttgatgattcattcaatcattcatttatttgacgtaccaattaaaaatattttttaatttttttaaattttaattatttttattggaaattgatgaaatttaataggaaaataataattttatttttcagatttattaattcatttcatcttacacaaaaacaatcgtcttaaatgtaagagaacagattattataaaataaaatatctttctaaaaatgattcattgtctctctatttctttttgtcggctaaattaattagacgtaataattttaacaaaaataagtttaaaaatactgaaaaatttgaatttttttctttaatggtaaactaat

SEQ ID NO: 30220 - DNA, 1625 bp, Heterodera glycines
acatcatatttcattagttataactgaagaaaatacaattggatttatccacaggataaattttctttttttgataggatttaaaaatttatattttccattaaaattataaattcattttttcaatctatacatcataatttttattagttataacagaaagatatgtaaaattttctttttttgataggatttaattaaaaatttatattttctaaaaatgcaattatattttccatttatacaaattatatttcgattaattatataattaaaatatacaattttgtttttccacaggaattaattaaaatttaaataaaattatctttttccacagggaattaattaaatttaaattaaattttatttttgattggatttaattaaaattttacatttcccataggatatccttgtcgtcatggagcacaacaattgagccaacttttgtcaagttatgttcccacattcgttgaatcggtcaaccacactgaaaaaatcgtggtgtgcaacaatgtcattgaggacgtaaaaagtatgaaaatctttttaaattccatggacaaatgcgaaaatggcggaggaacacgaattattggagtaattaacgaccaattgacggaagaaaaaagtaaaaaaaaaaaaattcaaaaagatattattaataataaaatcatattaaaaaatagaaaacaataaaattttattttcataaaaaatgaaatctataatgtaatctaataattttaaagacatttacataaaaaaaaatattttaacggttattttttagtttttattgacttaatttaatttttggctataagaaatttcattattggaaaattttaaaaattcaaaaattttattttattaatttaaaaaatttctcaataaattttatatttaatttcttttttatattatatttatttacaaatattaaacgcttttttatagagaaaggcttttccgcatcaagttcaaacattcaatttggaaagcatttgctgacaaagaattcttttctgacaacagataaacttggtaatattttgaatttttttaaaaaaaattattgaaatataaaattgttgtatttaaataatgccaaattttagaaatatgcgcatacagcttgagctttatccgttccattttcaaccttggcgttgaatcgctgaattatcttcagctagtgacgaccgcttcaaaagctaatattaaaatttttaaggaacaaatcaaacaaattgacagcatttgtaacaagtttcaaattggcattaatgccaatgtttatttcgaagcgccatggggtaattaattaaaaatatttatttatttaaataaaatattttttgattgtttatttttgcggaaattaaggtaacaaaattgtcccgcttttacctcaaatggtcaataattattctgattattcgctttcgcttgaaccaagccaatttagagatgaacttggctcatctgatgaagaaatttgatgaaaatctttttgaaattatgatattaaacatttatagttattcttagtccatttagaagacaaataaaaacgatatttttttatttgagaattattcatgatagacaatttattg

SEQ ID NO: 30221 - DNA, 894 bp, Heterodera glycines
  misc_feature (61)..(63): n is a, c, g, or t
  misc_feature (65)..(67): n is a, c, g, or t
  misc_feature (72)..(72): n is a, c, g, or t
  misc_feature (75)..(76): n is a, c, g, or t
  misc_feature (92)..(92): n is a, c, g, or t
  misc_feature (95)..(95): n is a, c, g, or t
  misc_feature (98)..(99): n is a, c, g, or t
  misc_feature (101)..(103): n is a, c, g, or t
  misc_feature (108)..(108): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (125)..(126): n is a, c, g, or t
  misc_feature (138)..(139): n is a, c, g, or t
  misc_feature (835)..(835): n is a, c, g, or t
  misc_feature (842)..(842): n is a, c, g, or t
tcctctttctctcttccttctcctctttctttcccctccatcacgagcttccttctcctcnnncnnnccccnccnnctcctttaaggcgtcnccnccnncnnnccccnccncgngcncccttccnncgccgcgggcgnnccccgccgcggtctcccttccttctcctctttctttcccctcctctttctcccttccttctcctctttctttcccctcctttttctcccttccttctcctctttctttcccctcctctttctcccttccttctcctctttctttcccctcctttttctcccttccttctcctctttctttcccctcctctttctcccttccttctcctctttctttcccctcctctttctcccttccttctcctctttctttcccctcctctttctcccttccttctcctctttctttcccctcctctttctcccttccttctcctctttctttcccctcctctttctcccttccttctcctctttctttcccctcctctttctcccttccttctcctctttctttcccctcctctttctcccttccttctcctctttctttcccctcctctttctcccttccttctcctctttctttcccctcctttttctcccttccttctcctctttctttcccctcctctttctcccttcctcctccttctcttcctcctctccccattttcttttttttcttcccctccctttctcccttttttattttatttttcctcctccgtttcgcccttttccaggtaaatgtccaagtgctggagaactttctgctcgcgttggaattggcctactacgagcacaacaatccctnccacacncggcaaaacccgggagacttccctccgttagtccatcaatgaaacgaaagcg

SEQ ID NO: 30222 - DNA, 1541 bp, Heterodera glycines
  misc_feature (23)..(23): n is a, c, g, or t
ccatattaattaaaaaatgaaanattatttggcacgcatcattaacatgaaaaactgcaacaaaaaaaaaggaatatttttaaaattattaaaaataaaaaataaagaaatttaatcggcattgaatttaggatttaacaatgaaataaaaaatgtctatcaacattgcatataacaattacaataaagaatagaatttgattttctgatttaattactcatattagatgctttattgaaaatattagtttctttttttctgatttaggattgaatttataaaaaataaatactgaaaattaatgaaaaaatttaaaacaaataattttttaaatttaatcaagctgcagaaaaattattaaaatgataaatttatggcgatttggttcgattaaaaagacatgaaagtaaaaaaaaagataaaacaaaatcgaattatatttattgtttgtaataaatattaaacattcaagaaattgaatttattattattttaatgcataagataatggaaccggccggacttattaataacataataaatcattccaaataaaaaaatattcttttaaatttatttgaaaaatgatactgtttagacagaaaattaaattttatttgaaccttacggatgataataataaaaaaatacaaatatcatgagaaaatgatgagcctattatcataaatacgaatatacgatttattataactaatttaatatctacagtcaaattatgaatcatgttctttggaagcatttcattttgtaatttaattacatttcaatgatttaattgcccaagttccgagattacgggagaagaaaaaaaagaaaaattaaaatactattattttttaattaataatttgtcacttagacttaatctgtctagatttatattttgatttccaaacgtatgtactttaacaattgatttataagtgacataaaaatagtaaataaatccgacaattactgctttaaaatccattaattaaatattaaaaaatctgaattaatcataaaattgcagttatttaggcgaaccgagagatttttggattgagtcagattatccaattaaaattcagatacaagaaatttgtttattttcaaaaacacaccccctgagaaatgaaaaatgtttcaaaaaatcatctccaaaattttgttaattattttatcgacgatatttattgatcttgaaaattatgtattggtttggcataatatttttgctttttgaaaaaattcaaatgcatgttgaatggaaaagtaaaaatgcaattaaatcggtaaaatacgctactaataattgaaaatttttgtcaaaattgatagttaaaattttatttttttttattgataaaaaattctagattaaaaaatattatccgaattacaaaatatttaaaatcatttaaatgactaaaattaagttttttttgataatattacttgagttaattagagaccggataagagaatcggtctaaccaggggagaaaaaccgaaaaaatcgaaaaactcaaaaatt

SEQ ID NO: 30223 - DNA, 1376 bp, Heterodera glycines
tttggaagagatttcccatggaaaatttcgcgtcgcttcgctttcaattcattttggaggacaaccacggaaaaagtggtaaaaatggcagaaaaattcgttttgccattgactgcacaaaattttcgattggaaaggaaaacttcaggttggtttaagcttatttttataatcgaactatttaataatacaagaatattgccattacttaatcaaagaatgtcaacaaaactctaaaaatttctactgacaaaagcgatttgaatgaagaatcctaattgtaattgctcttcaaaaatcatagaatcaacatctagataaataaaaattgcgaattttctgctcagaattcgcttttaagtttttaaatttgttatttaaattcaaattcattttccatattcccagagaatcatatgaatttttcatcatttaatcaatttcaaccaaatttgtcaatttttgaaggttttccctttaaattagaaaaagactctaagcataattttgaaaatttagcctcattaggctctaaaaaaccacaaaatgaggataaagcctcacatcttagggaatactgaatatgatcccggtcaatgccgatccgatcccgactctacccataattttcatttagggattaatctacgctgtgttagtagttttgtccatttagcatcacgccattttcccagatcactttgcatatcaaggctaaacaatgttttgcgcaattaaagattaatgccagtaagaaaaatgctgataaatataaatcaaaaagctaaaatttttaaaatatttcttaaggaaataaattaaaaaaaaagaaatttagttgaggagcctttattcatattaggccagaatttttttgaacaattgcattatggtgcatttttggacgattacgcgggcatttggttgtttggcattgacacgatgcaaaaatggggacgaagatcaacgaaaattgttgttcacagacaccaaaaatgtggactaatggtataacttaattaagtgaaaaattaaataattaacatatcaatttaatatttttaataatttatttaagtgtgaaagttgtattggtaaattagaaaggaaatttgaaaagtgcacaattttcaacacaacgagaattaaacggaaaaaaagaggaagcgacttacacattaaaccattggtaaatattttttaaaaataaatcgattttttttttgatttttattttccccatcaaaaaaaaatttttaacaataaatttaaatgcaagattttgctcaaaaatcgaatgcacaaaaattaatcagtttattaaaatttaaatgcaagattttgatcaaaagcaaaattcaccaaatttaatctta

SEQ ID NO: 30224 - DNA, 1308 bp, Heterodera glycines
aaaacttagaaagttcgttgtataagaaaattcttagaaaaaataatttcaaaaattttcagctattgtagaaatttttgaaaaatcctagtaattcgctgaaaatttttgatattggagtgggaaacggagtgcacccatttttttctatttttacagcattgcggcatcggacggcgtgatggtcgctcggggcgacttgggcatcgaaattccagcccagaaggtgtttctggcccagaagatgatgatcgcaaagtgcaacatggccgggaagccggtgataactgcaacgcaaatgctcgaatcgatggtaaaaaattagggttttaaaaaatgaatgaaaatgtgtgtatttaatttccaaatttgtcattaggtgaacaagccgagaccgactcgtgccgaggtcagtgacgtggccaacgcagtgctggacggctcggactgtgttatgttgtcgggcgagtcggccaagggcgattatccggtggaatctctcaaaaccatgcacgacgttcgtttccctcgttacatttgataattaaagactgaaaatttaatttttcagatttgtctggaggccgaaaccgcctttttccactcgaggtacttcgaggagttgttgcagaacacgcccagccccaccgggccgggcgaaaccatcgcaagcgctgccgccaacgccgcgaggagatgccgggcaagcgcaatcattgtgctgaccaccaccggaaagtgggcattcatttttttattgtttgaactatttgcaaaactaattttattgtcctaattccaattacaaaaaagaggcataacttttgaacaattgcattctgcagattctctggtcaggagcaggtcgtttccctctccctttcgccgcccctccccccgaaaatattacttagtttttcctttggttttgaattataaaatttaaaaaagacaaatatttaaacctcaaaattttgaactttttccagtgaaatatggactataaactaattaataatcaaaataaaatatctgaaaataacaatttttcaaccgcaacacacccaacacgcactctcaggtcggcccaggagtgttcccgcttccgcgtgccaatccccgtgttggccatcacccgctatgagcaggtggcgcgtcagctgcagttgtgccgtggtctgttcccgctgtactacccgcacatggaacgcgacacggagtggacggaggacgtgaacaagcgcatcgcgtacggcatcggagtgggcaaggagcgcgggttcatccacaacggcgactttgtggtga

SEQ ID NO: 30225 - DNA, 1499 bp, Heterodera glycines
aaaaaatgaccaagtttgcgattttgagccatgaaaaatggggatctggtgctccggcagtgccgtcgctggcccctttgcgagcgagggggaggggggtccgccccctaaaaaatgtatgattatcaaattgccattttatctattttatgcatttattatagcattgttaaagtttgtttccatttgtatttaaaagtttggcaatgttaaatctctccgataagagaggtttaacagaaaatgttggaaaatgtgaacttaatgaccggataatcattccttattttctaaaccccaaaagaaatagtgtgctagggctgctcgccaatcttgagacacgctgttctcgagccgagcaattctcgggttttaaaaatttcattctatgaaagttccagcaaggatcttcgagatccaatgaagaattaagaattcgttttgactactttcggcgttcggaataaataaagaaattttgaaaatgctgtaagaaatgacacgaaagttgattttatgaatttatgtttgaatttgaacctttaattatataggcgctgacccacaaattgtccaagccacgaattgtccaaaagagtaaaaacttacgaattgtccaaagtctaaaaagctcataaaaagccggaaaatgggtctattttagggttttcggggtcgctgaataccaatacgacatttatatagccccttgcctaaccctagacccaaatataaacataaaattgcaaaaaaatattcaaagctcttaaaaagagtgctgatcaaaattcgaacaagttttagggttcctatgccatccgaattctctctatagacacaccctcagcttcacatattaaaaaaaataattttattaaacattcaataaaattctttacgacgtggacaattgaatcatcaaaattctcgaaatccttcaattttcctgcatatccctcaatttgtaaaccgagcgccgtcataagatcatggatgtcaccgttgttgttgtacgacgcgtccgccaaaattcgcagaatgacagcatcctggaggatgaatcgctggtgccacacgagcgagagggggccacttgacaggcttctttttacatgaaacccatcggatctgttgcccatcggaattgctctgggactttctcaaaaagcatgtccttacgcgaaggaacatgctgcccttcattttgccattgcttccaataagcagagcatggtgtcactgggagatcgcctcgctgaattacctcagttttgctcaccagttggaatgccctggagacaacggactgatggcttggcaaacgaatggacaagtgaacgacgggatgccagagattgggaaacggcgtggagtggacaaatgcaaaagcttccgtgtcacccacggaagttcattttgagattttcgagccgggatcatccataccgattttgctgccggactcctctttgactcgacattacaatgtccaggccctt

SEQ ID NO: 30226 - DNA, 1064 bp, Heterodera glycines
tctagagtcaggcaagtgcctttttctcccagcattttccattcacatttatgaaaaggaacagatttataagcaattcaaaaaagatgtctgggaatgaatgaaatttgaaagaaaacgaatgaaagtgtttgaaattgaaaggaaaaactttaaaagaaagaatctggaaacatgaaaatagtgagaatcgacagttcatatgacagaaagtcactgtagaaagtgctgctgctgttctggccaaactgacaatgagccggaagcattgtccattccaacggctgttccgatgctgctaaattggggcagccaccgtctttgatcctcggaaactattggcaataaagcatttgagtttggtaaatacacattgggagaagggttcatcaacaaattgtagttcagtgaggtcggtgcagagatgccattgcctggcaaagagagggcgtctggccaatccggattcacgctgttgtgcggcattggtgggtcaacaaagcgcgtctcttgtccatagttcggtccgtgctcatttccaatgaccatttgctggtgttgttggtaataattcattgtgttgttctgttctgtcgttgctccatcagtttgcccctcttcgtcctgttccacggcgattgatgcaataagaaattcgagttttccagaatgagggtttgtgaaagcggaaatgcaaaaagaaaccggcagatgaccaaaaagttccgtaggattttgcgggtcgtacttgcaccatttgcatgaaatgatctgaatttggaaattcagttgaaaccaatcagagagagaaagcttttttaaaacgggtgcactacgtttcccccccgtatcagttcccccccccccgagctcggttcccccccgcatcgtttcccccccgagaaattttttttttaaaaattgctaacttagaactttttcagagaaaaatcttagaaagtttttttacaagaaaattttaagaaaaaaatttttttgagaaatttttagcgattttttgaaaattttttgaaaaatcttagtaattcaccgataaaaatttc

SEQ ID NO: 30227 - DNA, 439 bp, Heterodera glycines
gggaagggactgctgacactcgtcgatgagtggggcggtggttgtgctggaggcacactgtagagaaagaagaaaaggatgagggaagaggggcacagatgagaaaggtcgccacactctctcgccatctctttgtcttcctctctcattatctctttccatctctctctatctatctctctctctgtctcttaactctctctcttcccatcgtctctctcgcaccctcttcaattagcagcattagtgctctactctctttctcccttcctttgatggtggtgctgtgtaaaaggtgcgcaggtggcgtgttagtaatttatttatttatttattatgggcaaatgtcggcggacactgacacgcgtacgctaccgtaagcgcgttcattacggtatcccatttctcgaggctatttgtcccctcgccacaattcccc

SEQ ID NO: 30228 - DNA, 1071 bp, Heterodera glycines
aaaataaaaataataaaaagcagctaattatgacatatttaataaaaatcattttataaaatatatacattagatttaaagagccgttaattattgacatttttttatttatactatttcttctttgcttttatccaagtaaattctaaatttttatgatcaatatattaaaaatttacatccaatacaaaagtaactggcacaaaaaaatcatccacaacccaaaaagaatttagaaggcttatataatgggatttgttaaatgatgaattatacctaacaaaaaaaaagtaatttacaaattatttttagcatttttaaatatttcgatataatggagaaattggctcaacagaatccgagtctagtcgattcaacagcatcatctttggaaaaagctgcccaaatggagttggacttcatccagcgcgttttgttgggcccacatcggggcaatttgacggcaattgaatgtttattggcccaaaattttagccaaaattcatcgatgatgcctaattatggcggcgcaacatggaaaaattcgaaaatgccaaaattagaaaccgaaaagcacattgttggtgatgttgatgaacccaaatcagacaatgaaagcgaaacggaccgaggtgatcagaagctgaagagaaaaggagtggaacgaccgaaaaggaatccgagtgaatgcaaagtgtgcgggaggaaaagcatgtactgttattacagtgtcagatgttgcgaaggtgagtgacgaaaaaatattaaatttttaattttaattattttattagagttgatggattataaaatactagataagcgtttgaattaatcttggtataaaacggaaaaaactgagttgcagcaaatcccgcactatcacgaaaaaagactcgggaccggaacttagacgggattccgattcagtatgctcccggtcgtttttccaaatatcttcggtaatgattgggattccaaattgggatccctcccgatcgttttcccaaagtcttcggtattgattgggattcctatttcggcatccctcacccttgttcggtctctagt

SEQ ID NO: 30229 - DNA, 1714 bp, Heterodera glycines
  misc_feature (1425)..(1425): n is a, c, g, or t
aagaagaataattgatattcttgatttttttttgtgtgaaacaattatttttgataacattccataagttaatattctgactccttgttttacctttctcaaaaaatagattcacccattcaagctcgttaaggttaacaacatgataaacattgcccatttgttcgtaaatctcttcaattttcagaagcgaaatttgccgttttgccatgctgtgggtcgacctttcttggtagcacttgccggagctaaattttttctattaataaatggttatcttttgctggtcttcataatacatttcatagagacaaatcctcaaaatttcattcacagcagggacgtccgcctcgtcgaaatgactacagtagggaagacagacggttcgcagggacggacagtcgcgcagaatgtatggggcgaactgtcgcaaacatcggaactccgctggccaaaattccatgccgcagactttgccccggagcaatggccaaagcttgcacataaggtactcagcagtgcgatcagtgagtgagccaaatccaatggacaaattaatcccagaagagccgaaaagagagcgaaaacggtggagaaaggagacgacattttggtggaagtatctgaaaaaaaacgagaaatgttagccaatttttcataaatgttcaattcactcgattgtaatgcatttaaatccgatgattttctttggcatcggcttttgcggaattggcagtgccttcccatgcgaattgacaattagtacttctttggtgccattctctccgattttgcgccaaatgtccattgaatcgaatgcccattttctcgttttaaagtgttcatcgacaagacagtcaaatcggtggctgagcagtgcaatttcgaggccaagctgagaaggcgcaagaaaagcaaagaccgccagccgccaatcgccacgggggatgaagcagctgaaaaacaattataaacttaattaattattaatttttgctacttttcttttttgtcgtcaatggggcgccgtcgtcgtccttttttgacgtgtcgttttttggcgtagtcccaacacatccaaagaatggcgcaacagccgaccaacaaaggcacaccgaacaaactgaaaagacggaatgagagaaagaaaagagggataaaaagaaagagagaaggaaagagaaaaagaaaaacatacagaatcttttttgaagacattgcggcggcaaaaggaaaagaaaaagtgagtgaaagagtgaaagaggcaaagagaaaagccaggacttttatagtgaagaacagtgaacaataggaaaaagagaggtacctaatttctgcgtaatacaacataccgtatttcctaaaataaagccgccccctaaattagtgccccctttcaaataaagccccccaccttttgagggnggtggggtggacatatagagcaccctgttggatcgatttatagaagtacccaattacagagtcactgaccgcatctcgatgagtcctgggcgatgtttactccttctaacctcgacagaaatcaatgaccatcactgtacaatatgcatgccgagcgaataggagacgtctattacgctttagaatgagaaagggaggtagatcgtgcgtaatactgttataaatagggaccggatcttgaggcatatgtttttttttttttgctaatctgctatgacttatatacatg

SEQ ID NO: 30230 - DNA, 1140 bp, Heterodera glycines
  misc_feature (53)..(53): n is a, c, g, or t
  misc_feature (55)..(55): n is a, c, g, or t
  misc_feature (57)..(57): n is a, c, g, or t
  misc_feature (60)..(63): n is a, c, g, or t
  misc_feature (75)..(75): n is a, c, g, or t
  misc_feature (91)..(91): n is a, c, g, or t
  misc_feature (96)..(96): n is a, c, g, or t
  misc_feature (1136)..(1136): n is a, c, g, or t
acccatttttgggcggaattgcaccattggaaatgtttcctttcaaggcaagngnanccnnnncacggcgggcancaaaacctttggagangctgncacagctaccccaataaacggaaacccaaaaacggagcagattgagaatactcttaattggtcaagccagagcggaatatgaagcattggacccaccacccgaaaatttaaccaccgctttgaatcatttaaaatcaaaatttgaaaacgaaaatacccgttccatagcgagacaagcgctttcgatttgcaaacaagcaccaggcgaaagagtgtatgagtttgccaacagactgaatgaggcaatcagaactgccctcgctggggaaagtgaggaggccatacggaaaaggcttatggaggagttcatggaaagactcattcccgagctccaatttgaggtaaaggcgggaagaccaaacagttattcgggtgcctacgaactcgcacaacattttgaactgcttttggcatcccggagaacaaatcaaatttctgtagccgactctgttgcagaattatcctcaaaagttgaggcatcgagccttgggcaatatcaaagagaaaatgtcaaaggagggcccgacagacgaagatgctattattgccgtcgccctgggcatttggtgagggactgcaaaacaaagaaaagagatgaaaggcaaaatagccgcgggccacaaagaaataacgaatattatgggaatgagagacattggaacagagggccaaatggtggagaaaattctcgttttgtgaacggaagggaacaaagaaatgaacgagaattccgccggtcaccaactccgaatacgcgccctaggggataatatagctgctaatactgcagttagcccaatgatttgcctatcggatgctccctcaagtctctggtctattccttctgaccccttttgcccaacttggaccccaacagtggaaccgattcccgcaaattttgccatttttaggcaaaatacaatacagtacaaaactgaggctacggcttgtaaatgtatgaaaacaagcatttcaagaagaatcggtttctttggagggaaaaaagaagaaataagtacaagccccagtggaagtcccanacag

SEQ ID NO: 30231 - DNA, 895 bp, Heterodera glycines
ggaaatgaatggaagcgcgatttgaattttatggttaactaaagtaaagtcaagattttgggtcggtcgagtctctttaatcattcttacaattaattagctcagtgttcttctctattagcctgcaaaatttcaaaaaattggtcagaggaactcagaaaactaggtttacagtatgccccacctttgaacaagcacttactattggatcatttgcgaataattttcgggaacccgtttagcaccgtcaattacgggccgcagccgcaaattaaaggggcagcaaatttatgggctcaattgcacggcataaaggtttataaaggtttattctggtaaagaacgaccgaattttgcgatttttttattaacaaattttggtgctaggtcgatgcgaaaaaaaaactcagtgattgattggtcattttccggaagccgattgcaccactttcgggcaccaaaaatgcctgatccggaagccgaaccggcccgggtaagaacaattttttgttcagtttttcaagtgctatctcccaggccgggtccggttcttgatccattcatttggagcccgtcatgggtcgggcacatctgccgaggaccctcagcctcgcccccgactctgtcgatggccaactcaagctaagcttgccggtagcagcggcttttttgtacagctcgatgagctctacaaaacggtattaatggcgtccggttatgtctactacaaacgtagaaaattgataagaagtgatgcgaaaaatgaaaaattaaaaaaaaattgaaaatgacttgcatcccgccgtacattagtgttaaccgggacggcgccgggattttgtgaataaaattatttaattaattttttaatttaatcaatcactggagttttttt

SEQ ID NO: 30232 - DNA, 942 bp, Heterodera glycines
ggcctcagtacgggggcgcttcgctccatttataattttttttgggggaaaatttcgggccgcttcgcggcctcaggacgggcgcttcgcgcccgttttttaatttttttggggacattcgaccgcttcgcggcctcaggacgggcgcttcgcgcccgtttattaattttgttgggaacattcggccgctgcgcggcctcagtacgggcgcttcgcgccatttttaatttttttggggaaattcggccgcttcgtggcctcaggacgggcgcttcgcgccatttttaattttttggggaaattcggccgcttcgcggcctcaggacgggcgcttcgcgcccgttttttaatttttttggggacattcgaccgcttcgcggcctcaggacgggcgcttcgcgcccgtcttttaattttgttgtgaacatttggccgcttcgtggcctcagaacgggcgcttcgcgccatttttaatttttttggggacattcggccgcttcgcggcctcagtgcgggcgcttcgcgcccgttttttaataaattaaaaaataataaacacggcctgggtccgaacatgccgccccacccctcagaatccccaatcacacagggattctgaggtcttaacgatgtcaaaagtaaaatctgatcacgtattcgtgatcagcggcccaaataacccctaaagacatgtttttggaagatttttggtgaaaaaatttttcctctcaaaaatcatggtcacacccctgtggtcccaaattccaaaatcacttttatttctataacttttttcaaaaaagtgataaaaagctaaaataaaatttataaaatagagcaaaaaattgcggattttttgagtatattatttttataaaatacttttttagaagggagttcaaaagtttttctgaaaaatcgaatttttccagaaattctgga

SEQ ID NO: 30233 - DNA, 921 bp, Heterodera glycines
tttttgaaaattttatgcaatttgctataagattttgtctaaaatgactaagattttggagctaatatttaaaaataattaggaatttttggggcgggcggtgccgataagcgccgccgaggaaaattttttttcagaattttaacgaattttgttaaaaaatagccaaatttttagcatttgctcttttccctttgctagccttccccccccccctttatgtatgttaataatactacaaattaccaagaataagtcagattaaatcgaaatatgggtagccttttaataaaaatagaaaaaaaaaaattcattttataaaaaataatcttgcaagaaatcgtctcgaacacttttttcaccccccccccctttctctctctcgccccctctctctctccccctctctctctctcttccttctctctcgctctctctctcggtgtctttgtcacacagtcacatatccttatatactcaataaaagcatattttaaaggaatttttaattatttaaaaagttttaaaaataatgataaaaaagaaaatacagacggaaacaatacataaatttgtttatttttaaaatttctttcatacattttcttctttaattttaaaggttttcgcgtcaaaaaataaacttaattcaaaaaaaccacaccatcgaattagtatagttagatgaaatctttaaagatgggctattatttgcgaagagtctggaagtaaaagtaacgccttgtaagaattggctaaaccaaccgcaccctgttttgagaggtgcaaaaagaattgggacaaaacgtttattctacagtaattcaaattttatgtatagaaaaaaatctgaaaaaatccctgctaagctaactttttgatactggatcaaaaaagtctttggaacaacatgacagatca

SEQ ID NO: 30234 - DNA, 1004 bp, Heterodera glycines
ttagaaaaaaagatttttataagaaaaatttaaaaatagcttttttttgtgatataaaaattttatgaataataattacgaagttttctctcaaaaattttccaaaaaatcgctgaaaaattatttgatttttttcttgaaaattttcttataaaaaacagctaaagcaacaaaacctaccgttctggcatgacttcgccgatagccgtacacgttgagcgtttcgtcctgcaattggatgagcgcgtgatgaccgccgaaccctggcaaagtttatccattatttggcaacaaatttcaagcattttaagggaacatttagtcgccaaaatataaatcaaaaatttttggtgctatgacgaagcttacaaaaccaccgaattgcattttccgggtttcctacccgctgggccgtgctcgtccatgtccgacaaatcgggcgccgagtgccgtgctcgaatgggcggcggtggtagtggaccagcggcagcagaagcagcgccagaagattgtgccgtatgtaaatgccggggggacgacgaagacggtgccattcgccgacacttttgctgcgggtggttggccaactcggagttgctgttgtcgtgcaacaaatgttgctgtgtgccgtaggagtacgaagtggtgcagctactgcttgaagaggaggcggaagaagacgctgaaagggagcaaaaaaaaacctaatttgctattttgataaatttcaaaaaaaaaaaattctagaggtccccggattattcacaattacttaatttttttgcaaaatgctcgaaaaaatgcagtctttaggaaaccgattttttatatgggcctaattgtaaggcttttacaacaaaaattggataatttttgtcattctgataaatggagagcatctaaaccaatctaaagtcagtaactctacggaaaaaagaaggcctaggcttgaaaatgagtgaaattattaccgttcaatgaaaattttggatttgaaaaaaagt

SEQ ID NO: 30235 - DNA, 1509 bp, Heterodera glycines
ttttctatcaaaaagggagatgaataaattattaatcattttttaattccttatttaacagttcaaaaagtacaggcttctcttttttttcagacaccttctcagaagcgccccaaactctacagggattctgaaaggaaaagaattaacctgtattatctcactaccttgtcatcagtttttataaaaaattttcaaaattttgagtctcctattattttatttatttttcaaattttgaagggcggggggggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatctttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccacacggacacttgaaaaaatcgatttttttg

SEQ ID NO: 30236 - DNA, 1390 bp, Heterodera glycines
  misc_feature (107)..(107): n is a, c, g, or t
  misc_feature (109)..(109): n is a, c, g, or t
  misc_feature (111)..(111): n is a, c, g, or t
  misc_feature (129)..(129): n is a, c, g, or t
  misc_feature (131)..(134): n is a, c, g, or t
  misc_feature (141)..(141): n is a, c, g, or t
  misc_feature (149)..(149): n is a, c, g, or t
  misc_feature (151)..(151): n is a, c, g, or t
tacgtaaaggaaaacaaagatttatttaaaattacggcccttcaagaggacagtcgaacatgaatttgccgattgaaaacttaattatagagatgttttgttgtatntngnagggaagaaagatgaaanannnnggggtanaaaatttntnaaagctcggttactgaaggatccaacagtaaaagacatggttgataaatcaaaggtcatgtggggacgtggaaggaaaaaggcaataaaatatataaaaacacccggcatagtgcgagagaagaaacccttcaaaccactaatatgggccagactgtagagaaaatttattttaatttaaaatctccggcaagttttgctggaattcaaaaaattttaaatgaggccaaaaagattgacccggaaattacgactgatgacgttaataaattcctagaaaagcagaaaacatacacgattcacaagcccatcaggaaaagattcccgatactaaagacgatatctcgagttccatccaaacccaaataaacacactacgggaaacaaatcctcaaatttaagaagagcctgatataaaagtgtggtttgacaaaatggtagagaatgggaccgaaattaaaacataccgaaatgaacttaaatcttttcaagaagaagtagataaagccaaaaacacaacattagagcatgtggcaaataatgacatgaaacaagcaaagaaatcagccgacgtcgcaaagggaatcgccaaacaggcaaagatcaaatatacatcaattctcgagggatataatgataaatcggaaaagggttttagtggtaaggtgaataggcttaatgaggtgcttggtgagcatattaaacttaaagatattgaaaatagacaagtatctgaagctgagaaaggccataaaaaagagagagactagccaatgaggatgttcaatttcaatatgacagcattgatcaaaaatgtattgtctatctttccgctgctgtctcccacatagatttgtcaaaacacctcgcctatgtgctcggttttaagaacgcaaggctatttcacgcggaagaggcgaattatatgccagatttgacgggtggcgtaaggcaactatacatttatgcaccaaatttaatagaaaacacaattatcgggaaccagatggctccactctaagaatattaacgtcgtagatgacccagggtcgattagtaaagttatatatagcaccgagtactttcatcgtctacagtcgaaacgaatttcagaaattacaattgaaattcacacaccatttggtgaattcgttaaatttcactggggaagttgtattcttacattacattttaagaaaagtatattttaaaaatgacacacgtatttttcgatcccgag

SEQ ID NO: 30237 - DNA, 1684 bp, Heterodera glycines
  misc_feature (786)..(786): n is a, c, g, or t
  misc_feature (1542)..(1543): n is a, c, g, or t
agagtcggccgaaaaatattgggtgtttgtgactagaaaaatagctcattcatatcaaatgactacagaaaattacagcctccaagaacttattgctttgcacaagcaatattttgtaggacccatcaaacacattgtgcttataggaaaggcagaattaaacaataggggcctttttattatgattacaacaaatcagcatggcgtctcgctgatatggtatgtttcagttaaggtttagccgatctacaaatttcggcactgtctattttgtaaaagcgaatcaaattcctttggattccaaagtggaattacagaattgcgacggcaaatcctaaatagacaacgacgctttcattataaagctttaagggaggaaaagtaatacgaaatagaaatttttaaatggagttttgtctattttaccagctttatccggtctccggattcttaaattggattgagaatttttccccgaattctcaagcgatttcaaatcgctttgtagggcttccagggcccgaaaattaggaagtaaggcccgtgttgcggcaaggaaacggcggcatggaactgggtcgatccccataatagtactgaaattgaattatcactcaatgccaaattaacgttttgtttatggaaattttttagaaatgtcatgataccaagcttggtaaaatttacaaattccgaaaccagactgatccgttgaaacacaccttggaaacagcaaccaaacgaactgctaaacttggaaaattgttaaaattatgcatgctttgntgatgccaaccacctgcagatgaatggacgcccagttcggcaacactgtcgagcaccaccctcaaattgttcaacaccaactcagaggccatttgcaaaaaagtgaaaaaatagcacagaaaaatggagacaatattttaaaaagagcatcaaatcgaaactccgaccaaaacaaacaaacaaaaaactttggtaaaatattgacaattattctgaggagacggtgttgcacaaaaaaatgacatgacaatttttttgtcattaataataataatccatcgctatgatccacaattggttctcttcgggcgcttaaagtcggaccaaattgttgaactcggccaccagttgtggcaccgccgcactgccaaagttgtggctcaactgcttcttggtgagcgtgaacttctgcaacggtgccggcggcggtcgcactccgtcaatggtgcacaggggcggattacgcggatgtttcttgcctaaaggcatcaaatatggcaatgatcaggggcgtaatttttgaatatgacaagtcttttgtgagggctttggacttggctaaaatagatccaaattcgtgactagcgacaccgaaaaccccggtaaacaaattttaaagaaagtacgacaaaaaaaaatttttttttttttgagaaaaggtcccctgtttttaattttttataagatagataaacagaacaaatgagccgatttcggattgtccttggacaatgccaaatccgagaatatccttannatccacttaatgcactcaccctggtattggtcacggcgccgtttgctgggcccgctggccatgcgaaagccaaaccgacgatgcatttgggcagagccccaatggctttttactgtcaaaataataaaataaaaattgaaa

SEQ ID NO: 30238 - DNA, 985 bp, Heterodera glycines
ttttttggggtacattatcaatttttttttttttttacaaaaacttctataaattctcaaaaaccctattaaatatgtacaagaaaatgaaaatatgtacgaaaaattgcgaaataggtatgaaaagtccaaaatatatataaaaatatgtaaatatgtaataaatgccggtccctagtatcagccagcaaaaaattaatagagatattcctcaaattttcataataccaagcaatttaacatttatatggaactgttgttttagtttttaaagcggcaaaacttaattaaaaattccaaaaattaaaatgcatcgcttaaatttggcttaccagtcgaaaaaagccatgcgtaagtgccaacaatgatgtaggttttattgattctgacaaattgcattgagatgtaaattacggcggaaattgaatcgaacaaacttatgataagcacttggaaaaacgactaaatattatttataacttaaattaaattttttttttgtttgtgtaatagaactaaatgctattacaatggaaagccattttattagcaaattttcaagtaaaagttttttttttgttcttcggtccctaaaatttttccaattgtactgctcaaaaataacatttattgagttttttaccaaaaattaattattaattcatttcgatcaggaggtggtggaatcaccccgtttctaccccccccccccccgctgattacgggcctgatgactttggcatttttcaaaaatatttatttaaggggagaagcgctgttcggtgcccagcaaattcagcgcttttaccgcgatatcgacgaaacattggcatggatgggcgagaaagagcttacgctggccaccgacgactttgggcgcgatctgaacaatgtgcaggcactgcagcgaaagcacgagggcacagagcgcgacttggccgcattggagtcgaaggtggcacggcacggggaaattttatcagtg

SEQ ID NO: 30239 - DNA, 842 bp, Heterodera glycines
taaaaaaattgttttttttttttttggggccattccccccaacccaatgcccccaattttagggggagccgaattctttgggaaaaattttccttttaccctttctttaattttgggttgggttttttcccccccaaattttttggattccccaaacggccccttaaaaaaattgttttttttttttttggggccattccccccaacccaatccccccaatttttgggggggcccaaatctttggggaaaactttcctttaacccgttcttttattttggggtgggttttttcccccccaaattttttgggttcccccaacgggcccttgaaaaaattggttttttttgttttcggggcagtccccccgaaccgatgcgcccagatttatggggagaccgaatccttcgggaatagcttccctataccctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccattattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctcaggaaacaattgtttgaggaaacggtggtaaggaaatgagtcgacccctccaaa

SEQ ID NO: 30240 - DNA, 1590 bp, Heterodera glycines
  misc_feature (100)..(100): n is a, c, g, or t
caatttaaatgcttcaaattgggggtcttttttttagagttttaacggtacgaaaaaaagagattaaatttgagagaaaaaataataatttgaatttatntactcatctttttaggtacgatgtgacatcagtaagttcttcaattggcgtcaattatttattttaattaatattttttgccaggaaagttcgtttttgaatgtgcgcaattggattgagtcggtgaaggcgggcgttgacaatgaaagtgtgctctgtttggtcggcaataaggtcaacaaatttaagtcatttaatatattattatactattttgtaatttcttgcaatttaaaaataataaaaaatattaaaaattggaataaaataataaaagaaatcattttcaggtggacctttacccaaatgaacattgccgcacaattacatatcagcacggcaaagaccttgcagaagtgagaattacaattaattgtaacaaatctggggctatgagacctcagcataattatccactaattattctttccatggagtctaattaatatgctcaatggagattatttttgaataaaattgagaattatttcaaaaatattttgaattcgaatatttcggattgttcctctgatctgatttgctttttcacctcattttgatcatcaatttttcaaaccttattaggaatatggcatgttgttcttcgaatcaagcgcatttactgggcaaggcattgaggaaacgatgcaatcgttggcactgtgaatttaaaattattataattataatagtacaaattatgcatgattaattcgaatttagtcgtcttcaacagagagaggatgatcagttgaaggaattgataaaactcgaaaaaagacagggcaaacggcgaaattggtgttgtatttagctgggcctttttgttttcttattttcatcatttttttatatattacggaataaattgaaaattgatttaattttattttttaattttgcaaaaatcatgtttttttctgcaaattaaggcagggcgcggatctgtcctgattatcagaaatgccttgatttggtggtagcgaccaaattttgtcgattttttaaaaacactacaattttgaaaatttaaggcagaatgtctctattttattaagaaaatataggatttgtggcaaaatttggtcatttttttttgtttcgatcagagaactgaattaaggagacgaatttttacataaaaatttaaaaataaataaattttcacaaatttattctttcctttccctttttttcccattaaatttattcatttatttctctttcccctaattatcagctgatttgatgattagcagtgccaatgacaaaaaaagattcattccatctgtccattttcatgtttttttttttgtgctttggaaccggccttcgcccgacggcagacgaacgaagcgaaagaatggacgacggcggacgacacaatccctcctttttcttacaatgccctccctcccccgcggcgtcaaaatgtaacgtaatttccccctgcgggggggggggcggggctgatgggcacgggcggtcgc

SEQ ID NO: 30241 - DNA, 986 bp, Heterodera glycines
attacggattgcggattacggaaattacgtggttttggagttacggattacgaattacgggttacgaatttttgtgatttttccgtaattttgatccgtaatttattatttttcgagacgatttcttgtaagattgttttaataaaaacaaatttttctattttctatttaaagggctacccgtattcgattattcaggaaataaaaatcagatattttgttaaggctacaccctaattttggtatttcgcctagaaaatagaagcatcccttttttgtcgaacttattttttactcatttatgaaaattcataaaacctagtcaggggatggaaaggaattccctcccccgaaatgaaaaattaaaaatttttccaggaaaagtcgacatttttaaaaatttatcgatttttcttaataaaatcattaaaattaacggctacaattcctgtttttgctctccggcgctgaaattttttaaagaaagattttccgagggatttttttgaatatttatagaatataaaagcagtttattttattttataatattattgttttatattttatgattatttttatagggatttgtttccttttcaaaaatatttattttacaaaatatcttcattaacatattattttttatagcttactcattcatatataaaaactttaattcttttgaattatcgtaataaattcaattttagtatttttttctaaaaacttgcactcatatacatattctttatttgacgattattattatagaaatttaaaaaaaaatttacttgcaaaatttactgaaaaagtgttttattaatttttagcattacagttaatgaaaatattgatgattgtataaacatttaaagcatatttacaaaaatgtataaaaatattttctttgttatcattcaaaatgttaatattaataattgaaatgtttttattgaagtgtttgttttttaatatttttatat

SEQ ID NO: 30242 - DNA, 709 bp, Heterodera glycines
cagaagaagctcagcgaggatgagtgcaaaattttcggcaaaaaaaaagacttgcccgtgcggtcgtatcaaatgcgtccaaatgccaaagaacaaggtagggatgatatttgagactggaattttgctcgaaaaatttatggattcaccggattggattagcgacattcaaaccccagtttctagccttgaatgccgatattggtcgaatggtcctgatccagagtggcattttagagtcgggaacccacccatgatttgggttttttaagaaattaaagttcaaataaaactttataaaaatagctaattaatagaataacgaaatatttctgctaaaatagactccattttaatgtccgaaaaaccctgacaaatgtccgatttttggacaaaataactccccatggaatgaagtgattctcaaaatcccaaaatttgtttgtgttgctgcttttatccaatacacaacaaacaggttccatgcactgcaaggtcgtccaaaagatgcattttcgaaatgaaatccacctctgcgagccatcttcgcacttctgctacatggcgcactgccataaaatgaagtaaaagtctaattgatcaaaaataatgaaaaatcattttcaaaaattaataacgatattttatgaattaaattgattacagtactggtaagaaactgatgtcataaataatcatcaagtgtatt

SEQ ID NO: 30243 - DNA, 1418 bp, Heterodera glycines
tgtttatccacacacacagtgtgctgggcgtatgcaccagcaaacatgacgaggaattgtgcaaagcgggcggtgatgcgtgcgaatttgtgatcgacggttattacatttcggtggcaatttgcgtggtcgtcggtctgctgtggtatcggtcagttctgttatattatttctcgatacgatacgaccaatagaaaaacagtatcagaatgttccgaactggtctaacaacattgagaaattgttttgctaaggatgaagaagaaattttctaacaaattttattggaactttacaaaaaaaaatttccgacgcgcggttcctcccccccccccctccgaaaattgtgcggacttgtgtctgaaattaggtacgattcagtcttttctccacaattcaatgtggcgttgttttgttttatcgtattgttaggcccactaaatttgattgatagtttttacgatttttattttagaattttctaccggcgcatcaaatacttccagaagattccccgtcaagattggcgcgtgatcaaaacaaaatgatgtgtgtctgtctgtctgtatgtgatgatgaaggcgttttgacatttgaaagcaccaaaaaagaggaatcattattttattatttttttttgctcttttattttacctattgtatttttctgtccctttattgaattctgtgatttctattattttatgtgtcaaaattttatttccaaaaaaggagaaatgggaaaagctttactcatcgaatgtacatattcattttcgcagaaaatgccattgatttggttttccatcattgtttttcaaaattgcattaaatttcttggcaaactgcccatttgtaaatgttgcttcaccattttctggccagatcagctactgctgcgcttcctttcatcaaaagcatttgccgtaactccgttcgcacaatgcgcgtggttccaattccggccaacaccgacaattacatgtatttgatcatcgacgatgacgacaaataccaaaaaggacatcgaccggcggcactcgttgacccggtgaatgtggaaaaggtgcggcatttaattgtggtttttggcacttttagttctttttgtctttcattacttctattataattggcaaaacttttcaagcgcagaagcaaaaatttcccaggattttttcttgaaatttttttgtttgaatgatgtttggggtggggaaacgacgggggcgggtgaaatgaagtgcacctacagacgtcgccgggaaaattttttttgtaatttttaatgcgaagccatgacaagcctggatttttgtccagtaaatccaggtacatgcttttttcaaaatgctaaactctaataattttgaaccgaagtactttttctttttttatgcatcaattacaaataacaa

SEQ ID NO: 30244 - DNA, 901 bp, Heterodera glycines
aagttcctttttgttcggccgaacaattttgaataaataaaatttagctgaaaaaaagaatgactaattaaagattaaattagagttgtgcggtatcagcaaaatggtaattgccagttttcaggtctcggtatcggtaacgttttttaaaaatattgctattttatcgtaataaactttgatagtaccgctcaacttttgttttatttttattaaaaatcttactagttattattccaaattttttcatccaagcataaaccgtggaccgcctaaggccaatctttttcgcaattttctcttcaatttttttattcgtttttaaattgaattcttttgcaaatttttctttcactttttgaaattgctcatcaccgttactctttaaacgggttttggttttttttttcttgcccaaatcactgcttcgttttctctcaattatccagtgatgtaaaacgggccaaatcactttgcaactccgtttcttcccgccatttaaacccgctcagagagcgtcgcccccgcggccgactccccaggggggggggggccagccgacggtcctcaacgccgggcgatcaccaaaaatgctttccagcgacgcccccagcgagcttcacgctcaggggacgacgccgagtctcgtcatcgcgggtgctttggcgagcaaggtggaactcccaccgggaaaccgtactacagaaatgatcctgagaagtacagtctcaagaaaggaagggattggctgggaacaagtggaaaaggaagagagaaattaatgatgagttgaaaagggaggaaggaaagagggagcaaatatgcactttctctctcacttctcccttttctctgcccattaaatgtacgcttttttcttcctttgcatttcttctgcttg

SEQ ID NO: 30245 - DNA, 418 bp, Heterodera glycines
accgtattttctctttttatccccccgtctccattaatccccccgtccccatttaccccccccccccgggggataaatggaatttttatttatcaaaccatttttccaaaaaaaaacaaatagtaaaaatgctaaaaaaagcccaaaataatgacgaatagtgacataattttgttaagaaaaaaaaaatttgagggatgaatttttgagaaatttaccaattttggcaataagttttgtggtttcttcgaaaaataagtttaaaaatttaataaacacagccaagcgggctcgaaccccagaccccgtctcatatgaccattaagcagggttcggatctgtcctgatttgtaagatttgtccttatttcgggctattcttcttatttcttaaatatattcataatagagaccggcgg

SEQ ID NO: 30246 - DNA, 2096 bp, Heterodera glycines
tctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccactcccctccagagagctacagcaatcccggcaaaattcagttcagtctagtcggaggggaaggaagtggatgacaatctcccaccaattcctcgtcgtcggacgtggcactgtgaccgtccttcgtttcgccgtcgctgccccacacagagacatccaatcggcggtggtggggtgtggtcgttgtcgacggagggtaagtgacgggaggggggggggggggggtgtactaaaagcttaacgctgacgatgttataaagcgaaaaatggacacggattgggcgggtggggacagaggacggacacacgtcggaggagttgtaaaagttgacttaatgtgcatatatttattggttgtgttggtgatgaacactgactgaagagagagagagagagagtggtcaatttgagagagcaaccagacgagcatagattgggcgagagagagagagtacatagaccaaaagggtggtgaaggaggacagagctggaagaaagagcagaggaaaagcatagagtgccctggacagacagattgagagagagagagaaagactaatggcatttgtgaagagccgaacagacaagcaaagatagggtgaaatagtattagacagacagaatgacagagaagactaatagcatttgtggagagccaccagacaagcacagggggcgagacagtacatctccaagggggtggggagtaaaaaggcaattaggcgaacaaaacacaatggtaaatgaagagagtaagcagtgcggtagacagacagagacagacaaaatagggggctggggacgggttgtaggtgtaccccggcgctgttgaggacaattgaaaaattttgtttctttttctccgtcgttgtcgccctccgccgtccgtggcggggcggccgaccggcgtccgtcgaccatccaacgggaatgaattaggcggcggcaaggctttgtgcttggtcattactcgataaatgaagggtggtggcgacaaaggcgtggacctccccggcgcagcggcgaccggcataaaaagtcgtcgccgtccctcgtccattcctccgcccacccgcgtcgcgctcggtgcgcaaaaacgcgtcgttttgcgctccccgaccggcgtggggacggaggtgggaaggaaggaggatgtgcccctccctttccccgtcgctgtttctgcttttccttcctttttgctgcgccattgatggactgctcgcgcgggggggggg

SEQ ID NO: 30247 - DNA, 900 bp, Heterodera glycines
agccagaattagcataaaattaacgacacataatgtgttggccccagtgccgtacagaggctgcaaaggcgtgcagaagacttccttgcttttatatttccgcacgggttcttagaaaagagccagaattagcataaaattaacgacacataaagtgttggccccagtgccgtacagaggctgcaaaggcgagcagaagacttccttgcttttatatttccgcacgggttcttagaaaagagccagaattagcataaaattaacgacacaaagtgttggccccagtgccgtacagaggctgcaaaggcgagcagaagacttccttgcttttatatttccgcacgggttcttagaaaagagccacaattagcataaaattaacgacacataaagtgttggccccagtgccgtacagaggctgcaaaggcgagcataatacttccttgcttttatatttccgcaggggttcttagaaaagagccagaattagcataaaattaacgacacataaagtgttggccccagtgccgtacagaggctgcaaaggcgtgcagaagacttccttgcttttatatttccgcacgggttcttagaaaagagccagaattagcataaaattaacgacacataaagtgttggccccagtgccgtacagaggctgcaaaggcgtgcagaagacttccttgcttttatatttccgcacgggttcttagaaaagagccagaattagcataaaattaacgacacataaagtgttggccccagtgccgtacagaggctgcaaaggcgagcataatacttccttgcttttatatttccgcaggggttcttagaaaagagccagaattagcataaaattaacgacacatcaaagtgttggggccccagtgtccgtacaga

SEQ ID NO: 30248 - DNA, 1176 bp, Heterodera glycines
tttatgttttatacagtagaaaattgtgctagtgcttactgtattttgcataaaacaagttacggtgataaatgacttcttgcaattcaaaggtatggcaaaaaatatcttttccttacactattttcataatttactttctctgtttcactgtccacttatttttgcggttagagacgcatacatactttagcgagtcctttcattattcatcaccgatggccttaaaaatttcggcaaattgaattccgagcctcaaaaatatttgaaaccagaaatttcgagggcccaaaaaatttagacaatcaaaattttgacgaccaaaaaaaaatgaagagaatttatgagaatagtgattctatcgtccaaaataatttgactaaaaaaaagggaacacaagcccaacaattagagtagtaaaaggatattcgttagaagccagtttgtatggaaagcatcaattagtacaattgaaattgtcaaaaaaaacgaaaaacaattataattaggaagaacagagtgacacatcatcatgatcataatttttcactcttttctaatgcttccttctcgtctggatcagctccctcaaattcttctccgtctcggcaatgcttttgtccaaatagtccttctggcggtccatcaccgttatgcgttccccactcgttttgatgtcctcattttgacgttcaatttctgtgtgtatataaaaaaattggcactactgtaaaagtgacagtttttgaaaattttttcaaaaggggggagggacccttttgttttgcaaaattttttttgtgatagtcataaaaatttattctctgggtttttggggtccccgatcacgaatccttcgattattttgatcaattccgatttcctaatctaaatttgaacaaaaaatcacaattttaaaaattcaaaatttcgatttttataaaatctgctaaattttcgggaaaaacaaaagaaaaattcttgcgaaaaagcaggttttttaaacaaattttttgccgtttgggtcaaattttcgaaaaataatggttaaacgccgccgggaaattttttttatttttttgtaaattttaatgaaatatgataagcaagtatggcataattttttaaagctttaaatcatttcttattaaaaatatttttcgtttcggggggggg

SEQ ID NO: 30249 - DNA, 990 bp, Heterodera glycines
atactggaaaaatgtgaatttacaaccaaaaaatggacagtaatatcgtcgtcctgtttctcaattgcgattttcgtattggccgtcacaatgccagttgcccctcactgactttctccatgggttttcttgggcagaagaactgcttgaatgttgggcagcacgccaccctgggcgatggtcacaccagaaagaagctaaaggtgaaatggtagaaatataaaatagtggcagaaaactttgttaagctcttcgtcattgcgaacagcgagttggagatgacgaggattaatccgcgtctttttgttgtcacgcgaagcattgccagccaattccaaaacttcagcagcgagatattccaacaccgctgccaaatacacaggggcaccagctccaacacgctcggcgtagtgacctaattgaactaaggacaagaaatttgttggatgggacctttgcgcaaaaggcgatgaagacgaccaacagggaattgcagtccggcacgtgaagaacgcgacttggccttgcctcctgactttgctttgccaccctttccgcgtccagacatttttcaaatataatttttttttgaacagtaaaaaataaattccgtggctgaaattttggggcattttacactcaagaaaatgaaatcatttgtttgtcaataaacaattttttaaatttttgactaatttagaaatattcttcagaattttcccttcaaaatgagcataaaatggttttatttggtctagtattgaccaagttataagtagggagtccaattatatggaaatccatattttttcctggactgtgggaggcctgaaacgcacgaaaaacatgtttttagcttggtttgaagcttctaggaaggatttctatatccatattttccatatttcgcgatttatgtccatatttccgggatcgagccatttccctaccgccaattccctaccagccatttccctaccggccacttcc

SEQ ID NO: 30250 - DNA, 965 bp, Heterodera glycines
tgttttgctctgacgggcgcttcgcgccccgttttttttaatgttgttttgctctgacgggcgcttcgcgcccgtttttaaattttgttgggccttttcgcccgcttcgcggcatagttcgggcgcttcgcgcccgtttcaaatgttgttttgctctgacgggcgcttcgcgcccgttttttaaatgttgttttgctctgacgggcgcttcgcgcccgtttttaaatttagttgggccttttcggccgcttcgcggcctcagacgggcgcttcgcgcccgtttttaaatttagttgggccttttcggccgcttcgtggcctcagacgggcgcttcgcgcccgttttttaaatttattgagatcggacgggcgcctcgcgcccgttacaacggtgttagaagaggtacaacagtgatgagaagaggtacaatggtgattaaaagaggtataacagtgattaaaaaattagtaaatggtttatgaaaaatagaattaaaaaatgtattaatattttttaaaaaattattaaaaaatgcttttttttattaattaaaaataaactttgaatttacaatgattgactattattgtattgaaaataatttttttgacaatttctaatttaaaaaaacaaaaaagaggtacaacagtgattagtaaattcattaaattaaaatgaaaatattttttaacaaatttaatttaaaaaatacatgaaattctatcaattaaaaaaataattcatttaaacttataaaatttattcattaaaaaaaaattaatttaaatataattttttatttattaactcaaaaaatattttaaatgaataaaaattgaaaaacacgaaaaaaatggtagaaaaataatgtacatcgcccggattcgaacttcccccccccccctcaaaatgatcctcagaataccgcaatcacacagggattctgaggccttaacgatgtcaa

SEQ ID NO: 30251 - DNA, 1439 bp, Heterodera glycines
tttgcaagagaacataaatttgactgaacaaaagcggcgccaaactgaaagtgccatctgcgtacgcatttttcataataccggcccattccgaagtcgaagcgcgagcaaatatcaaaattcttaatacggtattttaaaaaattaatggttttattattttaagtttttacttgtaaataattgacagaaaaaaaaacatttgtaaaaacgacttgccagactaaaacgaccctctgactaaaccggaaagactaaaccgaccctctgactaaaccggccagactaaaacgaccctctgactaaaccggccagactaaaacgaccctctgactaaaccggccagactaaaacgaccctctgactaaaccggccagactaaaacgaccctctgactaaaccggccagactaaaacgacactctgactaaaccggccagactaaaacgaccctctgactaaaccggccagactaaaacgaccctctgactaaaccggccagactaaaacgaccctctgactaaaccggccagactaaaacgaccctctgactaaaccggccagactaaaccgaccctctgactaaaccggccagactaaaacgaccctctgactaaaccggccagactaaaacgaccctctgactaaaccggccagactaaaacgaccctctgactaaaccggccagactaaaacgaccctctgactaaaccggccagactaaaacgaccctctgactaaaccggccagactaaaacgaccctctgactaaaccggccagactaaaacggccagactaaaacggccagactaaaccggccagactaaaacgaccctctgactaaaccggccagactaaaacgaccctctgactaaaccgaccctctgactaaaccgaccctctgactaaaacgaccctctgactaaaccgaccctctgactaaaccgaccatctgactaaaccgaccatctgactaaaccgaccctctgactaaaccgaccctctgactaaaacgaccctctgactaaaacgaccctctgactaaaacgaccctctgactaaaacgaccctctgactaaaacgaccctctgactaaaacgaccctctgactaaaacgaccctctgactaaaccggccagactaaaacggccagactaaaacgaccctctgactaaaccggccagactaaaccgaccctctgactaaaccggccagactaaaacgaccctctgactaaaccggccagactaaaacgactctctgactaaaccggccagactaaaacgaccctctgactaaaccggccagactaaaacgaccctctgactaaaccggccagactaaaacggccagactaaaacggccagactaaaccggccagactaaaacgaccctctgactaaaccggccagactaaaccgaccctctgactaaaccgg

SEQ ID NO: 30252 - DNA, 2252 bp, Heterodera glycines
  misc_feature (19)..(19): n is a, c, g, or t
  misc_feature (2225)..(2225): n is a, c, g, or t
aaatgcgaaacgccaaaanatgcgaataatgcgaaaggcgaaatgcgaaaagcgaaacctcggcccatccctgataagtatcgtagtaatccctgatctgatgtcatttttgttacatttgttagcggaaaaaaaatttgttgtcacaaaatggaaaagttgattagttaaaaaacggggcgtgaagcggatacacaaaaatctcacaaaacaaggtgaagaagcttccttttttcgtgaccgaaaaatgggtgaatttaaatgcgttaatgagcagggacttgttgaaaaacgagatacggtagtattattacctgaaatcataagtgtgttttaactaatttaatttaactaatttaatttatcgagcaaaccaaaggcacatgagtgctcttatatggtgccaaaaagaaaacaacaaataaatttgatcaaaataaaaatacaaaatgaataccgtaataaaaatgaataaaagcgaatcgtatattttagtgcaaacgggatcaaaaaatcagatttttaacaaaaaaaaaattttttgagtcgcatttttttaagtcttggggaacgggtgtgggtccagcgataccaataaaaaattttctaattttgatgattttttagctaatttttaagaaaaaaaggattttagggtccagcgttgcagataggtgccgccggaatttttttttttttttggcaaattttataacatttatgtccaaaaaatgaccaaattttgcgttatttttttcaaactttaaaaatctagataaaatattgaccataatgcataaaatttcaaatatttttgtgtattcttataaataagaacaaaaaatccgagccccgagttaaactgctcttttgtgaaaaaagactagagtcgaaaatggcccttttcgaacaaaacttattaacaaatcacattaaaattataaaaaaaaaatttcctcgacgccgcctaatcaaatggaatttctcaactttttgaccttttgtaaaattgaaaaaatgattaaactcgcgaaaacgaaagtcctttattgatttctttttaccccgtaacctttttttaatttaattataaatttattcaataaaaaattgaaaataataatatctgaaaacaaatatacacaaataagcgacaaaaaataaatgtccaactgcattcaaagttcaatatttatagctcgttagtgcgttgccgtataactaaaatacttttattatcacaaaaaatatttttatttatttatttttttacccttttgttattccaaatgcgcgtaaattaaacgcgtcgccgcgggcgttggccccgcaaacttccgcccatcggcgtcattgttgttaacgcaatggaagcgccgcctgctgagggcacattgttattgttgttgttgccgttgttgtggttgttggctgaggagggccataatacggtgaccgtatcccttaaatggataatatatttatgggaaaattattttactcgcaaataaaataatttattctttttatttttgattgctgatgggatatttgagagaaaatattataggtaaatattttttgtttttgcattacggaaagattgaagttttaaatctacataagcaaaattctaatgtttttatacaaaaaatgcacttttttatttcttaaagcagaacccccccccccccttcttctcaaattctcaaaatagaaaaataattaaattttaattaattatttgtttattgtaaaattggtgcaattttttttaattattcccctgcttgattttccggaatatcactaatttcatcaataagttggtctttttgttagtcgcatttcatgttgttattgctattttttctcaaacaaaaatttaaaggattttaattatatatttttttaaaatttcttcgtgtttttgggtgtgcacagttttcccacctcatttctctgttcattgctgcataaaatatccaattgccagcactgttcaaataaggcaagaaactgtaaattaaaaaagtgttaaatggtttttgaaaattcattttaaaaaattctcgcctcgaaaccattcgaatatttcgtgaaaattcggagtccaatgccctcggcagttgagacaattggaagtattcaatgattgggatgaggacgaagaccctgaaaaatttgtttaatgtatttcccaaatagaaaatcctgttgattgntttttcacccctcccctctcccccccc

SEQ ID NO: 30253 - DNA, 900 bp, Heterodera glycines
accgccgtttccataccagccatttccataccggccatttccatgccaccgtttccataccgccatttccatactaaggtatttaggccatttccataccaaaaatttttcgaaaattttcaggtaaaattcaataaatagataggggtttttcaactgtttgatgcttaatatgaattataaattcaatggattctcttttcaacgtatagattggaaaatggaagcaattctaacaaaaaagaaccgtaccaagcttcaacacaacggccattcatacatttttcacaagccgagtgccgatggtgaagttcgcttttgggcctgtgaacatcatcacgcataagacatcagttgtaaaggacgccttcacactgacctcgacaaccgcattttgcgtgaatttgggaaccaccagtgtgaaccaagtgcagctcgaatggaagcacaacgagtgatcactggaatcaaacgcagggcggaacaaaccatggaaccaccagcgacaattcgctcattggtcttgactagagaccggaaatttcaaatttgcggatcccgctgcgggactggaactcaaaattttttgcgggactggatcccgcaggattaatcccgcaaatcccgcatttaaaatttgcgggatcccgtgcgggattgcggattttaggaaatttcaaaaaattctgtattaataaaaaagtcggctctacttcagtttatgcgtccaatcaaagttttatgcgtaaagttttatgcgtccaatcattttttatgtatcaaattatgtttttttgccaaaataaaggttttatgctttcgtgagtcaaaaagtttgccacactttttatgggcagccgctgcctttttccattagtcggcattgtcgaccctcatgac

SEQ ID NO: 30254 - DNA, 1408 bp, Heterodera glycines
tctaggtagcgaagctcccaaagcgcgaagcgcttttccccagctaaatagccgacggttcacgcacccgctagtatatacgttatattgacaaggagtttcgtttcaaaaaacaaaatctcccggccgaaggccgggagcgccctgaaagtagtggaagggtcttacaactttttgaggagaatccgggaaaactatagaaaaaaatttagcgcggacgactgagtcccagggacggatttctcattttttcgtgcgtttgacggcacataactttttttctaaaacccgaatcaaaaaatgtctgctgtgagggggctaagttgaagtgttttctaaaaaacaaaaaaaattccaaacctctatctgcaataggaaaggctgtaggttcgtgaactttttcagtaccaactttgtccagttcagtcccggttgaataactcattagggtttgatctgggcggggagttaccagcagacttattgtagagttttgaaagcccgatttttccaaatttaaaaatttcgaaaattttcaaaaattttcgagttaggcctaaaaaacggttttcgggtttttgaattttaggattttttaacgatttttcccagagaaacgaagaccacttccaaaacatagtttttcgagctctatcgattggtgatatttttgaaaaaatttcgatttttttccggaaatagaaaaattttttggcctgagcgggacatttgagtcccgggcccataactcgtcaggagttgatcttatccaaaaattgccttagagcaaaattgtagagcattttaaatgctatcgaatggtgtactacatgatgtaaaattttcaaaaattttcgagctaggccccctagaaaatttcaaaaatttttttggggtcgaaaaagggggtgaaaaatttttttctggggtattttggggtgctgaatacgaatatgatgtttattttaagtttcggaaattttagaattttttaaaaattcgaaaatattttccaattttttggcctacgggattttgggctaatattgaaaaattcatatctagcctaagggttgaccaattttgagcaaataaagctttaaaaatagagaaaaatcaggagaattttatggactttatttggaatttctatctaaaaaaggaaaaaagttattccagaatttctggaaaaattcgaattttcagaaaaaaattcataactcggttctgaaaagatattctggaaaagtaaaatactacaaaaatccgcaattttttgctctataatataaattttattttatatttttatcacattttaaaaaaaagattttaggggtagtttatgacgctgatcacgaatacgtgatcacattttactttttgacatcgtaagacctcagaatcc

SEQ ID NO: 30255 - DNA, 1088 bp, Heterodera glycines
  misc_feature (895)..(895): n is a, c, g, or t
ctaatttgggcctggatccggtctttatgcacacagacagctgactggtcctgacacgataaaagtttataataattatttaccctaattaaaattgcattaaaaatgaaagctgaataattaataaaaattatattcaattacattgtcttataaaataagtttaataagatttacgcactttttcctcatcaaaagattcgcagtccgttggttattattgttatgatgactattattgttcgtattggtgccgtttcttgccatttttggcagatgaaaattcgacccattggtccgtccgctgctcggcattttgcagggcgacgaattcactgtcgatgtccctacaaatgaagtgaggaatttgtctaaaaagttcgaatcaattttgaactattcagtaggatcggccacggtagtttaaccgaaaccgaatttctttttttctctttttcttttcctttcttctccttttccccatattccttcttcctttttgcttgcccgtttgttcctctgtggccattggtgcttcttccaaagtgtacatttggggcggtgtttcactttttatgccgttattttgccgcgaaatgccacaaacggaagggggacgaatgtcggagaaagtgaccaatgaattggactgttggccaaaagtgtcgaccattcaaatgacgaataaaagagcagcagaataaaaattacaatttactcaatttatcaaatttttcgcggattttgcagaaaatttttggggcgagtaaaaattaagtggccaaattgttattttgagggataaataatgtaaaaaagggctaatgtttggctgggatggagcaaagggcccctggcgacggaaagagtcggcggaatgaatgagttatttggngaaggggggaaggacgtcccccgccccccccccctcaggtgaatgaattgtgactttggtggcctaggggtgggccgagcagagactgctgctgcttctgctgggcgtcatctttccccgatttacgcccccaaagggttaagccaaaagaaggcccttcggtgtccctttacttaacacccccccccccccc

SEQ ID NO: 30256 - DNA, 1944 bp, Heterodera glycines
  misc_feature (7)..(7): n is a, c, g, or t
tgtaaanatattaaagctatgtgttaaatgttctaattttgaccctagatattctaatttggaaaaaaaatctataaaaacctaatataattaccatccctatttttcacaatcgaattgatcaattataaatattagataaacatttgaacaaaacttagcacaaaactaaaaattaaaaagccaataaaaaaattgggttttagcaaatcccgataatcccgcgggatcccgaaaaaaatcttcgggattcatcgggattcggtcgggatcccgactcgggatccgtctcgatcgtttttccaaaatgttcgggattgatcgggatcgggattcagtcggtatcccgactcgggatccctccgaccccagttgtccggtctctactgcaaaagcccgcagcaatggacataaactcaaaccctatgtgttggtcaacagaaagcgaccggttccgcaaattatcaaccaatttgctggaaaattgttttgtttttcagaaaaaattagtgccaaacaatgttctcaaaattctatttatcccccatggggggtaaatggagactgggtgattattttttaaactcctcagaaagggggggggataattggagactgcggtattaatagagactgggctataattagagcatatacggtaagtttggcgttttataaattatttttgactctatagcactatgtgtccaatcgcattttttgagtccaatcaattgataaaacctaagtttgttcatgttcgaacaaaccctatctttttggtatcattcgaacgcacaaagtctaaagagctaaaataataatttcagcgtttaggcaattgccaaaaacgattgattaattaagcaatagttgattagtttcgtttgtaactttctttaaatgttaccattttcttgttttcccgtattattatcttattcagactttgtgctttcgatgataccaaaaagataggctttgttcgaacatgaacaaatgtaaaaaaccaggtatgttaattgattggactcataaagtgcaatagagcctaattttttgcttttctgaagtcatacttctctggcggctgctctagcgtcggctaggtcatcagcatggccagtgctaacaccgaccaatttgatttccacggccttgccggccatcgttgccattaatgctgctctcaattgcgctggcgtgcagtcttcattcggcctccgtgttgacaatgtttggccatcaagaccattctggccaatgatggtggtgctgatgaagcttttcgcgatgtcctcattcaataggaccactattgaatgtgccgcttcgtgcgcagcgaccaatgcgggtgtagtttcacctgtttcgagtcgtaatgcgctttgacagcaccacgtaagtgtagtcagtgagctgaaataataatttaaaattaatttttaattattaattgaaaaataatgaacattaaaatgaccggggggaggaatgatcgaaaacccgcaaaaaaactgacaaaacaatgtttggtgcccccttttttagtgtctcgcccccatttgcctcctttttgaaattgaaaacttaagaaattgttaaaattaatttaaaaattccaaaaccaaatttattgatgataatttctgagattttttcaatttctttaaaaaaaattttgagaaatgatacggggggaacaagctgctccctcctcgggcgctgcaccattttagactcacgaaagggtgcacaaatagttatgctctctcaaattgaacagtgaattcagagttcactagtgatcggactgatttttcgacaagaatgatctatcaataaatcgaacgccgattcagaccagaacggccaatcgatcgcattcaaaaatacatcaacagttacgataccaatcccacctcatctgaggatcacacccat

SEQ ID NO: 30257 - DNA, 1499 bp, Heterodera glycines
ttcaagagaaccgacaatctgaaaaaggaaaaataattaatttaattaattagacataattagtaggaataattaattagtcataattagtaggaataattgacattaataaagttaatgtcccgaaaggtcattgacacgaggcgatagattgtttgacggattccatttggagtgctaatagtgatgttgagctgcccaaactctgccaaagacaataaattcaatgtgagatgaaatccgctcaaaaaaaagaaaaactaaatttgcattgtattcgaaaaatcgcttaattcaatggggtaaaatgaaaaggaattagaaaattacatatttcaattaaacataattcggataaagcatatttttggtgtcaaaatccagaacattaaaatgtgattttgcttcatcattttatgttgtttatcagttttatccacaatttcaacatagtacaatgattataatttggactaaaattggctaataattgtggatttatgccgatttttcgaatcctttgctttgccttaccttcaccctcctcctgtaccgtttcaattcgcatttcgaacggttcgtttggattaaacaaactcatgttgggctgtgatccgaattggaatttttccttgaaagaaatcaaattaaaacaaatctcgccaacagtaaaactgtattttatgcattgggaaattaaatggtggcacggaattccgattcccgaaaaaaattggatgtcagaattccgatttccgaaatttttgataaaaagtttcggatattttcggaaattttttgagtttttttcaaaaaatcttgaatttttgaacaaattctgttaataaattgcctgaattttcaatttttcccggcggagcctatcattatctcttgtaataacggctcaatcaaaaaatatttaaaataataaaatatttcataccgcaaaattataatggcccatcgtaaaattgccatccttttggaacaaaaaccaggcaactttggacactgacaatgagagagaaaaaataaatgaaaaaaggcaaatttacagtgataaggaagcgggaaacggtagaaaatgcctaccgtaacgattaaattcgggcgaattgtgcataagatagaaggacagactcagttgtttgtcgcccatttctggcctccccattttgcctctgatcacaacggtgtccccggcgttcaacgcattttcaaattttttggaccaactttggcgttttgatttgacactttcgggcttaaagttaaaacattgaattggaagaagaaaaatcaactatgtttgagttttaagaatttaagaaaattcgaaataattaaaaatttaaaaattccaaaaatgcctaatctgtaaattcattttttaattttttcagcaaattccaaccctttccttcacttggggctcttcaatactgcttgggtagacatcgcccgcaatctgagcaatttacattattaaaatttaa

SEQ ID NO: 30258 - DNA, 1250 bp, Heterodera glycines
attagcaaactcgcggcagcgatctcttgttctttttctgatcactttttggcaaatcaattttctgcttacaaatttttattgtattttaggcgtaatgggcgaaaaaagcattttttggggggtgaaatgatcaatttttgggtttttgattcataaaatttataaaattagtcatcctatcgacatcgataggcttcattacgggaaatattgcaaattttaacaaaatcattaatcaaaaattaaacatttaaaaatgcaattatttttcttcaatattttttattttcgacttaaaaatcaacaaaatactttctcatcaatgtcaccaatcactggagtttaattatttatttaattaatttgcatttgtttaaacgatttctctcaaattgtggcacagaatttccgtccaaagtgccaatctcttcccggttgtgtgtcttggtctcacaaattgattttcatctcctgcaccgagtaataatggtgtgccggcggcgtttggtgctggtgataaaaggttccgtccgctgatggagtcaaaaaaggcgccggaggcaaaggtcgtcgcctaattaggcaattaattaattaattaatgagacaactgacaaagaaattttattaccgtttaatcgaaagggaaattaaaatccatcctttttcttttgccatcatattttttaaaaaaaacttagtaatccatcataaaattttttagtaatcgttaggaaatttcaaaaatttttcatgaaatttaaaaaaattctatgatttttgaaaaatattaccaaattttggcaacgcttttctgtgagttgtgtgaggaggagggcggcggaggcgaaggaaaagcggcggctgccgaagtgatgaaatggttctgatggtacggtgccaatgtgtagtgcttctcgtcaacggtggcggcggcaccagcggacaaatgcaaattgtcaatggacgacgagcaacagcagcttggggaaaatggtggcaaaatcagaggaaaatggcatagaaatgccggcaaaaatgccatagtaaaagctcgacagcctcgaaagataggataaaatttcgcgaaattaggaccagagttggcacatgggtcgaaaatgttgcttggattacaaataacccatcgggtctaacaaaaaaaagttggggcggcaaagaagcttagaattcggccagaaaatgccgaaaaagtcaagagaaagttggcaaaaaaaaatcaggat

SEQ ID NO: 30259 - DNA, 1669 bp, Heterodera glycines
ttaactcgcttcctccgtcctcctcttccgctgtgccgtccctctccccatcaaatgacttggacattgtccttctctctccgtcttcctccgttgccaaaccttcgctgctgctgagccattcgcccgaacaatttgcccaaagtcatcttctgctaatcacggacaaccgcgagcacattgccggcgcgagaactcagcgaaagatcaaaggaattggcgaacatttggccacaatgggcgtttcgtttgagagtcgtccgctttcggtcctttctttcatccgtcgataatcacaattaattgcattttaaggttggcgactatctttgggtgttgcagtggacaaattgggagggcaaaagacaggaattggtgttggattatgtggtggagaggaaaaccctcgacgacctccgggttttatttccattttaaagagaatattcatttccattcagaggagcatcaaagaaacgcgatatttggagcagaaacagcggctgaaaaagtgtgggctaagaaatgttgtttttgtgctggagggagggacgacggccaacgaccggcagttggagcaggcgatggtgtcgagtggcgtggagagcgggttcctcgtccatcggacgccgaatgtgcaggggacggccaaatttctgcaaaatttgacgcgatggctcagagagcgttgttctaagcaaaaggtcgttagaagaaaacaatttgctgatggtttttactttaagtgaccgacatcaaaatgtgaaattactgttcaattgttcaaattgaacccatgggaggggatgaagcggattataccaaaaagaaaatatgtataaaagggggggggggcggtaaagcttaacaactcgcatttccgaacgcccaccttaaccattgagtgtttttcgtcccttcaggtcactggccctcatttcgatttgtttcaacaagagagcaaaaaggcccatgccacgactgtttccgattattgggttcgccaattgaccgtttgcccgggggtgagcaccgaccgagcacgcatcattcgcaatcgcttcccgacttttcgttcatttgtcgaattttgccgtgaaaattccaccgacaaaaattcgataagagacgactattcgagtgccattggagtcgaattgccccaattgtcagctgcccctactaaaaaccttatgagcttttttaggcaagcaatgactacgaatgactaagacgaaaattaacttttttcaaaattgtctcctttctttcatagacttcatttgcgcttcatttagattgtgttcctctatttttatccgcccaagatgtataaatgacaatttattgatgtctgtgtagtgacaggttctagtgcagggttgccattcgtccttgaatggcaaggacgtccttgaaattgggccctctttcttgaaaataaaaaatgtccttggatgccaaggacgtccttgaaaatgaatatttagaaaagttttaaaaaaattcaaagaaatttgagaaatctttgtaattttcaacaatattttgattaaattatggcattatgtcatttaaaaatgtaatttttgagaatttttgaaattttatggcattaagtcactagtcactatttttcttaaaaaattagccaaaaatcgcaaatttt

SEQ ID NO: 30260 - DNA, 1654 bp, Heterodera glycines
caaaaaacaaggcgcggcgagttggccgcggcgagctgggcccgcggcgagaaagcttggccccgcggcgagatggccgcggcgaagtgaccccaactcagcctagaaagttgcaaacgaaaataatcaaccgttacttaattaatcatatcttttttggaaattgcctaagctgaagattaatatactttagcttctttaggcttttgctttcgaatgataccaaaaaataatacttttttcacaccatgcatttttaaaaaatcgaaacttcaaaaagaaaattttttgcttcaatactattgacctgactgtatatttccctgaatttgattttattgcgtaagatttttggaaaaaggctcggatttgtcgttggataccaaggacatcttggatttgtgcctcgctaattggaaatggaaagagtccttatttcaaggatgtccttggtaattaatattttgcggcgccgcttgatgaaaattttcaacaaaaaactatccattacttttgtcaacgtcaatcaaattaaaaattcttcgtatcattcgatagccctaagtgttttctagaaagttttttattagaaattttcacttgatggttttttgtataacgctttttttatggtttttatataacgacatagcaccaaaattattactaaattatatattttttatataaattcttagattttgtaaattttttgtaacattttctcgggtgaggcaaacggcgggcgggaattcacccggaattatggcactttcacaaaaccttaaaagtatctgatgacgaacagcgaaaagtggcgaatgaggctgccccatgatagtaattatatacatcacgagaaatttttgttttaaaaaattttgccaaaaagacaacttcgttattagggttcaaaatcttacacaaatgcatacttttttaattggtctcggtccaaaaagtactcgatcacttgttttaaaacttttgtatctgttgacaatgatttcattaaacaaatatttatatcggtaatgaaaatttaaaatgcttaataaaaaactaatttcgatcgaagcaccactttcgtttctcatccattttttatttaaaatttcagaatattctatggttttaaattagtttaccgattctcgagtttatacttaacaacaatctcctaacgggaatcttatttcagattcgtggtcatcggcataaaatgtgctgaacgtttcctaaaaatgccacccatgcgcgttttctaaatgcgccattttaatataataaaaaaattattattcgaactaatcgattgattattttgattttattattcgtgaaaatagatttcatttgacactattgttggatatgatggattttaattattatttgaattagcgccaatacagtagaaatgatgctcctgttgtttttggtcgccatattcttcagtcaatattctcccccgctgttttgttttcattcattattattttcattatttttatcatcatttttcggttctaaattaaatctgttttgctccttccatttttgccttcctctgactccgtcgtcatcattattttatttgttttgttttattagttatttctttgttatcatttgtcttccaaccaaataaatt

SEQ ID NO: 30261 - DNA, 1672 bp, Heterodera glycines
  misc_feature (67)..(67): n is a, c, g, or t
  misc_feature (86)..(86): n is a, c, g, or t
  misc_feature (110)..(110): n is a, c, g, or t
  misc_feature (148)..(148): n is a, c, g, or t
taaagagttttgtctgatttttaattcatgcaccgggtcgggtctttgaattttgttttatctcacnatcataaaaatctttaaanattatattatcactttattcatgnaaaattaagcttaaaccaaaatccattcatttcaaatntagacaatataaatatttgttaaaagcagaaatagcaaaatgctttgagtgatcaaaatcacttgaagaatggaaacataattctccgatttgctcttttggttatggttgtcgacaaaatttaaactgttgatgcgcaactttgtgaacaggcgtgccttttgctgctcggcacggtcattggccaacgcaaatttgaccagtgccctgcaggaggcgggcaacggcgcgtcaaagcccaactgacggtagagcagctcgaaactgatcgtaagaagagtgaccaaaatttattatgaaattaatcactaaatcttatatgtacaaaaattatttcttggattaatagttttttacaaggaccacatgttgatgatagcagcagttgtcattctcgaatgaggaattactaaattttttgcaccaaagattttttttgagagaaatcttcaacaaaagttgatttacgagtgtcgggcagtgccaatgccaaaaaaattttgaaaaagccaagattccggattttataagacgtaattttacggttgatttgaaccaactgtattgtctgactaccattcaaacattatggattgtcgaacacccaactaaaccccactcatattgctcataaacaattctcgaattcctcctgtgttcatcaaaatacctcgagaattccaatccgatgaatttgagcaacaaattggccggcttttcgccacaattatctttgattattgggagagtgcaacgaacaactgatgaaagatcccttaaaattaataattataattaatttagaaattcaattttatttttcgaatcgacctgcaaagtgaattgaagcgcaattgcatagaatggaactcgcgactgatgatcgaattggtgaacaacactgtggtcatgctggttggaaaataaattaatgaagcaaaattaaaaagaattcaattataacagttttttttatgataggcatatatagaactaagaatgacattttttattctagtttttcaaaattattttttcgatggaattctataaaatattttccatgtttttccttatttcccatttatttttatattcacctatgaccaaaattttcatgaaaaacaaatatttctttcaaaaattatcataagaatgccttcaaatattatttttgataaaaaatataactaaaaatgaagaaaattcgtttggctccttttttcgtaaaattaataaatttaactttgtttgtagtttttctttgggaattatttttaatatcaattcacccattttagagcgtttttttattaaaatttaataaagtgaagatttagaattttctcatcaatttggaaaaatttatgtccttatttttgcaattttgtatccatatttcgcgatttttgatccgtaattgatgaccatatttcttgcttatttaccatataattaattacctgtcctaattatgcaatagtttggcatttcgaaattatttttggaaaatgcaattttatt

SEQ ID NO: 30262 - DNA, 1859 bp, Heterodera glycines
ctttttccaaatcaccaaaagcggactcaaattcctttgctttttcttctgccgctttctcttcttcttctccgcttggtcatcatcattttcttcgtcattctccaacaaaatctctcgcgaaattctttaaaattttgctcaattaattaattttttttttgttaatttgatataatttaatttatttttttaaattttgtttttcgattttaaatctttttgtttttagtaccgtaatgcttcgccgagtttcccccgcaattcgatgtgttctttttgatcaccgcccccaatttctatgataattcgctcggaaaattttccacttgatttgcttcgctttgaagagccttctgaaaaatgataaattgaaccaaaaaatcacaattaatgcaaatgattttgactttttttattattgaaataccgtacccttggccctttgggcaacggtagtgccattgtccgctgaatttttctgcccgccggcggggggagcagctgaaggacgatttcgaatgcgtcgaacagattcaaagggttggtcataatcttcgctattgctgctgtcactgccgtaatcattcccaagccgaactttgtcttcttcggataagcaatggccacaagttttggcacatttgtccttgagaaagtcggaatagatctgaaaggccaattttatgtgtaaaatttgttaattttcagttattttttaaaaaattaattcataaattaaaatattattaaaagggatataataattagacattcttaattgatttaacaaatgcaaaaagtttttggttaaaagtcactttatctgtacaaagccctgaattgtccgcgcacgaaggcgacatatcctggcaaatggcactttttggactcgcagttatttgactgtttttccgcacaagaacaatgaccgaaaattaaacttacaattagtatgaataatctgagctgaaagattagatctactactacttattatccacatacttattttgcttaaatgcgtatgccattcgatgagaaattatgaacgtaattccaggggatggcacaaagctcgaattaataaaccaaactccgtatttttaggcattggaattcaaatccttccctaataaatgaccatttaaactgtttattcctccggctttcgcttaattaatataattacctccttaggcgtcttctgtacgccaaccacttctcgtgactccgcgcctccgccgcgtggtgccgtctccgctcgttgctgcggcgtgcagagaccgcacgagcgcgcgcactgctgacggacgagcggagagacggcctggtggaagcacagatggcctaacgacgtgcagtcgtcggccgcgtcaaaacatgcgtcggctgcgcacaggccgcacgtgtgctcgcacatggacatcatcacctgacaaatcagggagagaacggcatttggttaattaattaaagggataatcaaataataaaacaattaacgggcaattaaaatgaaataattaacgggcaatttatattcatagagagtagaagaagacaaattttttaaaaacggatttccttctggtaaagaccaattttgggacccgaaactcggttgtcagtcaaaaaagagtgcctactaataagatactcctaattagcacattaattacccttctccaactcggctctttgcatttggtcttatgcgtcgcgcagtcaatcaccgtgccgccgctgtccacgcaattgaactgcggcgtttcgcaacaaaatgcgcatgttttggcacaacggcgtgccaaatcggacaattctgtcattaaataattatttttcaattttttgct

SEQ ID NO: 30263 - DNA, 1143 bp, Heterodera glycines
atttcttggtaattagtgcctttcactcactgatcagctgtgatcagatatgtgtcccattcttttcctgattagtctgttaataaattgcccatgcccctctgtgggtggccaaatggccgtacccaagggatgtccgagcgatcaaaatagcgacaattcaacattcaattaattgtccattaattagtggaatcttttagcgccaaaattggattgccaaaaattggtggtagggcaccaagggactgactcggtgctggtgctcaattggccaccttgggaaaactgagctccgccgagtgatcgtcgaaataaaatcaaattccacttgatcagcaccagtccccccttttcgtgatcgataagtttgatcagcccaccacaaagcatcaaatgaaaaattcaattgtgtggtggcgatttgtccctcagccgcctctgtcggcggcggcggtgtctcttttttccgtcgcgtttttctcgcgcagccaatgggcgcggcctccgagaaaaacggggcgggcggggggaagtgtccagcaccattctcgagactaagcactctcgaccagctaatgatggtcaagactgactgattgactgactgactctcggctgaccgatcgttcgtttcggccgatcggctggcagcagcagcggcagctgtaagtaaaatgtgacagccgaccgacaggaacaaaattctcaaattctcaagtactctctctgctgggccccggggacagcagccgaataaataattcgaaatttgtgatttaattggaatttaatttgaggggaaaactttaactcaaccatttttaattgcttttcttaaccattttgaaaattcgttgattcttttttatatttttttatttttaaaattaaattttatgtttcatttatttattttaattaaaaataaaatgaaaattttccacttttgcgcatttatttgtttttacaatttttaatattattttactaatgctataaaatcttgattattttcccctaatttttgaggggtcgccgcttttccccgtcatttgcgaggattttctgctattacgctcgattttatcccgactgtttttcagagggtttttccaccctatttttctggccgattttcct

SEQ ID NO: 30264 - DNA, 1553 bp, Heterodera glycines
cacacattagcaattcctttcaaaagggaagaaagacatgcatcactgtgaaaggaaatcaaccgataaaatttcaactaaattttaatttttcctattcatgacttactttttcacccaattttttttgcttttgtgtaaagggaatgaagaagtttaagacttagttgaggtaatatggcaaaaaataacagaccgataaaatgtttgatgaatggccaataaaaaatgctaataatggaatgacaaaatgctgaggatatgagaaaatgggaaagcgaagaagaaaatggtggcaaatgggggggggggaagtgtgaatgatggcccaatttatgacggaatgatccgtcattggctgttatttgccaagagatcataaacggacaaaaagcattagaagaaagaagcgatggaagtgttaagagctttctcgctcaatcggcccattgaatgtgtgtcaatttctggtgaaaaagtctaacgactgttctgccgtttagagaattttagggcaatggaaaaggagaaactttggggagggattgaatttcgtgagaaaaacggagaatggaaggaagagatggagaggaagaaggagcagggagaagagagagagcagagcggaggtaggggccagaggggggagaggggtcgagactctcgaaccggtagggcggaaaataaatttgggtttgaatttaaaaacggttttagcaattatgctttgaagtttgagttaacacttattaaaataaaaacaaaaaatctttgccaattttctcttatattgcgaatttcttagacaaattaacaggaaagaatttatatagctatttttaattaaattaattttaaacaaagattataattaattaattgcccctcccccctttgtttcaacttactatctcggacggtagaaagacattccgcaaaacgaggcaattgaatttggctgattcgtccgtttattttccgtaaaacgaaaaaaatgctcagaagaaaatgataatttgtgaagaatcgaagagcggactcccagcaaaacagcagcagaaatgcttaagtgcttctttttccctcatcgtttggggatttgcactttttaaggccaataaataaatgccaagaagagagagtgccatcaaaagagggccaaagggaattttgaggggcgcagaaattggggagagaataatgaagagagacagagaaagggaacagagaaatagtgaaggaaggaagagaaagagacggcgaacagtgacacaaaaagggaaggaattgaagaagggaattcgaaaatgatgcttttgtactgtgaatcgaagctaacaaaaaaaggttgttcccggacggggaacaagcttctcccgtgcgagagtatcgcttctttggttctcgagaatttctcagggtttcgattaagcagcagaaatactcataaacagggctgttttttcctggattctatgtagtctaattagtaggaaaaacatcttctttttggtatttgcgtacaaaagtcgtgacttttatttgcatatttt

SEQ ID NO: 30265 - DNA, 1397 bp, Heterodera glycines
tttaattttgctagaaatttgaacaaaacaatttctcaatatataaattttttaatatttaaaaaaaaattcagtggagaaattttttcaagtttttctagcaaaactctctctctctctctctcttcctccatctctttttctcttcccctctctctctctctcactctctctttctctcccactcactctctctctcccactctctctttccctcttccctctcctccctctctccctcgctctctccttctctctctctctccccgtctctttctctctccctctctctctccccccgtctctttctctttccttctatctccctcccctctcttcctccctctctctccctctccccccctctctctctctctctctctctctcttcctccatctcttttcctcttcccctctctctcttcccctactccgccttccttcctctgttttccagcctcgtgttcggccctctgatcaagctcttcggtaggatgccccttttgatgttcggtgccgtgataaatctgttgatgatcatcactttgatggttcgccttccttacttcttttgtcccatcattttgatcaatagatttgggttgttaatcccggcgatcggactttgtttaacgctgtcgccggtgtttgggggatggcagacggagtttggaatacgcaattgaatggtaagcaaagggaggggcggcggggggagggggaggagatggcctatgtccaacaacagtattcccggaatccgctcccacccccaccttttgcgtccactccccccccccccttccggggttggctctgactttatgttcaaggcttttgggtcgcactgcttggtcccggccgtgaccaattggaggtggcatttgccaattatcgtttttggatgtcttttggcctcgcgctcggcttttttctcatccgcgccacttccatcgacactttccttctcatctctttcgccttccttctgatgggcattctcggctattttttggtcgaattattcgaaatcattgcggtaaaatcgaaaattcgaattgggcttaaaagaaacatttcttcagatgaaattggaattagaaagaagaacaacggaagtgataaaggaagaaaaaggagaaggaacggaggcaaagaagaagaaaggacaaggagaagaagaagcggaaaaggagaaaaaaaaggaggaagagaaaaaagaagtgacagttggaatggcatagaaagaagaggaagaggacaggcaaaggaggaggaggaggaggaggaggaggaacacggatgaagagcaaaagaaaaaagatggagaaaagggagaaaagggagaagaaactgaggaaaagaggaaataaacgggaaaaggaagagaaaaggaa

SEQ ID NO: 30266 - DNA, 1733 bp, Heterodera glycines
ttgcttttctacatttctattctggcaattatggcatcattaaaattttttaattgaaatttaaaaaattaataaatttaatttttatcctgagttatgaatattgttaaatttaaaatctttttttttctattacgcttttgaattttccattttaattccaataaaattatccacgtataatttcagtggatttggtgagcgattttgacataatgaaaaaaaattcgcctaaaattttgctgagcaaataaaattccgttgaacttttaaatttcggagtgagtttaacaaatgtttgaactatatccacgtaaatttcaataaatcgaacgatgtgaatagataaatcacaaaaattcgctcagaaaattttactgatcaaataaattttgaaaatttgtggggcacctgaaaaaactgtacaaataatgcatttgaatatgccgacggaagtcaactttcaacattgcactactgttcaaagcatataaaagggcttagtgaatttggagtgtaagcatttaatttaattttaaaatttaattattatttcgaaaaatttatttaaatttccaaaaaaagtttggggttttcagtaatttcaaaaaatgaacgccttcttttcgttcggcatttttcttgccattcaattccatgcccaatttgttttggctgatgttacggcctcaataaagccatcgtccacatggaacggtggtggccaatacattttgagcttcaagaacaatgacaactccaagacagtgtgctccgtcaaattcacgttgaccccagcaagcggagtaaaaataaaagaaatgtgcaaaatgccaaaatataattttttaatggggaaaagtggaaaaatgccatggaattaattaagtataaatgccaaaaaattttggaaaatgtcaaagaataattttaaaaatggggaaaatgtcaaaggataattttataatagggccaaaaaatatttttaaaatggaaaaaaatcataagcaattttttctttttctttgtccaaaaagaaaaatatttttcaaaatgaggtaaatggccaagaaagctttaaaaatagtaaaataaatttactccacccattaattgatattatcttcctaattactccgctgattcatcattcacaaattactaattagacgtccatctcggccaagtggggcttcgacgcggtcagtggcgcttccaaccaatacactctgtacaacaatgccgacatagcaccgggcgccacaaattcaaatggtggcctcaacattcagggcaccaaccctaacggaccaccagcaacgccaacactccaactgattgaggccaaatattacagcaacggtaattggaggagggcaccaatcaattttaattagccatttttaagtattaaaattagttttaaaaatttattaaaattagttttaaaaatttattaaatttaatatattttttaaaatgaaatagcagcagcacatgaatttttcttttaagaaaaaattataaaaaaaattttttaccgctctaatatggttggcaaatgtgtgccaattttcactccattcttagggggtggttttattagaggaatgaaggttggctctaatagagagaatgggaggggaggtggagttatttatttttattttgcatttttttcaccagatgtatgctttttataaaagaacagcagagggttgggtttctaatag

SEQ ID NO: 30267 - DNA, 1216 bp, Heterodera glycines
atagaaaaattgggaaaatgtccaaagaacttttttgagagtagtatttagacgtaataattatacggttgatctacctaattatgctgaattgttatacatttatgatcaaaagtcgcttgagagtcgtaggttaaaaatagacttaaaacttttccatgaaataattttaggcaaaataaatttacaaaataacgaatacttttctttttccaaaaaccctgtaaaaaacgaattcactataagaacagcttattgctcaaccaatgctagatacaattcgttctttattcgaacggtgccgcgtcgttgcgcgaaacccgcaaaaatgggtatttcgcgaaaaccgcataaaagggcgttgcgcgaaaaccgctaaaattttataattaatttatttaattgttattaagcaaattaatcaaataaaattattttataattgatttttttaaattattaagcaaatttatctcaaataataaaacatttgtataacattcatagatttattttttttgacaaacaactagggaaatctcgactgtaatatatttactcaaatgataaaaatatatataattttatccatattttaattttatattcttttgatggcagatttaggaaatgaaaggagaattcaggaaatacgctggttataagcccatttggcggatttagcaaaaaagcatggatggcggtttttatgcaccaacatctttgaagaaacagaatttgctctttccgatatgattgaaactattggaattttttattaaaaaatttatgacgattgttcaaaattcatagattttttagtacccaagaggtcaaactcgtaaaaaaatttactaagaagaaattctttggcgtgccataaagccgcaatccaaatggtaggtcgttaatcctagagaatgactaaaatatggattatgactcttaacataaataaatggtgatggaatgtttgattataatcctatttctgatgaaccagcatttgaaattattagctttattatttaatattataataagttatgttaagtattaaatagatttggataatcctactgctgaattgactaagcaagagaatataaaccaactttatttacttcgagcggggacattttcaagcaatcatggatccaaattgattgaattaaatgcttgattatagattatatttattagggatttactttaa

SEQ ID NO: 30268 - DNA, 974 bp, Heterodera glycines
ggggaggaaaaagtgatggccaatgggaggaagagggaagagtggcaaattggagagggaggtgaagagaggaaaggagagagacggaaaagggggaggaaaaagtgatggaaaatgggaggaagagggaagagtggcaaattggagagggaggtgaagagaggaaaggagagagacggaaaagggggaggaaaaagtgatggaaaaatgggaggaagagggaagagtggaaaattggagagggaggtgaagagaggaaaggagagagacggaaaaggggaagaaaaagtgatggaaaatgggaggaagagggaagaatggcaaattggagagggaggtgaagagaggaaaggagagagacggaaaagggggaggaaaaagtgatggaaaatgggaggaaaaaggaagagtggcaaatgggagagggagatgaagagaggaaaggagagagacggaaaagggggaggaaaaagtgatggaaaatgggaggaaaagggaagagtggcaaatgggagagggagatgaagagaggaaaggagagagacggaaaagggggaggaaaaagtgatggaaaatgggaggaagagggaagagtggcaaattggagagggaggtgaagagaggaaaggagagagacggcaaaactgttcatattgtctcgggttttttgggtctcggtctcggggttttcagtctcggggtcgggtctcggggtcaagtctcggtctcgagtctcgggaaattttcggtctcgaacatcactaattctgagcaatgtccacaaaaatggggcacctgtatgagtttggctacccagatgaaattgccttccaattagtacccctcattattgcagaacagcgtttttctgatcacccattcgtcgggctcgggaaaagccatcgacgtggtgagcgagctgctggaacagattgaggaagataacggcgtaagtgcaactgttggctctagtg

SEQ ID NO: 30269 - DNA, 1871 bp, Heterodera glycines
tttttccatttattcagcgttgctgatccaatccccaatttcgtggcaattatttcgtcactaattttgaagtttctttcttttagttcaaaatattgttgcatctttttaaatttttcattattcgagaatggtgaattaaataagaaaaaagtttttttgaaatttctcttactattatggtaatttggcaccaattcttttttccatcgtataaaggtcatttccgaaatgcccaattctttcacaaattctttctgctgttttctttgggtacatatataattctttaagttcatcaaatcgttcaataatttctttcattttctcctcaaatgcgctttttaattttgtttttgttaaatttaattcattttcccatttctgtattaaatttctatttgttcctaataatcttccaatttttgtctcagttttactttgatctttccttttgtatttccctttcaaaaccatgacaatgaatgccctggcttactgtagactcctttatatcccattattaccatttcaatacagtatgcaacagtaacgactttattccgggaaaggaatgatacaattcttaggctctctacctacaataattcggctcgggaacagatactgcccggagggagaggccagatctgagtatagtgatcgagagctcgaccccgggagcgtcattaacgcgcgaggggactcttgagaggacacccgccgattatgagatggagtggattgtttgagacacccaatacttgttaaatattgaatagaatgacgattcataatgatcgatcatataaaatcactgatctattagtggtagaatattgtttcttccaccttatcagcgtttctcgtgagatttccaatttagtggaaattatttcgtcactcatttgcagattggctatttttattatacaatatcgcttcatctttgtcagattgtcggcacagagttttgggttgcttgatacagttattagaattggatccatgcctgacaaagaaaattttatgggcacctatttataggacagaatacagcctaaataatcgattaattttttattttatgaattattaattttagccattaaaaaaattggatgaaaatgtaaattttagacaattttttggaatttacattttgatattgattttaaatttgtaggtacaaattaaacatgaattgcattactttttcagaatgtgtcgaccatttagatatgctattttatattataatcagattggcataatttcttttaataatggcctagtaacaccgaaacaattcaagagaatgatcagcataaatattctaatcaaatataaatttgtagtaatttgttagagaatcaaattttcttgaaatagttataaatttgacccaagctgacaaagaaaattttatgggcacctatttataggacagaatacagcctaaataatggattaattttttattttatgaattattaattttagccattaaaaaaattggatgaaaatgtaaattttagacaattttttggaatttacattttgatattgattttaaatttgtaggtacaaattaaacatgaattgcattactttttcagaatgtgtcgaccatttagatatgctatttgatattataatcagattggcataatttcttttaataatggcctagtaacaccgaaacaattcaagagaatgatcagcataaatattctaatcaaatataaatttgtagtaatttgttagagaatcaaattttcttgaaatagttataaatttgacccaagctgacaaagaaaattttatgggcacctatttataggacagaatacagcctaaataatggatta

SEQ ID NO: 30270 - DNA, 1317 bp, Heterodera glycines
  misc_feature (1257)..(1257): n is a, c, g, or t
ttttcgaacttttgcttaatgctattataacaactcatgcagaaggattcgaagctgtaacatatgttttaaatttaaaataatagttttatttcaagaatagaaaattgaaatactttttttttcaaatactactttggctttttgttttacaatttaataccattttttccatttacttaaataagaaagcaatgaattaaaggttattttataaataaataattttttttgtttattttttaatcttatttttgctaagatcataagtttctgttttattttgttttttatttccgtatatgcatttcattttttagaattcatttaaatcttaatttacttcctttatattctttgtaataattgatccagtccacggatgttggggaaggaattcaaattcttctactccccttttaattttcttttgtattcgggtagcatatcgctcactcttacagatcaggggccttatacccgttttggcagttaaaataggtaaaccacggttaagaaatttaaatcaattctcgtcttcaagtttttaaccatgtttaggcttaacaacggtacctcgattaaagggatgtttaatcatggttaacacctcaaaaccatgccttgcatttttaggtattctcgttttcccatactaaacagcgttttaatttttccctaatacttttaaccacattttatagcatgtataagcccttggataagagaacttttaataatattcgattaaaaatcgttaaaaaactttaaaaccgtcaaaaatgttaatttttgttttgtatcctttattatttttacattattttctttccgagcaattatattaatttttatgcctagcattggtagttaatttataattttaaatatttggtcgctttttagatttttaatgtaaatatattgtttatcatacttgaaagcgtcgggcgcaacattcgaaagatcgtcgtcgttatacactgctttataaataaaatttgaaattatttgattatagtattataaatatttttttacttatattaggtttctattcatattccttattaaaaagtttaatacttaatagtttcgttctttttctcttccaactcataggtagctaatatttttcagttttttaatgtttacattaattttacaaataattttacaatatagttagattacatgaaaattttaaatatttttgaagtcctgtttttacagaagtctatatattttgtattccanattatgttttggaatttagaaggtggtttttatttgtaaaatatgttgaactgatttatt

SEQ ID NO: 30271 - DNA, 1203 bp, Heterodera glycines
aatggaagacgttggcactgaaaaaggccacgatgcctgttcaaaacgcagagctgtttggattcgtcatccaattccatttgtaggtatgcgtcttttaagtccaaatttgtgaaaaatgcagcgccgcttatggctgcataaatgtcatcaggccgagggagtgggtggcggttgagttcaagtgcattgtttaagccagttgagaaatcaatgcacattctgattttgccatttttctttttgacggccaaaatgggtgctacccaatggctaaattctatcggattaatggcaccgatctgtaagaggcggtccagttccgtgttgactgcttccagtgagccatgaggaacgggtcgggctttacagaaaaccggtcgagcgtcggatttaagaatcaattgtgccttaatcttggtacactgtcctagctctttaccaaaaacatccggaaaattttctttgagagccgtcgtgagtgacttaacatcggctatttcttggaaaggtgcggcagatgatgctcggattccaaccgatgtgtgcgtctccggaaacatgatttctttgggaatcagttccgttgcctcaatccatggcaaaccaaacaaatcgtaattgagctcttcagtcacataagctgttagctttttggctggttgtcccataatgctgacaagacatctaaatttgccaattgttttaaatgtgacgtcgttgcagttgcgagtctcaatgtcggttggcaacaatttaggttgtcctaatttaatccatgtttcaatggtaaggactgtcgcctgagctcctgtgtcgacattcatttcgatttttgtgccgttaatttagaccaaaattgtccaccaccgtccttgagtcgtgccaatttgtaggcatgttgctttgacttggaccgtgtgaaatgaacggcgttgcttctttgtcgtgaatgctccctttcggcaaacattagcaatgtggccttgtttttggcacttgtggcatgtcgcttctcggaagcgacaatctgatctccagtgatcagtaccaccacatgagccgcacggctgggtcggttgtccacgaattgcttttcctcctgtggccggtttttgctgtgccgggtggttttgttgcacggcatttgctgatttggccttggtttttgattctctcccactgttgagggcgagttcggat

SEQ ID NO: 30272 - DNA, 1451 bp, Heterodera glycines
gtacattccccctccccaccttttatcattacccaaccattttttaaattttcaaaaaaagaaaatatttcaaaaaattcataaaattggcgataaacacttaaaatgagaatctacaattgaaaaaacgtcgtaatttgagttgacaaggcaaatttttatttcaaactttgtgatttttatttgccaaaaaacgcagccctactaattacgctaaagatgtaccatccgccaaattggtggctcacaatcagttggttaaattactatttttgaaggtccgggttcgaacccaacatgaatcatgttctcgattttcgtccctttgtctgatgaagcgcatatttagtaagacaaccattgcagcaatattttttgttacacaaattttcttcaaaacactgactgaaactgaccgtcactgagttgttggcacattcaaagtcaaacagtgggcccggcacttcgccaaccgcaattgtgaatgccacaatgaaatggatggcctcgcaatggaacactttgatagccggatggcattggttgtggctggacgaagtgaaaatggaggaggatgaagaaatcgaggacgtctcagtggtggtgccatgggcagaggaggcggaggaggacgagcagttcccaatgttttttaccggccttttacgcatccactgaaaaattttaaaaatttaaaaatggtttttttttaatttttagggcttatagaataccaatctttggcatcatgacaaaatacccaaggaaatgtacctcataaaataaattgagaaatttcaaaaaatctaaaaaatattatgacaaatcatacaatgtgggttggcaacttagaaaaaattttgagaaaattaaaaaaaaaacaaaaaatgatttaaaattttgtttttagttattatcgaatttttttaagatctgtcaaaccccttcctttcaagcacccaattttaagttgttcatgtactagcaatatttttgaaattaaaaacagaccatgatcaaatcgtggagatggcagtcaaatttcaagcgtgcaatgtctttgacaatgttcgaggtcagataggccaggccaatttcaaccctaaaaaacagtcaaaatcaatttcatattttgaaaaaagagtatggaaatgaatgaactctcccaaaacaaaccttaattggaatggagaggacggcgttgtcaagcagtggtcatagcccacaaaaacactttgcaaatggacatgcatatttgcctaacataaggaaattagttgttttttcgtttttaaattgtgttttttttaaaacttttttcaaaaaattccatttgcccactcccccgccaagaaatcgaataaaatgcttaattgtaagaccatcagtacatcccccagcccatcaatacacacttcaacttttggcagcacatagcccggcactccttc

SEQ ID NO: 30273 - DNA, 1515 bp, Heterodera glycines
  misc_feature (10)..(11): n is a, c, g, or t
  misc_feature (27)..(27): n is a, c, g, or t
  misc_feature (35)..(36): n is a, c, g, or t
  misc_feature (47)..(48): n is a, c, g, or t
  misc_feature (77)..(77): n is a, c, g, or t
  misc_feature (1333)..(1333): n is a, c, g, or t
  misc_feature (1367)..(1367): n is a, c, g, or t
  misc_feature (1438)..(1438): n is a, c, g, or t
atgcctgcannggtcttgcaaaaatanttgcaaannttcatataaanntagcattttcaattaggaagaaacaattntggagaagaaatgtttaagaaaagagcggaagaagaagagtgatttatttgtttgtgattttcaatttattgtcgcttttttctttcttaatttgccaaattataaatttcctatttttcaaagaaaattggaattagtcgtttagatattgaaagctagaagaaccaattgaaaaatggatcaactaatttggcattcacacctatgcattttctaattaaatttattcaaaaatacaccaaatttctatgtatttaaaaaaaaaattctgaagaatttgaaatttttatccaaaaatggttaaaagaattttttgtgttagatttcgagggcgctttcataagttaagtcccggattttttttagtttttgtgcatttttgtcaattgttacaacccaaaattagtataaaaattatttatttatttatttatttatttatttatcgagcaaaccaaaggcacatgagtgctcttatatggtgccaaaaagaaaacaacaaataaagttggtcaaataaaaaatacaaaatgaatatcgtaataaaaaaaatgaataaaaataaatcaatcaaatgttaaaaattcacaggtgataaaaatatagtgtaaatatggcaacatggaaaatcctactcagaactcattgcttttagtaaacccctgaattcctttgccttattaatttgcaccgctaccactggaaggttattccagctttttactattctattgaaaaaattattttgagttttggccgtgtggcgctttactcgcaaaagtaaaggcctcctgggcctttccgagaaaaagaaacttttttcagcatcgaggctggtgaacccttttataattttaaaagctgttgttaaatcattgatttttcttctttcttccaatttgtgtaaatcagtgatttttagtctttccttatattttctgtacaaaaaaccacattttctaaatgcttttcttgtgaaaaatttttgaacccgttcaattttgtcaatgtctttttttaaatttgggttccacacttcggtagcgtattctaattgaggtcggacaaaagttttataagctgttgttagagtctttatttccctggtttttaagacttttaaaatctggaaaactctaagataagcgtttcgtacaattttgttaatattttctgaaaaattcagtttcgagtcaattaaaatgcctaggtcacgaacattatccgattctgaaatcttttttgagttaattanataatcttttttcatattatttttccctaaatanagaacaaaacatttcccagttgaaattctaacccatttatttttgaccatttttccaagcttcattgcttntatctaatgattgtttatcatcatttcatgggcatatataatttacatcatcgcatacattttatgccactgatgat

SEQ ID NO: 30274 - DNA, 433 bp, Heterodera glycines
gagtagagaccggacgggatcgggatcccgcgggatttcttcgggatcccgctggattaaattcgtgatcccgacctcgggatccgtcccgagcaattttccaaaatgttcgggattgatcgggatcgggatttcaccgggatccctcccgaccatttaccaatcccgcgggattggtcacgataatttttcgaaaagtctccattttaaaattaagatcttgaattttaattaaaaaatattgtcatttgctaatttttcttaaaaatcccttaaaaatgcgaaaaaattttacgggtctccaaaattccactaaaatctcaaaatttgacgcaaaatttggccattttgtgactttttccaaaaaagaattgaaattttttttttattcttaaaacaaaattctaaatcttattagctggggctgggctac

SEQ ID NO: 30275 - DNA, 1657 bp, Heterodera glycines
tcctcacctgtatttgtccgtgtactgcttgacagcgtcgcaatactcttccattgcctcgtcaatttccgtctcgcaccactgttcaaactccgaatcgttcagatggcccatcggaattggcacagtcggaggaggcggaagttgcggagattcggacacgcgctcatcctcaaagtcaataggaacggttcgggtgccctgcaaattaaaatttgctaaaaaagtaacaaaaacgctgcaaaattcaattaccatcgaatggtgcgaacttttcggcgtttccgtaataaatatgcgggttaaataataaaggatgaaaatgaacatctgggtttttgaaaatcaaagaactttcaaagaatttatttaaaataggaatttataaagaacggaccgtgccgggcccggcaccgctttttgtcggcccctgtgattttggaaaacttcagtttggagaggccggtcccggaaaccagttgcttctgaaaatatcagtccggcccggcagatttgaaaattccgatctctagaatttgaacatgaaaaatggatatttttgaatttttatcaaaaatattctgtttttagaagtgtatttgttagaaacctaaatataataatacctatgaatgttaaattaaatgtgactatttttatcagatagaatatgctaattgtttttgaatacgcttttgatttgctaaatctatgctttccgcacatgcgattgtaaggattagccagtggacagttaaaatgcataaaacccaaaagggaaagacaaatgagcattgcaactgctggtagctcagagggtaatttcgtccaaatgaataatagaaatgttcgtttaccgcttttgagatttaatggaatttttttaatttagtcaatcactgcctcactcggtcacttcgcttacaaattagtgtcccaagctttaaacttgcagtccgatgaaaaacataaattaaaagcctttccgtttttttttggattttcgagacagatttttggctttcaaattgaaagcgtgattcataggcctgatttaagagcccaaaaatgtcgataattcagattcttcagttctcgggcggggattccgatttccgacaaaattttcttttaatgtgaatttcatgacaaatttttgaccaacacttgctggttcgtggtccacgtgtcttccttcaatcatgggctttttatagaacacaaagtgcacggactttgcaaattctcatgcgtctcaatgggcgagtgcttttgatgttgttgtggcacggcatggcactgccggcaccggtgccaacaaccgtctcacatcgcccaattcgccatgagcaaattgacaaagtccgtggcctccgttcctcggccactcctccttttttggcccgtctccccacgccggtgccaccattttgtgaggggcaaagcattgcccgaaattataatttgatgcagaatttttggcaccgaacggccctcagattttcataataatactcaatgcttcttcattcgtcagacattgagatattttgaaaatctgcagtccattccgagcgctcataacacacacagtagtgaaaacaatggggaatacagtagtaaattgttatgagggaatgaatcattggagaagact

SEQ ID NO: 30276 - DNA, 2201 bp, Heterodera glycines
  misc_feature (22)..(22): n is a, c, g, or t
  misc_feature (60)..(60): n is a, c, g, or t
  misc_feature (64)..(64): n is a, c, g, or t
  misc_feature (117)..(117): n is a, c, g, or t
gagcaaatgacaaaatattacnatagattgcctcatttttttttacaatttgaaattttntatntgataaatttatttttcttaacattttatctatcttaatttacctgcactttntagggttaaatccatgatcaaacagggatgtgccggggaacatcaccaatccagagaatttccttgtgccgaattccgaatcccgccccgaaaaagcattggcccctatttttcgtttcgtgccagggaaggcacggaattctgatttctgacatttttggggtcggaattacgatttccgaaatttttggacgtcggaatgccatccttgggccgcgcctttttttgtgacaggcatctccaatttgagcatcacaaagtttgggctaaattaaaccattcggtaaaattaatttaaaaaataattgtaataaaatttagaaaataatataaatttgtttgctttttaatgtcatgcgccaaaatatggagatatgcacaaataataaaaatttgtaaataaaaatatttttttatttttatttttcccatcaaatgttttcccgaccatttcattttatgcttttagcaccgtgacatgtcacataatgataaaaaattttttttgttattgatgacacaaacaaaattagcatcagctgacacgagaaagaaattatgatttttctttttgtataaattaaaaaaaatttcccacaatattcatactggcatagctattatttttctcgtatacacttaatagaaaactcattctcggtgaaatggcaactcgtataaaatttctttgaaaaaacaattaaaaattaacttttttttataattttcaataaaaaattaaaaaagtaataaaatccgaaaaaggaacataactgatatttgattatttttaaaatattttttatccaaattaacaagtttttcacacatacaaaattttattttaaattaaataatatagaaattaattttattccgacaactttttttcaacactaattactcccctcgatttaaatttttttgatccgcataaaaatgctgatgattacgctggcatttgtgaaacaaattgtgaagttgagcctgtttttcaacggcatttcctgggatggcacggactgcacttcgttgtgcccggcccaacaaatggtgtccaacattggccaccaaaaaccacgctgattttttgtggtggcttcaaatgatgatcaaaaatgggacagaaatgcgcaaattttttgacataatgcttgaacagatcaaggcggaggtggaccaattcaacaagaattgtgaagaaattgttgaaaaatgggcacaaaagcacaaaaaatcgaggacagcaacaaattcatcagcatcaatagcatcatgccaaaactttggacaaaatgtgccaactttgcaaagttattatgtctattatcaactattccggcatttgaacacaatcagagcagcacaaacggttaattagggtgtaaaaagggcaaattagtatcattaaaaaagtgggaaaaaacagtattagtggaaatcaacattcaaatttattacaaacattaggtacacccaaaaattgggaaccaaaattaagactttccaaaaattcggtcttagcaagttagggtttctggaattgtcattattctactagctatttttttacacagttatttgtccaaaaatgccaattaaataagcacttttttgcttataaaaattaaaactctgaaaattaaaaaaaattaataattttaagttaatataaaatttccaactttttagatgacatctgagcactatttgctcagttattgggttgccacaatgactgaccaattaaaaatacaaataaaatattttgcaaccaaaaatggatgtgcagagatgattcaatcgttgatctgatcattattttttttacctcaatttggttttcgaaatttttttttgtgcgaaatttaataattgccataattattgaattgagcctccggggtctgtatttccaatcccttccccttgaaaggctctgtggggatggacctaaaataattcaataaatatggtaattgaatttttttgtcaaattttgaaatttatcatataattgaagctaaatttcggcatttcaggccaataggcattccttgctaattcctcaattagactaatta

SEQ ID NO: 30277 - DNA, 1349 bp, Heterodera glycines
  misc_feature (210)..(210): n is a, c, g, or t
agaattgagtcccagtattggaatgctggtggcctgattttcattgattggaatgtcattgaaagttgttgggttgagtcccagtgtttggatgcccggagattttagtcccagagattagaatgccggagaattgagtcccagtattggaatgctggtgggttgagtttcagtgattggaatgtcattgaaagttggtgggttgagtcncaatgtttagaatgccgcagatttgagtcccagtgttttggaatgccggagatttgagtcccattgtttggaatgccagagatttgagttccagtgattggaatgtcattgaaagttggtgggttgagtcccaatgtttagaatgccgcagatttgagtcccagtgttttggaatgccggagatttgagtcccattgtttggaatgccagagatttgagttccagtgattggaaagcctgagaattgagtcccagagattgaaatgctggtgggttgagtcccagtgtctggaatgccggagatttgagtcaccgagattgaaatgctggtgggttgagtcccagagattgaaatgctggtgggttgagtcccagagattggaaggccattgaaagttggtgggttgagtcccagagattggaaggccattgaaagttggtgggttgagtcccagtgtttggaatgccggagatttgagtcccagagattgaaatgttggtgggttgagttccagcgattggaaagcctgagaattgagtctcagagtttgaaatgctggtgggttgagtcccagagattggaatgaaattaaaatgctggtgggttgagtcccagtgtctggaatgccggagatttgagtcccagagattgaaatgctggtgtgttgagtcccagagattgaaatgctggtgggttgagtctcagagattgaaatgctggtgggttgagccccagagattggaatgccattgaaagttggtgggtgagtcccagtgtctggaatgccggagatttgagtcccagacattgaaatgctggtgggttgagtcccagcgattggaaagccttagaattgagtctcagagattgaaatgctggtgggttgagtcccagagattggaatgccattgaaagttggtgggttgagtcccagtgtctggaatgcaggagatttgagtcccagagattgaaatgctggtgggttgagtccccagcgattggaaagcctgagaattgagtctcagagattgaaatgctggtgggttgagtcccagagattgaaatgctggtgggttgagtcccagagattggaatgcctttgaaagttggtggggttgagtcccagtgtttggaatgc

SEQ ID NO: 30278 - DNA, 1231 bp, Heterodera glycines
  misc_feature (1141)..(1141): n is a, c, g, or t
aaatcatgttttcccatctccctttctcccaaggggtattattttgtaaaagctttttttcaaaataaactttttcaaaccccatttttcgcaccgtgaatgttatttttatgaaattctgaaccgttttgagtagattagactagaaaaaattgaaaattttgaaatcatgtttcccactcccttctctcaggggtattattttgtaaagtctttttttccacaataaacttgtcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactataaaaaattgaaaattttcaaatcatgtttgccactcncttctcccaggggtattagtttgtaaagtcttattttcaaaataaactcttcaacccccattttcgcaccgtgaatggtatttttattga

SEQ ID NO: 30279 - DNA, 960 bp, Heterodera glycines
atgggcatgcagttggacccgtgagcagttggaatgggcatgcgtggcacccgtgagcagttggaacccgagggcttggcttatgggcatgcgtggcacccgtgagcagttggaatgtgcatgcgtggcacccgtgctcagttggaatgggcatgcgtggcacccgtgctcagttggaacccgagggcttggcgaatgggcatgcgtggcgcccgtgagcagttggaacccgagggcttggcgaatgggcatgcgtggcacccgtgagcagttggaatgggcatgcgtggcacccgtgagcagttggaaaacgagggcttggcgaatgggcatgcatggcactcgtgagcagttggaatgggcatgcgtggcacccgtgagcagttggaatgggcatgcgtggcacccgtgagcagttggaatgggcatgcgtgcacccgtgaacagttggaacccgaggcttggcgaatgggcatgcgtggcacccgtgagcagttggaatgggtatgcgtggcacccgtgagcagtcggaaagcgagggcttggcgaatgggcatgcgtggcacccgtggctagttggaatgggcatgcgtggcacccgtgctcagttggaacccgagggcttggcgaatgggcatgcgtggcacccgtgctcagttggaatgggcatgcgtgggacccgtgagcagttggaatgggcatgcgtgcacccgtgaacagttggaacccgagggcttggcgaatgggcatgcgtggcacccgtgaacagttggaacccgaggcttggcgaatgggcatgcgtggcacccgtgaacagttggaacccgagggcttggcgaatgggcatgcgtggcacccgtgagcagttggaatgggtatgcgtggcacccgtgagcagtcggaaagcgagggcttggcgaaggggcatgcatggcactcgtgagcagttggaatgggcat

SEQ ID NO: 30280 - DNA, 1221 bp, Heterodera glycines
cgaagctggcgaaaaggcccaaaaatcttaaacgggcgcgaagcgcccgtctgaggccgcgaagcggccgaaaaggcccaactaaatttaaaaacgggcgcgaagcgcccgtctgagctcaacaaatttaaaaaacgggcgcgaagcgccctaagcgcccgtataagttcaacagatttaaaaaacgggcgcgaagcgcccgtccaaggccaacaaaaattgaaaaacgggcgcgaagcgcccgtatgagttcaacaaatttaaaaaacgggcgcgaagcgcccgtcttgagcctcaatgtggactaaaaacctctaataattttttaaaaattcaaaaaatctctctaaccaattcgatcaagcgcccgtactatgccgcgaagctggcgaaaaggcccaaaaaatttaaaaacgggcgcgaagcgcccgtctgaggccgcgaagcggccgaaaaggcccaactaaatttaaaaacgggcgcgaagcgcccgtctgagctcaacaaatttaaaaaacgggcgcgaagcgcccgtctgaggccgcgaagcggcctaaaaattccagataatcttttaaaaattccaaatctcttcacaacgcaatagcatatctaggtagcgaagctcccaaagcgcgaagcgctttttccggtcttacaactttttgaggtgcatccgggaaaactatagagaaaaattcagcgcggacgactgagtcccggggaccgatttctcactttttcttgcagtttagggcccctaactttttttctaaaacccgaatcaaaaagtgcccgctgtgagggcactccccacaactgtcctctacatgctggtattttttattttttgatcagaccaaatcccggacctgtacagacacggagactcagttaatttttttttcccacttcagtaccaggcgaataactcattaggatttgacctgagcgcagggtggccagcagacttattgtagagctttaaaagcccgatttttccaaattttaaaatttcgaaaattttcaaaatttttcgatctaggcctaaaaaacggttttcgggtttttgaattttaggattttttaacgaattttcccagaaaaacgaagaccacttccaaaacatagtttttcgaacaggatcgattggtaatttttttggaaaattttcgatcttggaggggaaatagaaaaaaatttggcctgagcgggacattt

SEQ ID NO: 30281 - DNA, 1009 bp, Heterodera glycines
  misc_feature (37)..(37): n is a, c, g, or t
aaagaaaaaaacttaattattaatacggcaaaatatntaattaggaaaaaaagtaaaaaagaaatatgaggcattaaattgccatgaaacttctgcatttttcaaaaacgaggaaaatgggtgataattaattaacctacaattatttttgaattttttttaaagaatgggacccgagggcataattaaattcgatgcctatttcacgatccatcagctattttaatctcttttataccattatttttcactatgatttcttcaaaaaaatacttttgggggaacataagaaaggagtcctgctgatgtgcctgcctgtacgccgtcggcaaaatttttttggaaattttactcaaattttttaatagattttcactaccaattattgaggtgagatagcacaaaaagaaatttctaaaaattagctgaacaaccatgttttgagggcatttcgacttttttattttccaatatttatcaaaaatttaatcgaaactttcagttaaaaaaaatttctccatcaaatattttatgtggaattactaattaggtgtacaaattgtaattgcttaacattttgatgacgcggatagccgccgaaatgcacacgaacatacagcggtagaggtcaactccgtctggccaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagttgaaaaccgcaaaaaaggcagaattttcgaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggccagacggagttggcccgttccgac

SEQ ID NO: 30282 - DNA, 880 bp, Heterodera glycines
ttgtaaaatgccaaaatcgccattctattggctttttcttttcctttatcggaatgccattggcatcccctctgcttctcttcccttccctttcttccccctccccctaccaacgatggcatttcatttcaattatttgagattttctgtgcgctaaaacttgagatttaaaaagaagccaaaacatatgatcactcgaaaatggaaacccaaataaaagtatgtcaccaaatttcagactgccccttaggcgaaaaattcatcccttttatccctttattctccatcctccacagctctcttcctctctctctctctgtccgctctctctctctccctccctctctcctcactctctccctccctctctccttttcggtgctctaattaaccgcgataaaaacatccgaataaataaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacatacttttggaaaaatatatttgcaatttatcaacaattttgagaagtgagttagaaatgataaacttcacgattcaaaccaattttcgttgctctaattaaccgcgataaaaacattcgaatcaattaaatagcttctgagataataaggttatcataaaattcatttaaaataaaccctc

SEQ ID NO: 30283 - DNA, 1664 bp, Heterodera glycines
  misc_feature (94)..(94): n is a, c, g, or t
  misc_feature (168)..(168): n is a, c, g, or t
  misc_feature (191)..(191): n is a, c, g, or t
tcagcatcatccgtgtgtgtgcctaaccgctcgaggaggtgctcgttcagcaggtggaccgcacttcgcgacgggaagttaaggacggatattngctgccgcaggatgcgtaccgaaaaggcacggcactttggctttgaaccatcaattctttcccttacggttttnagcgctcgaccgaatgcgtttgnaggcgcgtcagttgggaatggcggtggaagagtgctttccggattggccaaagcttcggcaacaatactgtcgcattcggaaacaagcagtcagagagcgcatgcagcgcaattgggagatgatggtgatgatgcacggcggagagagaatgatcgacgaagactttgacgggcaggagcaatattacgacggatcaggtgccaccctaattaaaaaaagtttttgcagtaataaaggggaagggggccggggtaaaatgcaatttttttaattgaaagttggattttttagacttttcttatggtcggcaattacaacaaaaacatcgaattcctcctgacattgacatggacgtcgatgtggaggacgacggcgatggaaatttgcgctgaatgagacgagaaaagggaaaatctcggctacatgacatttcgcctactaacccaaaaacattcatttcgcctactaaggtaaaatcggacattttgcctactgacatttcgcctacttgttattccgcctaccaagccaaaaacattcatttcgcctactaattagtaggcaaaatgaatgtttttggcttaataggcaaaatgaatgtttttggcttagtaggcgaaatgtcagtaggcgagatgtcggtaggcgagatgtcgagtaggcgaaatgtccgtacaccaaaatctccattcttctattgactattaatttgtttttggtactttttgtaaatgcataaatttgtttatacttttttttgaatcctcaaaggtttctctcctacaaattatctattattttcgtttttaatggtaaaacaatttttaaaattcaaccttttttatttgcagatgaaccgattaacaaaaatccaatcgttgaacaaaatcaatgaacgggagctgagcttgggcatttccggcgatttgggcaaatcgtggcaccaaaaatacgccgattcggcttggatttacgtgggcaatttgccgtacgatctcaacgaaggcgatgtgcttgcagttttttcgcagtatgcatgttattttgttatttattaaaaaaaatttcggctaaccgacataattggtgattttttaggtatggagagatagtgaacgtgaacctggtgagggattggaagacgggcaaatccaagggcttctgcttcctgtgttaccaagaccaacgctccacggtgctggcggtggacaatttcaacggcataaagctggtcggacgggtcatccaagtggaccattgtgaaaactacaaaatacccaagtgtgtattggtggctaacacatatttcctgcctaatccaataagaattcgaacaaaaaagtcacaaatgaaattttactttatgcccaaacggcatgaaaaaaattgattaggagaaaatgccacttacaattagaaacaattttataacaaatgcttttaaagatttcgtgaggacgtgccggaggaaa

SEQ ID NO: 30284 - DNA, 2228 bp, Heterodera glycines
  misc_feature (757)..(757): n is a, c, g, or t
gcagggctcggatctgttcttatttataagaaatgttctgatttcgggctattgttcttactttgttattatttcttaaaattcttcataaatttagaaatttatggcataaatgttcttattttacctataaattttaaaaaattaatcatttcgtcactgctcgtttcatctcttatgagaaaaattattaaaaattatttatttaaaaaaaaaagttctcagtcacgaaatacagaaaacacattaattaaaaatgagaatttgaaaaatggaaaataaatgaaaatttggaaggaattaagataatttaattaacaagacttcttactcctcttctactattcattttttaataaaatgattaaatatttgcatataatttagtcatttaaaacaaaaaacaactcgttgttctatcattgaaacaagtgcaacaagaaatttatattcagaagcacagatttggcttggaaaattaaaataaatgtcttataaatgaatgaaaataatttgaacatttttaaattaaaaaaaatatataaatcaattaagaatataacgattaaaatttaaatgaaaaaatgaaagtcgcaaaaaaattattggacaaacattggcaatggaaaagaataacaaaagaaaagaatggttgaattaaacaattacacaaaatatgaaaaaataatattaataatatttaaaataaaaataatattttatagtaaaaatgcaaaagatttcaaaacggcattanatacagcagctaaagaacagccaaaaagcagcagcagggttttggagccattttaaaaagattttgacgaaaaagagaaatgcaataccaaatattcaaatgctgaaaataaattaaattagatattaaaactttctttttttggcaaaatgcttttttattaccctttttgaaaacaaaaaaatttaattaaatattagaaaattcactttcattttgaaaatttttgtgcatattttcagtttttatatgtgcgtcttttgcaatttcatataactttacgcataaataataaattaaaaaacagcaagtacatataaatatgaaaattaaaaaatttctgtaataaattaaataaattttaattaacaatttagattataattttaataataaaattatagaaaatgcaaaaaaaaacattcatcaaagaagagaaaaccaattaatgtacaataatttaaaaggaactttcttaaatattcacaattaaatagaagtgatactgaaaataaaaaaatatattttggcaaaatttaaataattgaaaagaccttttaaggctcagcacaattttaaaataataatatcaaaaaattaaaaacaaaacaaaaaagaaaataataatgttattttaaagtaaaaaactgagcaaaccccattaaaaaataatgctataactataactatttaaaagcatgtatttaattattcataatttgacgagacaccacttaaaaaatgaatgagtgcgcgaattaatggacagaaagacactaaataattaacgaaaaaaaaaaatcaaaatttgcaaaaaacataaataaattatcaaattgcgccgtcaaattattacaaaatcaaaataagttcgaacaaaaggacatttaatttaaaatgtttaataaaaaaagatctgaagattacataaaagacatatatcagggatgttgctcgtctcgtgtctcgtaatctcgtattctcgtgttttagaccgtctcgtattcgtgtctcgtatctcgtattttggcacgagacacgagatttttatgcactggtgagaatggggggggggggggggtaagaaaaaatattttttggaaaaataaagaaaaaaaatttttagagaggaaacaaataatttgatctatcttttaaatcaaaataatattgaacatttagtctataggctaaacctccagccttccattgatttctgcctggttctagtcccacacacagtaaaattattttcttatttttattgttaaaattattttaatttattacgaaaatttttccaaccacaaaaaataaaaacaataaaaatatttatttcatttttttaaacatagccaaaaaaatcaattattttttatttcggcccgaccaatttttcgtaaaaataacaaaaattttgaattttattaaaaaaaaaattcgtctcgtctcgtggctcgtattctcgtat

SEQ ID NO: 30285 - DNA, 876 bp, Heterodera glycines
aattttcatcattttattttataaatggctttttcgaccgtttgcatgttaatggattttttcaaatggatggcttttggagttggcacaatttgcaatgtactaatgagccgcctgattatttggcacactcccaaattaatgcgaatttacagcaaagtaattataaataaaaaaaatttatctttttgaaataaaaactttttatttatagattttattgcaaacttgcgcagctgatcttttattgctcataatgaccatactttttattccggtaataataattgttaaattcaatattattaaaaaaaaatttcaaaaatttttaaaaaagtaaatgaaaaaagattctttttttgaatttattttaaaaaattattgaaaaaagtaatgctaaaaagcacgaaatttaagaatttctacaaacaaaaatttgtcagaaaattataataatttatttccaaaacaaagttttatgtcatttagtacacctttacaacgaacaaaggcgaacagatactgatagcaggtggtttgatcaatttgaatggatcaacggcagaaaatcatggcttgattttgctagcctctgtttcttggacttttctcgtaatggcatcattgtttagctatgtgtcacaattcatttaccgttaccttttgttaaattggtctgcaaacattttaacttttacttaatttgaaagaattggataaatgggcaaaccaacaaattctaaaaatttctaaaattgttgattttttggcaaaatttgagggaagctaagaaaaaagcaaccagtggcgcatggataaatttaaaatttttggaattaaatttccgtttaataatgtgcattttttggagattga

SEQ ID NO: 30286 - DNA, 1278 bp, Heterodera glycines
tttccatataaataaatgggcactaaaaatgggagaattccttatgaattgcttttcgaactcatttccgctcttccgtttgacattcgatgggccgtcacccgggtttccaaggcttttgatggttttgtttggcagaagcaattttcatgggttagagctgaactgacccgcaaggaagcacaaaggcaaaaagtaggctaattactcgctaattatgtggggttttggcacaaaaaaattggcacaataatggtgagcacatttgtaatgcttcttcatttagaaactcgagttccaggaagctgcccaatctctttcgacggctgcccactctctttcgacggctgctcaatcgctttcgaactcggcgttcaacaaaaacaaattgttcttcaatttgcttaccaagcgtacgatttatttgggcataatgttttacaatattctttaatattttcagaaatgtgttctgttcgccaacttaccgttgacatgttgcaggtaataaagaaatggtaaaaaatattttgtaagttcggtttggtacaattaatagggaagggttgggggattagcatttctcacctattggtccttaattgttagacttttctttttggatttttcccatctttagggcattgaggcccaacaagccgtcaaaaagggcggacggattccaaaggctggttgctcgtcggcaggcggcggacgcggcggtggtgcgggtcgaaagggcggcggacgcggcggtggtgcgggtcgaaagggcggcggacgcggcggtggtgcgggtcgaaagggcggcggacgcggaggccgatgagcaaattgacaatcaccgattgaagcaacccaatttattgtcatggagatgatttgcgggaacttccaacagacttttcgatgtccttgacttttattgttatttaaatgagttttgtgtaagcgttattagaggacggataaattatttgtttttgattgtccatttaattttactcggtaattaacctgtattttttttttaccatttttgattgtttttttaaatagtttttccaattttaataatgccatttgccgtttcgccctctttcaactttttgcgtcgtccgttgcctttgttggtctttcgtcgttccctttttaaaccgccattggactcaccgttctgtggcatttaccggacaaatggcgaaatttgccggacggatgacattttggtgtgccaacacaagatgaactatcaccctggagcaaatgtacccagga

SEQ ID NO: 30287 - DNA, 1631 bp, Heterodera glycines
ctaattaataatttaattaattaattaatcgccttgggtcgcatttagaaatgcagcaatatgttgaagaaaaatttttaccaattttttccaaaatcgttcttttttggtgttaattaattatataagtacatcataaaaaaatttaggccgaaccaaaacgaaacaatgttagtttaatatttgtgctaattaaaaatgtaattggacaaagttgatcagttcacttttcgtggtgatcataacatcaaaattgtttgaaatcaggtcgaaaaacgcctgggggttggaaaattttttctacaaaaagaaaattgagagaatcccgttttcgttccgcatatcacaaaatttccgttccatcatgaattttctcccaaacgcttaaacagttgcaacttttaattttcttttacagattctataaaatattatcttttatgataaaattaatcggattacttgaaaaaaatgaagatggaatttgttttttaaaaaaagttttgactgatttcagtcaatgaaataaacaaaattttttggaatttttattgtttgtgttggttgttatcacaattcccattaatcgcattttataattttacaaattaaaagcaatcacagaacaagataattttagaattttttggaaataaatagaattgaacaattttttaatccgattttagctcatatttaatgaattttctgctttatataaaaattcagtctcaaattatgaggaaacaggcatgttcggtggaatgaacatttaccatcaaaaatatttcacagtcccgcttcctgaattccgtccagaagcagctgcactcggtgcttcgactcactctgtttcacaaagtccaacagttcgagcatccgcttgatcccaatcgatattcctctgttaattgccgatttaattatgacgttaaatacattaatttgattaaattgaatgtgattaaaatatcattgatttccaattgtttggctgattgcgactattacacatcgggttatggtgagtgatcagtaaaagaatacttctggagaacatttataaattttcagaaaaattgtttaataattttaaaaaaaaataattttttttttgagttaaatttttccagctttttttgctaatctcaaaaaagatacagcctcctttcttactcattgatgcatcgcaattattttttcatgtcctattatgcatttgtataacccatttttgaatcgagagaagaagtcaaagtgaaaccaaattaaaactttcttgacatcattcgatagcccttaaagctctctatctacctgcttaatgcaaaaaatattttattactttcaaaaagttatgaacaagtcaattccgcgtcgtgccaattcaatgctgtaatcgcgggggtgtcaaaaaattgtttatcaattttcatcaaaattgataatttgtgcatttggtaaaatttagcgaaaatctttgcgacttaagaaatatgagcaaatttgtactgatttcttaaaatactcattaattttttagaggtttgtcacccccttgtaattttttcctaatatttttctaggcttattttgatgcttgatcactagggttataagttgtatgcgct

SEQ ID NO: 30288 - DNA, 1604 bp, Heterodera glycines
gcaacctttcgaattgtttcgaaatttttcaacgtggaaaattctactggggaacttttcggcaaaatttttaatcacacaacggatcaagcaggatttcctgatttcatttcatttgcggtgagtgattgattgcttattccttaattgatcaattatggctaactaaggaattgatggacccgattaatgggttttacagcaacaatgaggacaacgtgacattgacagttgactttatcttaaagaatgctgaaatgggcctatttgcttcttctgtaccaagaacatccgacaggacaattaattgggaaattgaaaaagtttccgaatttttccgtgaagccattggaagtgagcgcaaaagcgaaactgtgcacatcaaaggatttccgtggaaaattgtggccaaactaagccaattcaaagatttggactttttccttttgtgtgccatcccaaaaagtgagtgaacttaataaattaattcgaattagtaataataataaaattaattgctttaagcatcgaattggagttgcaaatgttcggcaactttacgaattggctcggatgattttagtgataggttcgataacttgatttttaacaatgaattacccatctgtcgatttgatgttggccttccgttttcgcatttggtaagaaatatttttgttttttcgaataacaaaaatatatatttaagttgcgcagagctcgaattttgaggcatatgccttttttctgcgcattagtttcgatatattaagcataaataacacattttccacttggttttatgctttccgttgacttttattatgcgttttttttttgcctttttcgggattttcgtgccttaaatgccttttaaatgccttttttcatgccattttcgggatttttgtgcccttttcatgtatttttcaattttttggtgcttaatctagtgcctttttcgtgatttttataaagatatattttttcctggctttctgtacgctccaacataaggaaaacattcccgccacctataaaagtcaaaaattgtcagtaccaaaagagaccctctgattttttcattttaaaaccaaaacaaaatggcctaattgcttttttaatgatataattaaggaattgattggcacaaacaaagggtggtacgacaaggaggaggacaaagtgactgtggtcattgattttttatttgacgatgaaaaaatggagaagccgtacggctcgattttcagttaaatttatgccattttttaaaaattttttctataatttttgtattcattttcaatatccgctttttatgctcataaattcccatttcgcagatcggggacgagcaggaagagaactaaattaatacatatattaattatatatataacttatactcagagaaaatttggaaatttgaaaaagaaaatccaaatcttgctctgcaaaaataaaaactcaaagacctttttgtcagactattttccaaaaatctttgatggacgaggttcaagcaaatgctagccaagtgtaactaaaaaaagatacaaaccgttgaaaatttgttttcgtataatgtataaaataaaaat

SEQ ID NO: 30289 - DNA, 1456 bp, Heterodera glycines
taggttaataggcacaaaaaatgcctctgctgcatttcactaccctttttcctttcctttccattttcggcttttatgtgacattcgccgctttattttctcagtttcactctaattttctgcttgcgactgtttaaacgaaacgccaaatggtgggctttttgaatttttctcctctgctcatttgtccgcctaatctctactctctctgccattgtttttgacttgggtaaataaagttgaggctgaggccgcttaaaaaattgtctggcttaatttgtagcttttcttcgcgttggccgggtaagaagaaataacatcgcattgccatccaaaggcgagcaaacattacttggcatattaattaatgccaaatactcgcgcccaaattatccagtccaattccgccagcgtttttttcttcgttcttcgtttctccttggcaactacaaaatgtgccattgtgcgccgacattcggtgccaaaagtgccatttgcctgtgggcagctgtggtgggataataaggcaaaagggaaaacagaaataaacgaagccaaaataaaaattaaaaaaacaattgccaatgaaaggcggaggagtgaaaaaggtcaacaaaaaatgatgaattaattacagtgggaggagcttttttgaattaagtgcaaagtaatgccaagccatcgccgtgtgccgtggcatttcgccaatttcgaagaaagcaaaacacccgcggcaaccaccgaccatttccgcaaaggcaaaacccccggggccaaataagcgggcggatggacaaagtggcaaattggcaccaagcgccacaacggcatcacctcaattcactcgccggggggtgtgacggttgggttgggcagcgattggtatgtccgtccgtataaagttaagtatccaattccggggggattaccctggctgatagcaatttacaaaatggaatgaaacggcacgggcatcggaggaaaatgggagaggggagggagggagacttttgccggcaaaagcccccgggaaaaggcaaattggagggggagggggacggactcacggcgaagggtacggtgaaggtgaacagtcaacggatgcatgaggagaccgtttcatcagaaagctagtgttatggttgactttggcacttccaattttgacattgctttacggcttttgttttcgaatggcttatgagcggccggatttaagggactttttggattaaaataattgctggtgccgctttgaatgtttcactcatccgctgatgccaacggcaaatgggtgaaaaagaagcgaaaagtggaagatgacagagaagcagatgaaaacagaaatagcgaaggaagcgcaacaaaagaggaaaagatggtcccctcacggaaggggggaagaggaattgcgaacaaaaaacaacaacaaaaacagaacctaactggatggaga

SEQ ID NO: 30290 - DNA, 886 bp, Heterodera glycines
cgtgatgccattggctgcggtgtatttgctggacaacaaatggcccttcggttggtctccgtttcccccccccccctcttcggtgggcttcgtccataaatacgcctccggcaacatttctcactatcattcattcatttctcttttctctcccctccctttgtcccattttccgccatatgcaaactccacgaaatccgatcttttctgcttcccatggatataactgcttattgtcaggccatttttggccaaaggacacgaaatgagaaaatgacaaaacaaagggacgaacaaattgatgagaaagaaatgggaaagaaatcgaaaagataaaatgggaaaacggaagggggggccaatcacccagggggcaaatggtgtcaaagccacctgctaattgcctaattgcttcgccagggcctttcatctgccgcttttgggtgaccgccgatttgacgctgtgcacagcttccatcctcaatttgtgtatgatttcggtggaccgacatttggcagtgacgcggtaattaagtgtggtaattaattaatgagttggtggcccatcattaataatttctcagtccgtttttgattagaatgcaaaaaaattggtttaatttttagtgcgcttcgctactccgccattcgagaaaaatggcgaattttgcggtcatcaaagtaatggcacagcccactggaaaataccaaaaatttaactatttaagaaccaagcaattgaattaaatataaaaaaagtcggaagtcagggtcacatggattcctttctagagaccggaattttgaaaaagatagacccggatttcagagtcgaacccggacagtatttcgtgataaactgtgttttctttgttattgcgcgcat

SEQ ID NO: 30291 - DNA, 1372 bp, Heterodera glycines
  misc_feature (492)..(492): n is a, c, g, or t
ggggaggggcggaggctgtggcaccacagcagcagaagccgaccgaccgaccgaccagaaaaatgagctcggcttacgccgttggcggcaaacccaaccgaagaaacagcagcagagcagcgaagctaaaacattattagcattgtgtaagccgcgtcctctgcttctctggcgctggtcgctctctctccctctctgtctgctgttgggcgtctgtttttactttgcgtggcccaacagtaaaattggatgttctgccgccgtctattggacatatgaaatagaaaggcggcatagtttgggatgatgggaaaacccatacgcaaaaatgttttcttttggcagcggcaccaggccaaaaatcacccttttatttattcggcaaaggaacccatttgaaggaggctacaagggtggacataagaatacggagggtataaacataaagcataaatatgtgtatttatcaaccggcttaaacaacgacggatnaatgcgtagaaatgtgaagacggacagagatatttgaaaagaaactttgtcaaaaacttaccactaaacgataacaaaaagaaaggcgtcataataaagcatatcaaatacaaatagaaaaatcaaaaatgtaattttcggattcagagatacaaaaaacaaaaaggagaggaaaccatggagagaatgccaaaggaatgagagacaaatctgaatgaccaggggaagggggacaaacacaagaaatttgggagggtagaaaaatgccttaaacaacactctgtcccgacaatacgatgatttcgctccattttcattccaaatgctccgtctctcttccaattcactcgtttctcttccccctctgctccgctctccgcaccttctcgcggtacttccgcctctgttccgcgtgtttcctccgcgccgtttcgagctgtgccgcgtccatccgcgcccgcctctcctccgccttttgccgtgccttggccctcgcctctgccaattcgtccttcgtcatttgccgtctccgctcgcgctgctgttggttccgcttccggtacatttcggccctctccttatcactcatcaaaatgcggtgcagggaacgatagtcggcacatgtcgggtcgaaattggtcagtgacttgcggggacggcccggtactgaatttagaacaaaattggaaaaataaactgaaaatgagagaaaaaagcacagtaaattgaaaagaaattaatgaaaaaaaacaaaaattgaattgttaattgatgaacttttatttggaggcaaagattaacaaatcgcttaaacgtttttttaagaaatgatacatttgagtagggaggattattaagcaatgatggccgaaatgattca

SEQ ID NO: 30292 - DNA, 229 bp, Heterodera glycines
ggaaaagaaaagaaagagggggggggggaagagggaaaagaaatgaaagaggggggaagagaggaagggggggggaagagggaaaagaaatgaaagaggggggaagagggaaaagaaatgaaagaggggggaagagggaaaagaaatgaacgaggggggaagagaggaagggggggggggaagagggaaaagaaatgaaagagggggggaagagggaaaagaaatgaaa

SEQ ID NO: 30293 - DNA, 759 bp, Heterodera glycines
aggattaaaaaattttgcttaggatcggagagacttaaattcaattaataaaaataaaaagaatattgcgctatagcataactttaatgtttttaaatcatcatgttatgttaaatttaatatgctatttttttgagattcagataacttctgttgattatataaatttttgtccaaaaaaccatcaaaataaattatttaaaatgtgctacacctcattttgttcaaaaatataaaatttttcgacagaaaaaataaaaaataataaattaattatgagggaattaggggggaggaacagagaaatagaacagctgctggtggaaaacatcagtggtgaccaaagaagcaaagaaaagaaagaatgtgcgtgtgtgtgcggtgttgtacacaaaactggtcggtgtcgagcaaagaaaaatgagcagaggccgaagagagagagaggggggggggggggtaatgaggcgtaatgagggggcatcttttaatgttaatgatgatgaagacgatgatctgtccaacctcgctcggcccattaacacatagaattacgacgagatgaaaaaaaataatggtgggcggaaggggcggcgcggagtggggggggggggtaaagaatgggacggaccgattgactgactgacttttggggtggcggtggcgggtaaaaaggaacgggttaaggggaccgcggagcggacgacgtgagcacttgcgcaagtgttgagcggtggcggcggcggcgcttaataatta

SEQ ID NO: 30294 - DNA, 857 bp, Heterodera glycines
taacaaacgttttctttgacgagttgttaatttaaaatgtgaacaaagaatgtttaaagctatttcaattaatgttaacaattgatcggcatttgcacgttttaaaatttctctcctttttttcatcgatttggttttggcaagtaaacgaataaaatcaaaatttttatgtactattgctccaattttacaaaaggccattttttggaatgaaaatgatcttttttccttcttcttcatcgtctttaaatatcccactccttagtcgcaacaggggttcgaaattcggtcaaaaggtaacactttgacaggtcaatgtagttttggctcgagtgtattttaaaatggtaaggtgtgtcggtgagtgggttactcggcaaaatctcgaaaacctttgacgatgatacggtaacatttgtagggggtacactgaaaaagtcaacagcattggtaattgaatcaatgctgctcgagtcaattttgtgaaatgccattttatcttcttttttaataaagtccaaatgcgtctgacctgagtcgctttttgcttttaattagtggtttggtaatagtttttccaattaaagtctggtgcgatagaaggggtgatttgttagcttttatacgttttcttcgtccgcctgtaccaaattgacgttgaaatccacccttctccaaaatgttgtccgcgcctcgtttaccctcagttgtcaatgtttctattgtcccctttaaccccggcttttcatcgatcattcgatttataaaccgttttccaatttgcattgtttcgtccgtaccagtatctccggctctgaaagagaggcagaaaaaagcgccagagtcctcgaaaaatg

SEQ ID NO: 30295 - DNA, 917 bp, Heterodera glycines
  misc_feature (885)..(886): n is a, c, g, or t
  misc_feature (894)..(894): n is a, c, g, or t
tccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaattttttttctttttttgattgnngtcataanatttttagagaattttcgatatt

SEQ ID NO: 30296 - DNA, 930 bp, Heterodera glycines
ttctatttaatgacactcctttttactattatttccttttcgaatatccctggaagaaatccaacccctgattgccgtagcatatgcccattaactatgaatattatataaacagccatgaattttcatttgaattctcatttctattaaatgactctcattttattattatttccttttcgaatatccctgaagaaatccaacccctgattgccgtagcatatgcccattaactatgaatattatataaacacccatgaattttcatttgaattctcatttctatttaatgactctcattttattattatttccttttcgaatatccctgaagaaatccaacccctgattgccgtagcatatgcccattaactatgaatattatataaacacccatgaattttcatttgaattctcatttctatttaatgactctcattttactattatttccttttcgaatatccctgaagaaatccaacccctgattgccgtagcatatgcccattaactatgaatattatataaacagccatgaattttcatttgaattctcatttctatataatgactctcattttactattatttccttttcgaatatccctgaagaaatccaacccctgattgccgtagcatatgcccattaactatgaatattatataaacagccatgaattttcatttgaattctcatttctatttaatgactctcattttactattatttccttttcgaatatccctgaagaaatccaacccctgattgccgtagcatatgcccattaactatgaatattatataaacagccatgaattttcatttgaattctcatttctatttaatgactctcattttactattatttccttttcgatatccctgaagaatccaacccctgatgccgtagcatatgcccattactatga

SEQ ID NO: 30297 - DNA, 541 bp, Heterodera glycines
cggcgggggggggggcattttgaattcgcattttatacctccccccccccttattagagatttccgtcttctgtatggccactgctgtcgcgttgggttttgcctacatttacacggtaaaacctgtttttagaacaatccggattttccctcaaaacttcccatttatcgctgaatcataaagattttaaccctaattaattaaaaatatatataaaaaaattcgtaaacagttactggctctccgataaacaaaaatacagagagaaataaccggcggaaagataacaaattgcaaatccatcccccgcaaccccgaaaaaaaaacaattctattattattttttttttaaatctaactaattatttgttgaaaaattattattttttagctgatgctgttcgccccgttgatctgttttgccaacattgtggaggacacaaagcagaggaaaagtggggacagcggcgccgctttggcctccgcccaatggcaggcgatggcacggacaaaagtccgttccatacattttttgaaaaa

SEQ ID NO: 30298 - DNA, 987 bp, Heterodera glycines
aaaaaagttattccagaaattctgggaaattttctatttttcagaaaaaaatttatatctcggttctgaaaagatatttcgggaaaagtaaaatactacaaaaatccgcaatttttttctctataatataaattttattttacatttttatcacatttttaaaaaaagatacaaaaataaaagtgattttggggttcgggaccataagggggagcacacggtttttaagtgaaaaaaatttttcaccaaaaatattaaaaaacatgtctttaggggtagtttatgacgctgatcacgaatacgtgatcacattttacttttgatatcgttaagacctcagaatccctgtgtgattggggattctgaggcatcattttgaggggggggcaggttcgaatccggacggtgtacattatttttctatgctattttcactgtttttaattaatttgaagacttcttttaaattattataattcatttataaatattcaatctgtacgtttcaaactctctttttaattaataaaagaataatttattttattttttaaaatttattaattgtattatatttttattttactttttaataaacatttccttaataatctcgcgcgtcgtttcgtcgtccaaacaatcacaaaccgatgcgagcagcaattgctttttgtcagtgttattgaaatgattgcaaaaaaaaaggaaaaatcctttaacgttggcaaggcctattaaccgaaacatttttttttcattaatggtaaaatcggctacattttttttaattcaaaattttggccaaaaaataattcgtcaaaaaattggcgacaaaaatgatcaaagaaatatttgtgcaaagaatatttatcaataacaattgaatttttttaagtttttgttaataagaaacgattatgaccattacaccgcactaaatttggtactttttataccccctaaaatatttttaaagagccaaaaatg

SEQ ID NO: 30299 - DNA, 1465 bp, Heterodera glycines
  misc_feature (1442)..(1442): n is a, c, g, or t
tttgctccatatttcggacttttttccatattttgtcattattcgattatttttttcgtaaatatttatttacaaatcattttcaccaaaactgtacgaaggcacaagagtggtgctaaaagagaaagaatcaattatatatgataattgataaataggggtttatatttatagttgctaaaaagtgccaaaatagttagttttaggttctaaggaaattttggggatcaattttgagaaaatttttcgtttattaggggttcattttcagaaatttttgagctcgattcttaggtgtgcattttttacaaattcttaggagtgtatatttcgcttttatgcatttttgttaattattttggacaaaaagccaaaatgggtcaataggttttttaatttgttttggctttttggctctaaaaataaaaacctagaaaatagttgctaataactcaaaaagtaccttattctgcgcaatcatgcaagttcattcctgtcatagttgttggttttcgactgtattttctttaaagccccaattaaaagcgttttgaaaatgaaaaagtatttttaatttgaaaaaattaaaatcggaaaaatatctcaaaagttgataaattttgccaaattttcacatttttgaagcccaaaaatttcggaagtcgaaactcaagcctccaatgcggggtttttatgctgtccgtgtccacccctatactactcgccctgttttcaatgcaaaacggcagaagccgcgtcgtctggagaaaattagtcgacaaattttgcggcttttttccccgtttaaaatgctggttaaaaaagccaaagccaatttgtattgttctttcgaaacaaaaaaatcataacttttttaaaagaaaccaaattaaatatttcaaaaattttcatgtcccatcaatattttgtgtttttcaatctttatgaatttatgataaaaaatgaatgttactaattgtttgttgaatgagttttttttttttttgctttctaaaattgaaggtaaaaaattttttaaataaaaatcgttaagtaaaatttgaattttttaaattttttgaataatttataagtgaataaattctcatcccgtgtcttctgtccgtgtccttagcggatcgagaattttgggtctcgtattttattttactgttcgaaattaacccggataaaatatccaataactttaatttggttgacttatgaaaagagttatgatgactttttgcctacacattctacgaatttggcttaatgcaagttgtctaaacatgcctaatcctatgccaatttcgcgacgaaatgggaaccaaaattggccattcaatgtcaaaattgtggaatttaatccgggaaaaagctgcccaaagcctatcgcggaagtgcaaagatgcacaaacgcagcgacactgaacacaccngtgaggatggcatctgaaaaaaa

SEQ ID NO: 30300 - DNA, 1492 bp, Heterodera glycines
caaccctaagtttataagaataatcaggaagctaacaaacgttttttggccgccttttctatcattttccaaacctttagtacaccatcgatagagcttcaatagctctacaattttactcagaggtgatctttcgctttttctattgataaaaatggtttattgtttttttgggaaaagataaaaaaattcaaaaaaaccgaaacggtataccgaaaatttttcttcggtttttttcggttcggttttttaaccgaaaccgaccgaccgacaaatttttgagtttttcggtttttttcggtttcggttttttcggtttttataccgaaaccgaccgaccgaccctcttgtccggtctctagtttttagcaaagaaaatatcgaacttaaagttcgatgggtgaaaaggcaattgaaatccggaagaaatctttcgtaattattgagacggacccgggaattgaaacaatcgcacaattttattagattctttcaggcaaaaagtttgctttaaaatactccaattttatgtcttttttgtcgcgaaagcgacgaggggatacgatcggaaagaaaaagggcccaattttaactttttttttggcctctcattgatcccccattctctactaattttcgccgttcttctctcccccctcctctttctcccctcttttcccttcgcccttcacaattggactttgagccctcctccccggggttggccaacatttgttttttgtcacccgcctattatgttttctttgaattgcgctctctccttcatttgatcatcaatttccattcatttgcattttttcacatttttgccccttctcctcccccgcctttgttcgtgcctcctttttctacttttctgctcggaatttctgttctcatttctgtgctcccattttttcttttgtctcattttgaattttttgtcttcttcgccccgcccgcccctttataccatacccatttttactgtaccctccccatccccttcatataatcctccccttcttgtgagataggctcttcacttcactcttcttcaatttccaattccgatttttcgacccccttttttctccctcttttttacatcactttttcgccatccttcccctcgtttgcgtcaaataatcccatcacgcaataaattgttgagaagaccctccttttggtcacaggaaaggatttgagggacggcaaggtgggaaacggcgggaactccgacccctctccaatccgatccatcgttcggcgtcatccgcccttctcggcgcgcttcgaccactcctcctcccttttctcgtcgtctcggcttttcggcgtctccgctttttgagcgtgtctcgttcggtttcctccccccccccccccagtttgtcccctccctttttccgacaaactttttggtgcgacgacccgggaacacaaaccatgcacccttcaattcactttcgaccatccatcactcttctct

SEQ ID NO: 30301 - DNA, 1135 bp, Heterodera glycines
tccgttgcccgccgccttcttcgcctcctctcatcgacgaccgtgtcgagcgagtctcgaggtcttttccctctgaactgctctcccccgggcggctggttgactggcggatggcggcttctctgcgggggaatacgacgcaccatcgggcggcgcagattgaggtcgtcgtcgccgtctcgcgccatctcgatgagggaaaggcgggagggatttgaacgatggttaagggatggagagggacggacggacggatgaagaaagagtgagtgaatgaatgaatagaagaagcggaggaatgacggagaaagggaggcacagaagagagagagattctcgaaaagccatccaaagaatggtcaaaatgcaaccgtttaagaaacgatgggggggggggggaagcgacgacggagcaaaatttaaaaaaatataaaatgtttttcattttaaaaaacggtgggtgcgattggcgtccgccacaattgtggtgtttggacggaggagccgaagaaaaaaaccgaaagcgaaagatagaatcgatcagatggacaaattggtcgagaggcgactgactgctcaatgtgctgaaggaaaacagcagcaaactttttgtatgtaaatgcgactgactctctcttctgatgggtgttttgtaaatgtgaagcccacccccagcagtcgatgactgatcaaaaaagagggaggaggggagggatgatccgacgatgatcgaaccaaagaatgatgggggagggggggggacagtgtaaagttgtgtgtgcaaatcatatggtacgaggggggggggatgaatgcagtgcattttgatcagtgattggattggcacggggcgatcagatcacttttttgggaggggcaaaggcaaaacaaaacaaaaagagaagcggaggattaatgcaaaatttgcatttggtaattaacggatggttaaaaaagaaaacggaaaacgaagtcacccgcccctttcgctgataccaccgaattcttgcccttccattcattcattcgtcgggggatgaattgatgagaattgggggggagcggtgatgaaaaaaattttaaaaaggttatagcgcgaacggattagagtctagagtaacaagatagaaaattg

SEQ ID NO: 30302 - DNA, 962 bp, Heterodera glycines
  misc_feature (874)..(874): n is a, c, g, or t
ttcgtccacctgatcataaggcaccaaatggggggtccgtttttgcgaggcatcgacaaactgagaaattcgaaattaaagaagggaaggcaaggcgtaagcgatgcgaggaatggagggggcagcttccctcgggggatgatctattggcaaatgttcccctataatgccgttgcctccgatcactcccattttccattgttctgctgatcacctcgctgattccgaatgtccagccccgcctgatcttctctttggcccaaacgttgtgtgtgttccctgccaatgcttcaattagcggttccattgcctcgctcagttcgatttcgtgcgtgtccaacggttgcggcttatatccgttcgcttgcgcataattttggggcagtcggacgggccgaagtcgcgtcggtggctggtcgaggatctgccaaattggaacgagcattggcctgctggtcggcactcggtaccatgtgccagcccaacgcttcgatggttcgcattgtgtccaatgccaaactgacgttgtacgccttttccgtgtcgggcaaccgctcgaagttggtaaggcacgggtgccgcttcgtttgttcgttgcgcaccttaataataccctccgtctgctgctcgcgtgccgttcactcacctccccgtaagtccagcccaggtcaactttgcgcatcgcccacaattcgtgcaaattttctgcgaatcgcaagtgcgcctcgagagcaaagtttggcaaagcgatgtgagcggtgtccacgggacacggcacaaacggttcgatagcatggaaaagggcggaagggccggcaaaaacatttttggatgtgtcgccaaaggacaaacactcctttagcaagagaaaggngtggtcaaatgggaacaaaatagcaaacagcattggtcacctgaacggtcagcggacagttcaaagcctcgaaaatgggcgaaaagga

SEQ ID NO: 30303 - DNA, 1262 bp, Heterodera glycines
  misc_feature (28)..(28): n is a, c, g, or t
  misc_feature (80)..(80): n is a, c, g, or t
cgattggtgccatatttgtcgggacgtnccacgggaaaaaacatcgtataagtcaagagtaccaaatttaatttattttntaaaaaatgtatttcttaattcactcatccacctgttgcagttggttaatggccatcaaaatttctccatgctcactctcaccggcagaagagtcatgccgtcgtcgcggatttggtgccgccaaattttcaatggccaaagcaatttcttgcagttgttgcagttccctaatactgctgctgctcctctcaagacgttgtcgtcgaccatggctcgacatattagtagacatttgcactagattaaattatttttattttataataaaatattattttttttttgaaaaaagcaattaatacgctaattacaatactattgtaattaattgtattattcacaaatattattgtctcattaatcaatgttcaaacttatttgtggtgaatgtttgtaaatgaataacgttgaattagtttgaattctctaagaagaataaataaatcaaaaaagcaatttgaaagagattaaaggaaatttgtgtaagggcgaaagatcactcactccattccctaagggcaaattgccgatttcaaatttttttggatttcttttttcacgtacattaaaacaatctattaattgtaattaacattatggatttggtactggggctatggtttgaatttacttgaatggaatggaattcgcattggtcatttcccatattttccatttatgcttttttaaattttttttctttattatttttctttaatttttcttttttgaaatgaaaaaacaaaataaaatatttaatattaaatgttttgaaaatgttaataaacatctttattaaagtttccgtgttttattattcaccttcagcagaacggaccgttccgttcaaaatcattttaaatggaattaaatcagtgagtcttttgctaaatttttgggtcaatagcagtttatacaatagagatttttacaaaacaatgcctaagcctaagcttatacctaagcccaagcaagtttatgcttaggcttaagcctaggctcaagcttagtttgaaagcttatgtttattcaaagcttttgtaaaaactgtctattgtgtactaactccgttgtacaaaccgcccattgtacgaactggcagcaggaccccaaattttcagctcgatttgctattaggaattttatgaaattttgatcaaaaaatttgtcaaaccctcaaa

SEQ ID NO: 30304 - DNA, 270 bp, Heterodera glycines
aattttccaaaaaatacacaattttttgatgaaaatctgctaaagatggctgcaaatcgcaaaatttgtcattttttggacaaaattcgttaacaaatcggattataaattgcaaaaattttcccggcggcgcctatcagcaccgccggaccccctgttcaacaaaaagttttttggaaaaaccgccgcaaaaaaagtggtgtgaaaagcaaaaaaaaaaaaaaaaaatagaattttgtcagcaaaccttcgtttttgcttttgcaattg

SEQ ID NO: 30305 - DNA, 1437 bp, Heterodera glycines
atgatttttgtcctttttccttcacttttctgtccgttggtcctccgtattaaatagtattggttatccaataagcttgtgaattctcattcaatcttccgataatttcaattaaacttcatggatatccattaataaatattggcttcaccaatggtggcaattttttcgtcaagttcgggtttttagctgaataattataatcattttattttaataatgaacattcaaaataatgtaaaccccaaaaaaccttcagcataaatccggattaaatattcatataaaatttctaaaattttcgatatttttggcattctgtcctttcatattcatcaaattcctttgctattttgtcacattgccaattctttctcataaaatacacaatgccaaggtatcatatttttactttgaataatcactaattttctttctgatcatttctcagaaatgcaatggtcgtctccctaattaaaaatgattagaccaattattaccctgcttaattgactgcaaaagataagcacgaaaaacaggttttccgcttggtttgggatgtctacgatgacttttaaaatgcctatttttgcctattttgggtttttgtgcataatgtgcctattttaggattttcggaaaaatccttaacaaaaatgcaataaaaacgaaaaacacaccccctaagaaatgacccaaaaaaaaatttcagaaaatacacccacccctaagaattgaaaaaattttcaaaaaaataattccaaaattatttttttttctcaataaaaatttttgttttaaaaattgtccgtatctggaaaaaaactttaaattatttaataatttcatttacaattaaaatatttaaatttttacgtgttttaatacctaaaaagcgttaattaaaattttttttgcctatttgatgcctattttgcgatttttttctgcctttttaggtgcctatttcgcgattttttgtgcctaaaaaaagaatccctaattattacgctattaaaaacacaaaaaattatactgactgtaccgaaggcgtcgggaaaagcgcatctcattaagtttcaaaatttttaaaatttgccaatttttcctggggaaaaaaggggtgaattccccaccctttccatctggttttcagtctttcaaattagatctattgcgaatttatttattttttaaaattgaaaaagcatttttgtttacagcccccaaaaatggatcttctcgtcagtctggagctgctcgacttgcactacaacatgatcgcccggttgccggacgaactgtttcggtgcctcgtgctgcgcacgttggacatcagtggcaatcaatcgctgaacattggcaacctgcaaacctggccgagctggtgctgtgcgagaaccaaatccggcacttgcccagctcagtcgggcggtg

SEQ ID NO: 30306 - DNA, 1036 bp, Heterodera glycines
  misc_feature (97)..(97): n is a, c, g, or t
  misc_feature (125)..(125): n is a, c, g, or t
  misc_feature (183)..(183): n is a, c, g, or t
gaccagctcaatgtcgtcgagaagcaggtgtttcttttcttatagacaccatcctgtgttggaaattttgattttaaattatttaaacgattgtttnttgttttggcacactgtccaaggcactntaatcttatgtgaattggaattaggccctactattcgagagccgattttctaagaatntagatcgtgaattcaatccggaaagtcaaaacaacccgaaattcacgacaaccccgagaaatttatcgagtttaatttatacgatttgtttttggcaccattttgtttttttttggcaccgtacaagtgcaatttaatcttatggaaaatttagtaattaggccctgtaattggaaagccaatttttctgaaactcttgaccgagaaatgaaaaaagaatccgtaaagtcaaaacaacatcagattcacaattttgagaaataaagactctacattcttgaacagcctatctcatcccatagaataaaaaaaatcaactaacttaaaattttttggtacaaaggcattaaaagtgggactatgaccaccttgccccgcttgcagaacatcatcatcttctcaaacaaaaacaggtaacgttgcgccgacccattctggttgaccaatttgacataatcatgggccatcaatcgcccgtagtccaacaatcgctgaaaagaacaaaaaattttatattttaatttcttataacagaaattctaggatttttttaaatttctaagttttatgcttgaaaaaaaaatcgggaggaaacggggtacttccgggttttgccacccctctgaaattttttttctaaaaattttttctaggctaatttttgatgctgatcatgaatctggcgtttaattatagctacaacgtattttacgtgaaattttacgtgaaaaagttcaaaatttgaaaacaaaaatataaatagatggcataaaggcaagaatatttcgtaaaatctcattattgattgcttttagcttgattccttacatttaagccggatttgaaccaaaaa

SEQ ID NO: 30307 - DNA, 1600 bp, Heterodera glycines
aatcgatttttttgttttcggggcagtccccccgaccctatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaatattatctagtcagttcattttaatatttttatccaaaaaattttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacactgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcggggtgggggggcgtgcataatttttgacatatcatttaaatttataaaaacaatttattaccgctgtttgcaaatgcactttggcaaaaaagcagcgcaaaaattggtgaaagggcgcgcattactaatttgaatgtttcaaaaattgttctatataattttgatcaaccactggggctttttaaatttgaaaaatagagaaaaccattaaaaattattaaaattaatta

SEQ ID NO: 30308 - DNA, 1074 bp, Heterodera glycines
aaattcattcatttgtcccctctttttgacttgagttcgtctttctttccctttggcacttttgtccctttttcaatgcccttctccatccaacagatgccgatgccttcgctttgtcctccgcttacttcgatttgctttcctccgtcacttctccgtccgtcctttccaatggcccatttttgctcaatttgcgtcgattggaaattgcgtcgtccgtttggtattatgaagagagtgcccgcgaactgttcgctttcgccgattcgttggacgaccgaacggcacaatttgtgcgccaattggacaaaaggcgcgaaatgtggcaaaaaacggcggaggcgaaattggagggggcgacaaagctttgtctggtgcacaaaatgacgacaaaaacagcaaaagacgagaaattgcgaaatgccaacaaaaagtgggcacggcaaatcgacaaaataacgcaaaaggacgaaatgggcaaaccgatggtaaggcaaagcgaagagaagaaacagttgcaaaaaggcattggcattttgaaattgacccaaaaagcgttcattaaggtcccgctaattttggtggacgatgagtcaacttccgagggcatcaattgtttgaacagtgaaatttcggaaaaatttttgcaaaatttcttttcggtgtccaaccgaatttattggattcatttctttgtgctggacaaactgttgacaaagttcaaccgattgcgcgcctttttctgccacggtttcggcgtcgtttccgcctcggatttgaaagaacggcttcgatggattataagagataatgcgctgctcgcactcgaaaacgcgcacccccaactgatgcatttcggtgggaaaagcccaatttggacttgcggcatttcatagtgaaaaaatatcttcagctttattgtcaattattgacgggaataaaaaagcgcaatttgagtttcaaatccgaaaccctgatccgaacaaaaagccgaaaagcaccaaactttttccataattttaatgttccaataaattactttatagtaaaaattacatttggcaaacaaaaacc

SEQ ID NO: 30309 - DNA, 1316 bp, Heterodera glycines
  misc_feature (1246)..(1246): n is a, c, g, or t
aaaatcgatttattttgtttcgggggcagtccccccgaaccgatgcgcccagatttttgggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttttctatcaaaaagggagatgaataaatttaaaaaaatttttaattcctttttaaacaggccaaaaattttaagcttgtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataatttaaaaaaaataatgctggtgtggtaagtgtgaagaactgtgttcctccaggcaaaaaattctaagaaaatttataagcatttgaagggttctcagcagtttccctgcaaaatttggtgagcttctgataagtctagaacgttgggtgataaaatgaaaaaaataattaaaaaaaaataatgctggtgtggtaagtgtgaagaactgtgttcctccaggcaaaaaattctaagaaaatttataagcatttgaagggttctcangcagtttccctgcaaaatttggtgagcttcagagcagtctagaacgttgggtgatcaaatgcaaaaaata

SEQ ID NO: 30310 - DNA, 1136 bp, Heterodera glycines
ttccctcctcctccttggtcaccaaaaaattttttcaagaaatacaccgcaaaaaaatttgtaaaaataataaagggattcaaaaatataaagttaataaatgttttgttcgaattaataataaaaaataatttatttaagcaatttgaaaaaattttctgatttttgactcaaaaaaaagattttttatttcaaatttgtcctttataaatttttctatatatttttaatttaataaattgattgtcctttaaatttgtgcattaaaaatatttttgtgagtttttaattaaattttcgaattactcccgctccagcacgggactggacgggatttttacgggaatcccgttcgggactcccgtcccggaaaattttgaactcccgctcccggaaatttttttttaccggactctagtttataccgtctcaagctgttgtcggacaattgctggtcctactccgaccaccacaattttcacattattgtcgcgcaaagccttcgctaaaaacaatcgattttttgcctccaaatttcagcttccccaacccggggtggccacgtcgggaccagagcgtttgggcccccgtttttgggcccccgcgtttgggcccccgtttttgggccccggggtcgtttgggcccccgtttttgggccccggggtcgtttgggcccccgtttttgggccccggggtcgtttgggccccaacccaaaaatcgaaaagtgcttttttaaaaattaagattctaaaaactaagcctgagggatccctcgccacttggcataagttaggtttaattaacattcgctcattttttacaattttacttattccaaatcctattattttttaatagttaaccaatttgatgtacattctgatttggacatttttcagaaatggctaacccaattgcaaccaaaaaacaaaaagtaaaattgtcttacgaaggccacctttacaccttcgctaaaatgagttctgatgggatgacaaaattttggagatgcgagttcaaaaacagcaccgacacatgcaacggccgaatctggacggacctccacgaccaattcattcgcctcgcaactccgcacacatgtccagcagatgcgtcccgtgttgatgctcaaat

SEQ ID NO: 30311 - DNA, 1074 bp, Heterodera glycines
  misc_feature (1053)..(1053): n is a, c, g, or t
gtcaattgctgcaatgttttcgggatttacctatagaattaaagaataaaactgacaacttattaactgaaaattataggtgaatcacaagaaaattcaacatttgggcttaaaatccggagaaaagtcaattggcgcaatgttttcgggatttacctatagaattaaagaataaaactgacaacttattaactgaaaattataggtgaatcacaagaaaattcaacatttgggcttaaaatccggagaaaagtcaattggcgcaatgttttcgggatttacctatagaattaaagaataaaactgacaacttattaactgaaaattataggtgaatcacaagaaaattcaacatttgggcttaaaatccggagaaaagtcaattggcgcaatgttttcgggatttacctatagaattaaagaataaaactgacaacttattaactgaaaattataggtgaatcacaagaaaattcaacatttgggcttaaaatccggagaaaagtcaattggcgcaatgttttcgggatttacctatagaattaaagaataaaactgacaacttattaactgaaaattataggtgaatcacaagaaaattcaacatttgggcttaaaatccggagaaaagtcaattggcgcaatgttttcgggatttacctatagaattaaagaataaaactgacaacttattaactgaaaattataggtgaatcacaagaaaattcaacatttgggcttaaaatccggagaaaagtcaattggcgcaatgttttcgggatttacctatagaattaaagaataaaactgacaacttattaactgaaaattataggtgaatcacaagaaaattcaacatttgggcttaaaatccggagaaaagtcaattggcgcaatgttttcgggatttacctatagaattaaagaataaaactgacaacttattaactgaaaattataggtgaatcacaagaaatttcacatttgggcttaaaatccggagaaaagtcaattggcgcaatgtttcgggattacctatagaattaagaatanactgacaactatttactgaaa

SEQ ID NO: 30312 - DNA, 1588 bp, Heterodera glycines
gaaagaaatgatttacaatcgcgaattgatcaaagccatttaaatggacatcgatacggtaagcgattttaatcggttgagccttggcccgcaacagtcggagggataatctttggacataaggtagatgctcttggatcagcttgaatttaatggattgatttgcatgatcaaatttaatgcttgatttagcgcattcggttttgaatagggttagcaccatgggtatctgtcatccggcacccggacagatttggaaaattgagatattgggactccaataaatcgtaaaattttaatcattcaataggatcaacggaaatagactaaaatatgttaaataaatggttgtattaaatagtgacaacaatgacatttagataattccttcacaaatctctccgaaaatgtaaagcaaaaatattctgacttggaaaaattagaaattgtaaagaaatttttcgaattaaaagcaaaacgagtagcagcgaaagataaagcaaaattaaatgagcaaattaacaaagaaattgccaacgaattgggcacaggcgtgacaacaatttacacttggaaaagagaatttaatattggtgagttaaatggcaaaagttcaatgagtaattaatgaataagtaaatttattaatagcatttagattaaaacatttatttaaaaaagtttactgtaaaaaagtcaattaaaaaaacacaaaaaattgattaaaatatgttcaaacctattcctattgttaaatatgtgaaaatgacaatatataatagcaaaataattaaataaaatattgaagtattaaatgtaattaatgaataaattaaatctattaataacatttaattacaaatattttattttttaattaaattaatgcttttctccgtttgaatatgaattttaggaatgaatgaaaatgagaaacaaaaggaatttgttaaattgtttaagaaatataaaaagcaaaataaagaaatcatgaacctcgaaattgctaaaaaattgggaattcatcaaaataaactgttggaattcagaaaaagatttgacccaacctataaaagtaaataatttcgagtaaaataagggaaattatgggtaaataaataataaataatttttaaaatgtaaaaaattaattaaataaatattaaatttaatttaaaaaatattcccaaaaaacagaaaagcttcttgcgaactcagaaaaaattgcattagtgagaaaatattacaaattgaaaagaaaattcccagaactaagccaaaacaaaatagccaaaattttgaagattagtaaaaattcattaattaaatggaagcaacaatttggcaatcaatttgaaggacaaggtgaccaaatttaaaagattacgatgaatacagtaacataaaattacagtaaatgcccgggaaaatgacgatgaagcgaattccgaagaagacaggcattttttttatttgacagcaaaaattatgtaaattttattttaaacaattttattttttatttagtccaaaaaatgtctcatcaaaaaatgctgatgagacaatttgggcatggaacaatgaaaca

SEQ ID NO: 30313 - DNA, 1074 bp, Heterodera glycines
caaacactcacacgatattgaatgctacgaaaaaattctgccgaaaaaatggctgttctttttctctggggattgaccgcaaacttggtaccaacattttccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacattttccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacattttccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgcccaaaaatggctatctcttttttctcctggggatttgaccgcaaacttggtaccaacatttgccttctctagtctggctctaccaaacactcacacgatatttgaaatgctaacgaaaaaaattctt

SEQ ID NO: 30314 - DNA, 1840 bp, Heterodera glycines
  misc_feature (1730)..(1730): n is a, c, g, or t
  misc_feature (1764)..(1764): n is a, c, g, or t
  misc_feature (1767)..(1768): n is a, c, g, or t
  misc_feature (1779)..(1779): n is a, c, g, or t
taaatagcgattgagaatggggaaatggtaacgataccctttaagtgggaagactgagagatgacagagagagagagagagaaagagagagagagagatgagaggatgggagagagacagagagagagagcagggagagagaaaaagagagaagggagagagaatgagaaagcaaagagagagatagagaagagaaagagctaagagagaggtgagaggatgggagagaatagagagaaaaagagagaaggaaaagataaagaaaaaaagagaaagaaagaaagagaagagagaagcagtgagaagtagagcgaagagagagagagagaaaaagtgagagcgtggaagagagagcagagaaagagagaagggagagaaagaaatagagagagagagagagagagaaagagagagcgacgggatagagagagagaaagaaagcgggctaagggagagagagaaaatgaaatatagagagaagagagagagagagagagctaaggggagagagaaatagtgagagaaagagaaagaaaatcgagcagtgagagagagagcaaagagagagagagagagaaagaaggaaaaacaagaaagagagagggagagagagagaaaagtggagagagagagagcgcagagagagagcagagagagagccaaaggatagagaaagagagagaagaagaagaagaaaagagggagaggaagagatcgagagagagagagagagagaaaaaaagcgagcagtgagagagagagtaaagagagagagagaaagagggagaaagaaagaaatagagagaagatggatagagaaagagagagagagagcaaatggagagagaaagagggagaaagagagagggagagagataaagaaatagagagagaaaggtggagagagagaaagagagatagagcgaagtgagagagagagagagcaaagagagagagagagagagaaagagggagaaagaaagaaagagagagggagagagagaaagaaatagagagagaggagacagagcgaagagagagagaagaagaagaagagaagaagaagaagagggagaggaagagagagagagagagaaaaaagcgagcagtgagagatagtaaagagagagaaagagggagaaagaaagaaagaaataaagagaaaaagagggagagggagaaagagagagagagcagagagcgaatggaaattgttgtaatcatggtaaattagcaaatttggaagaattaattccagaatatccgcaaaaatttgaacttttatttgatcaaattaaatctgataaaaaactcatgagctttttatgaaaaacatacgcttatttaactcgtttttcttgcgcttcattaggatgtatgagattttgttatccaaataaaaaaattcctatttttaaaatacaaggcgctgtttatcactcttataacactgtcgcttttcctgaaaatgatgatcttccgaccaatggacaattgtatttcattgacacgaccaatcattgaattataggatgcagatgtgtaatgaaaatacaaaagaaacagaagaaatgagagttttaatgtcttacattgaaaattatttaagggaaaattatattttcgcaaaatcttatgaaattatgaaggacgtaattgagtcatcaaaaaaatcagaaaatgaatttgaaattcccgatgtgacaatgctttttagtgtaagagaaggngttgatttaagaagatataatattcctagatccnatnngagttgtgctngtatgtttagagatgcaaatgaagaaattcctgctgcgaatatttgtgtccactcaaaagg

SEQ ID NO: 30315 - DNA, 1037 bp, Heterodera glycines
attgtgccatcggcagaggaaaagcgcctaccacaaaacatatgggaaggcttttctttggccgtcgagcactgggcccattagggtgtcttttttgtcctaaatttttcctcaaattttgagtaaatttggctaaattatttgtaaatgttcaaaaaatgtcaatgaatcaatttattaattgctttatttaaaatcagaaatactcttcattataatttttttatcttatagtatttaaatgttaaaaataagtctattttgttaattttttttcatatttaaggcaaaaatattggagaagaaattaattatgaattaaaagtttaatatttttactttattctaaagattagttttcttagaaaataactcaaattacgaaaaataataaaatttccccaaaaaatccaaatatccatcattttctctataaaattctcaaatataaaattaaaatatttttaactatttatcagtctgactgaatgtctatttgggaatttttcatcagttctatttttttatttattaaatatagaatttaatttaaatttttcttaacttttttatgaaatttaactttaattttttcccgtatttttcaacaaaatgccataatttaaaaatttaatccactaatcacgtcatttgtttcatcgccgcgccgccagagggtaccactttcccctccctttcccccctccgtcccccaattccaccacttgtcatcatcgtcaaaaaattctccgccggggacctttctcatccctacaacaaaacttcttcaaaaaatgcactttttgatgttatcggtgtgatacaaaataaaaaatgtttgaaaaaagatttgtataaatattgaaatttttttactaataatttttaatttaaattcgaaaaaattcaatcttttattttgttgctttgctactgaaataaaataatggacccaatatttttaaacaaatgcaattttaaatagaaattgaaaaaaaataaacttccgccaatttaatccaaaccgttaatggact

SEQ ID NO: 30316 - DNA, 1475 bp, Heterodera glycines
ctgccttacgggtgccggttcggtgccggcgtcagatgtaattcaggtgaacttcagacgcgggaatggtaattggtaatggtagtgaaaacgcttttttgttttcggatccacttataaaagcgatgcccgattcatgctcattatcagcaagcaacctgaaaacctcaaatatttttcaccaccctgaatttttttcttttaatttagggtttctgttcacagacggatatgccatttattttaagctgtcactgaattttcttcgtcaatttaacgagtccaaacaatgtttatgagagtctaactaattaatgtctttttggtcacaaaattggtctttcaattaacaaacttttgataatatgtaaatcgaaagtccaaagaatgaacaagataaaatccctaatttttgcatataaacaactgactcataagcattgatttggactcataaaattgtaaacataagcaattttttagctaaaatttggcaatttaaaaccaacaatttgcagggcgtccaaccgcggtgctttgctccggcacttttgcctccgccatgtcggcactcacgtggtgctgtgcccgttctgtctgctcactttccccgtgccgcccgccgacaaacgctgttcggtggtgcgaatgcgcgagtttgtcaagcacatggcactgcatgatgggggtgagtttttggcattttatgtgccgaatattggcagtgccaaaggagcaaatcattcacagtttatagattatatccccccccccgccgtttccctccccggatcagtttcccccgtattatttcgccccaagaatttttttctttaaaaaactacaaaattagaaaattttcagaatttttttttcgaaaaatcgctgaaaaatttttcaaaaatgtttttcttcaaaacgaatgaacgctcgttcccatcaaaattgcccttttataatgatttgtctcactctttcatatgaataatttttttctcatttagtggtgtcttaccatttttctatgctttttcctttctatttcatcgtacaaattaattcgtttaaaaattctttttctctcctttcttttctctgattttatttgttctaaaagttttcttttgctattgtgtctgtccttttatcgattttccattttcgtctttctcatgcaaatcattaaaaatgaagccaaaggccaaacaatttttcgcgtccattcgttaacaccacatcttcgtgtttccatttttagtagagttttcgatttttttttctgtttaaaactttttgtgttttttttcaaattcctttcccttctaagaataagtttttgtttcccgtaacatttttcggtgaatttttcggctgaacgaaacgggctgaaacgacgggtggggtggaagacgagctaatccctattttcggatttatcaaaaattcttttttccagagaaatccctttgctgtca

SEQ ID NO: 30317 - DNA, 1158 bp, Heterodera glycines
  misc_feature (65)..(65): n is a, c, g, or t
tagaattttgactcaccaaagaattttggttatcatagtgaactggattttaaaaattttaaacnaataaaaagtttgggtcgcctataaatcaataatataaaccaagcaataagcgtttacatattttacaaatcggtggtaaattctataaaaatagaagaaataatttacctcctctaaatttatcttgaaagtaaccaaagcattgtcatcacacccagtgttgttttgtaattcgacccattgatcaggaaaaaattccaagtacgatttattggtccactgatcaaagtccgtttgctcagtacagatgtgaccagtaccaagataagcagagattgtgatctgacgtacatcccacgagaaataaattttctttttcatcatcataactcgattaggattattcggatcaaaataggttaattctgctacagtagttcttccaacttcctgaaaattaaatattgtatatattcatatttaaacctgtaaaatatgagttttaaaattttatattaaaccctataacaggcataataaaatttaatgtgtgattaatcggaaaaattaggtttaagcgatgtaacagcaatatttctcaaatatttgctctcattattttctattgttaataaggctcccggaagaaaatgtgtcagaaatagatgtgttcatactagtgatgttcgagagtctcggtctcgactcgagaaaagtctcgggtttttttggtctcggtctcggtcttcgagactttcgagactcgagaccgagacttttttacaccccttatgattggttttttgtaaagaaagaaataaatatacttgttgtatgtttttgcttgtactatttatgtacctgtggcatggtgtcttcgtgatggctctaggtgattgtgtccattgtattgttgaaggggcgctcgtccccttgatttttgttttcttcaggttttccagattatttgttttttgagtgaattttgtcaccttttgaccttgaactttgtcttcttggaggttttcggagtacttgtgctttgactgcgtgatgagaatttcagactttgtccctggacttcacgatgggctccagcgcccttggcctttgactatcatgatgggccccagcgctcatggtctttgactt

SEQ ID NO: 30318 - DNA, 1656 bp, Heterodera glycines
  misc_feature (13)..(13): n is a, c, g, or t
  misc_feature (25)..(26): n is a, c, g, or t
  misc_feature (37)..(37): n is a, c, g, or t
  misc_feature (60)..(60): n is a, c, g, or t
  misc_feature (88)..(88): n is a, c, g, or t
  misc_feature (97)..(97): n is a, c, g, or t
ggcaatgattacntaaatgattatnngtagcatatgnattgtaatttttatatgtgactntagtcaaaaaagaaaattatgaattctntattatttntaataactatgtaattgtttaaattcaaaaatattttaatggtgtcatccggtcgtttatgtgattgtcgacttgttcgatgtgtttgatcggtcgttggtggcatgcggtggtggggtcgtgtctccgatgtccattggcactgttggtgttgactgaaactgcgaaaactcgtccattgtcacgatggatctccaggttctagaattggcatgcagctctggaataagctattaaatgtaagagaataaatcaaatttttaggtttccattttttaaaaataatttattgacctcttattttctggtgttcaaatgcatttggcttcgaattaattttcttcttttattggctttttaaacgagttaaacaataacctttttaattatttcttatgtaaaaaactcgctttcccgcaattcgcctttaaagcagttctcctccaagcggctttgaaccccacccaaagttattatgaattctgtatcattcttaatatggctttatctgatttttatcagtccttttttagaaaaaggctaagaattgtttcagttgtgacacaaaatccacggggtccatcagacctctgcccccgcttcgccgtttattgccccaggagttggagccctggcatatgaaaaggccttctattgtattcaaactcgtacattaataaactcctccatttctgttcttctgaagttaaacataagtttaatttttcaaagacttggatttaaattttcaaaaatttaaagataattacagtttccgaagtaaatttgctcgctgctggcaaaaacattagaatttggatggtgaatcaaattttttgcactgtggaaattggacataaatgataaattggacatcgatgtaatttcttttttaattatgtcgctgttcaacatttaccagtggcaattagcaatgtttattttgaattatatgaataaatttgttaaaatttttatacgacattttaaatattttttaatcaccattttttctttggtgtgttttaaatttcatattatgtccactatttggtatgtctaacgctcaaatggaccgcctaaataattcaattttttctaaaaaagttcgataaaccatcataactttttttggaaccgacaaaattttatatgattgatatcattcaatagccctaaaaatttttattcaaaaaatataatttaaaaaaaatcggcaacgccggagccctaaaattccctttattttgtaaattgactcaaaaaccgcgaaagtactcataattgacaaatttaaatcggacagtgcacaatccgacagtaggttacacaaaaaggtaagaaaatgccgtcgccgaaggagactgattgtgccaaaataggcaaataaaaaatgggaatgcatcctcgcacacgaatgtcgtagttatgtggattataagtgaaattttgatcaatcaaattccaatgcctactttctttcatttctttgacaaaattgcttaatgttgtacgaagaaaatgaaattggctgttcaaaatgacctttccacaccctt

SEQ ID NO: 30319 - DNA, 1044 bp, Heterodera glycines
  misc_feature (1011)..(1011): n is a, c, g, or t
ctatgagtgtttggtttggaaactgtctaaaatgttccggggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggncattatatgcagaaaagtcagtgcatatatctc

SEQ ID NO: 30320 - DNA, 1457 bp, Heterodera glycines
aaatttttgtgaaaaatcaattactgaaatggccgccaaacccatctttttctgtggatcgcatgaaactgttgctgagttcgggggatggggcggacgttcacttctttggtgggccaaagggaccctaaaagaggcgagatgccgtggaaattcaaagcattacaaaattgttttggtttttagcttttgtcggctcacaaactcatttctgatggccgcttccgacgtgttcgaggcaatgttccgttttgactccgcaaatgcgacgacttccacttcaaaacgtaataaaactgttggcctaaaaacattccctcaagattttggggaaaagtaaaatttagagatttttttgaaataaaaaaaaactctatttactagaaaaacctctactaaaaattagaaaactaacaaatttcgtttttttcgcaaaaaatgatgcggtgtaaaggcgggggaaggaaacgtagtgcaccccctaagaatgtcctaaaaattgaaatttcccgattttcagcgccttcggatttggccagcagcagcaaccctgtggtggtcagcgacgtcgacgccgatgtgttcagggcgatgttgggctttatttatgcggacgatttgagtgggatgaacggcgacaatttgttcgacgtgctttacgctggtaaaactttaaaattcattattttcttcgtttattttaatcacttttagccaaaaagtacaacatcgccggactggtcaaagcatgcgccgaatttcccatttctgagttgggcaatgtcttccacactttggccgaggcgcgacttttcggagagaaagtaacattttcaaggaatacgaattaaatgggactgaactgctcgagagtgaatctcggcttcaaatcccggcacaatcctctacatatggaaaaacgcatttttaaaggcattcgccgaacactgcttggaatacattgaccaaaatgcggacactttgctcaaatcggaggaatttctgcgcattgatcagcaaatgttgtgcgacattttgaagagtgatcagctggtgatcagcagagaatttacgctttggaaaactgtaaaattggattttaaaaattgtttaattaattaaaatttgttttttcggcactccgttgggccgattggcaatgtgagcaaaaaggcatcgaatgttcgggagagaatcggcgggaaatgctcggcttggcactgttcgaaattcgcttcccgcacatcacaaaggaggacttttcgaagagcattggtaatgccaattttatttattaaattttgtctaagttgggtcaaattaaaaaacaattaattttggcgtcacgcggaaaataaaaaaataatttatgatataattttaatttcaacaaaacagtgccgtgcggtgtgctgaccgaccaagaagtgatcagcgttttgctgcatcattgcctt

SEQ ID NO: 30321 - DNA, 1590 bp, Heterodera glycines
tcgggtcgggtttcgggacgagaaaaatgtcgggtttcgggattcgggtcaattgacaaatttttattacatgttcaaaatcaatacgaagatttttttatccgaatgaaaaaaagaagtaaaaattttctgcggcgcgctttttccaaaaactttttgggaaagggggaggggtggtccggcggtgccgatgggcgccgccgtggaaaaatttaaaatttaattgcaatttgttaaccagattttattcgaaaaatgacaaatattaggtcggggaattgcacccaagcgataaataatgaaaggcagaaagcttagccactaggtcacatatttctaacagtctttgaattattcccctaaatttcgttctcttcccccgccgtttgtcccccgcattttcgtccccccaggcgctttcgttggtcctccgcattcattgcgccaattgccgtgttgaaattggccaaaagttgtcgaaaatattccctctcctcgtcaaaacggttcaccaatacgtcaagtcccatcatccaaaagttcgtttccgtgtccaattcgtcgatgcgctgctgtaacagttggccaagtgttttggcactgatcccattgaaaagcatcagcgtcccgtcctcgtcattccgtgccaattccaaatagcagctttggctatcatctgccataaagcctagcaccgcttccgatgatgggcgtgaagtgtgccggaagctcagcaaagcctttcagaatttattttaggtgcttttgttaaattgcttttcaaattttcatgccattttaattattgtttagctgataaaacttgcttaatgtcatgttttaggcaaatgaatatttttgttttttgcttcaaattttctaataaaataaaaataaagattgcatttatagaaacctctaaaatttcgaaaatgtttactcgtaaatgaatttttttttttaatattttcaaaaattttgaaattaaaaattttcacaaaactttactttctcataattttttattttattttgttgaatttgaagtaacaaaattttaaaaataaatttgatttttttagaccgttaaaagcaaagcgatgcgcggatgttgttcattccaaattcgaatcatctgatcaatttggtccaagtgtccgtccaaccaatccaaatcatttgtacaatattcaaattccttatccttcttatcaaatgcgaatcccttgtaaatgttggaaaattcgctcaaaaatttgttgtgctaaatatttttgttatttaaaattttcaacaatttttgccaatttaattggccaaaacttcacactttattggatcgctgatttggctttttgtagagcccaaaatggggttggatcagcagcaattcataaatggtgactccaagcgaccaaatgtcggattttgtggacatcttaaacaatattatttttgttttttaaatgtgctgagacgatgcgaaaaaaactcaatgattgataaaataattaatttattatatattcaatgaatttaataatacgggtgggtattttaaatataaatttaaaaagaataatataaaaa

SEQ ID NO: 30322 - DNA, 1665 bp, Heterodera glycines
  misc_feature (519)..(519): n is a, c, g, or t
aatgccaaatatttttggataaattacttaataaattaatttaaaatgaactcattttcatcgcaaagttcattaaaaatttgtgaaattttcccggcggcgcctatcggcactgccggtttgaaaaaattgcgcagcaaaaaaagcggttttgaaatcaaaaatagtcaaatttatggaccattaagagatttttgtctgaaaattatgtttcactatttgtcactatttcgcacttttttcactatttggtcactattttggcacttttccgtcactattttagttaactattttgagatttttcgacaataaaagtcggggccctaataattagagaccggattttagttttttgattaataaaaatggttattttttctcaaatatttgttatatctattaattactttttttcctatttattattttttaaactatctcgaatagttccacatcttttaaaaaggtgtatagcctcagtgagtttgcgaccgaattattagcattttcctattntaataaaaatttcaaaaaattttcgctggctgcgcctatgtccgccggagccccaaataaagtaaaaatttaataaaaagtatttattcttagtttcttttttgtcatcaactttcttttcaatgctttgccatttcttttaattttgcatgttttttgctatggataaaaaattttatatacaagaaaatgtaaaagaaaatgttatcttcattctcaataatatattatttattgccccagtatgtttattttttgtctatttaaaaattcattttaattaattaaatctgatgcaaacatggtttaaattgtgatgccacaaggaactgagtgtggaagaaagtgggataaaggacataggagaaccgctaaaaggagcgcccgtagctcagttggttagatcacggcacggattgcttgggtcgggggtttgagtctcaccgggcgagttaccttttatgttctacaaaatgatatttttgtctaataaatattaatgtaaaagaagccgattcttgtcattatccaaaattataattttatgttttgtattagaaattttatatttgacaatttttgtagaaaaaaaataattattttctttaataaaaaaaattaaaatttcattttttctctgtttttaattttaaaaaacttttaaaattttataagttagtaatttatttgaaaactcttttcacaattttttaaatatatttatgaaataaattctcttttgtttgttttaaaatttctgttccgcttatctttgaggcttagccatttattaaatttattaaaattatttttcagttaatttttatttatttgtcaatattttatcaattttattatgatatatttaaatgagggattaaatgtccctaaattttcaaaatgacatataaataggttaatttttcgtgaaatcttgtttaaaaatggccaaaatctccaatttttttccccaacggcgcctatcggcatagcagcgccacaaaaacttctattttttctaagaaaaatggcccaaaaacgcaaaatttgatcattgtttagtgaaaatctgttaactagtttttgcattttttactttcgcaaatttcgcgtttcgttttttagtttccgatttggcccatccct

SEQ ID NO: 30323 - DNA, 1484 bp, Heterodera glycines
atataaaattctgctgtcagaaagtaaaattaaaaattcactacattcaagcacaagggttgcaccagggcatggaagattgtaacagaggagggaatgagtacatccatagtttggcaaccataaaggctgcagtccaattttatatttttgaatgctccaatttctcaatttcccaacggcacctattacactgtctatcaacggttaatatattgtaattgtatattttaaataaaaacatttacggattaataaaatgaacatgatattccaataaaaacatatttacgatggattgaaatgtataaattcaatatgggatgccactaggactcgcatttgatatgcaatgtatatagtacttttgttctaaaaatttttatatcatcaacacaggttgtgtctgtggactcggaggcggtggggccatcccatcaatttgttgttggacagccgaagccaagacaccgccagggacgagagccgattgctgcacctgaaaatcctctcattaacaaaataagaaatgttttatgacctgcgccacagtcgcattcttgagcaaattgttgtaccgttccatccgagcattgctaatcggtgtaatttggagaatatccgaaattatcgcgatcctaaatggcaaaaaaaaaggtttttttttgttgaccaacataaattacccctccgtttttgggacaatggcaaactgtcgggtgaaaaatttcatgttcaaaaagttggtagacccatccgacacttctttcccatcgcgaaaaattccttgcagcgataagacgatcaaattgtcctgaaaagcaatcaattcctaagcagaacatttgagtgaatggacaaacaacaatttaattaataacccacagaagtgaaattgaagtcgagtagaaatgattgtttgatgtgctcagtcggaggtaatttgctcagagcgactgctatatccataggtccacgataaatgattttgtcacgataggattgccatttgtgttgttggatgatgttgtgagaagaacggatgtacaggccgatcaactctctgaacagagacagaaaatgaattggaaccaaaattagaagggaacagggggggggggaggggggatcaacctgaagtatttgcgaagggttccggaggggtagaataattaagtaacccactgcttatgggtgttggtactccattagcacttactgatggtcacttctgtctctgtttccggtcggatgggtatccgccagaaaacacatcgaataggtaaacgtcgccttaaaagcgaattttactcaaatttaacattgcccattttgcgtacatttgcgtcgtatgcatttaacaattgttgtcgcgtctgttcaccatttggaccgtcgtaaaagttgaaaaattccaagagaaaattttcagccatcgtgcgaaaagatcttcggtgcaaaaaccgtgcttaaaggcgcaaaaa

SEQ ID NO: 30324 - DNA, 1071 bp, Heterodera glycines
  misc_feature (974)..(974): n is a, c, g, or t
aattttatgataaaatgccctaagaactaattggaatctgtcataatcttttccttagcaaattggatggaaatttttcaaaactacttcccaattctatagtttcaaattttaatttggataacctttgctgtcgaacttcgtcctcctgttggctcagataagccgcgtgttccttgggatgcctgtcgcgcaaatgtcgctcataaatgtgcttgtccagaaaacggttcctgcaaatgcgacatcggaccatctttgaccggatcagtttccggatctccgacggtttggtcgggtgcgcaacggcacccgcaatttcgtccgcactttgggttcggatcaccaacggcaccggcttaagcaccttcacattgctgctgtggccttgaaaatgtatggggataaacaaccatacaaaaagaaaacaatgccgtgccacaaaagccggtgaaaagtattttaatttttgaaatttgtgtgggcggtgcccggtcctggcattcctgcgcaattcatcataaatagagcagcaggatttgaaaggaccaaaatttggcaactatactcgaccggattaaaaagccgttctcaggactcatagagtaatccacggcgtatttttcaacaaaaaaatacccgacaaagggacttgataaaaccttaatagccatgccaaaaacaggaattaatcttttaatttaccataccattaactgtcacgtccgaagtggacggtgtgagtggagtgagatccggttcagatgagataactgttgttgtggccgataaattggagacagatgctgtcgctgccggagcagcagtggaaggggctgaccaaaaagtgaacgctccattgattggtgtaccggacgcatttaacacctaaacagttaaatgcaattaactaattagcacaaataacggttttcactaattattgtaattaaaggtaattagcgcgaaattanagtttctatttaatcaccgttcgtttaaaattgtttcattgtattctgctgctggctcaagttgaagcttgagcgtctctctttgctgctcatcaca

SEQ ID NO: 30325 - DNA, 1540 bp, Heterodera glycines
  misc_feature (1434)..(1434): n is a, c, g, or t
  misc_feature (1501)..(1501): n is a, c, g, or t
gttttttaaatagacaaaaataaagttgtgaaatgtttttgcatgtgttttgcaaatgtaattaagtactaaaaaagagtgttctccagttgtgtttttaaaaatcatttaagtaaagaaaatgcacttttgctgttgaaaatgcacatttttgcggttgttttttacaattgtattattttctttaaaacacatttacggtcatatgtattattgtgcaattgttattaagttgcagataatgcggatcttccgagcatcttgtgaaattgtatttaattattgtaaaacaaacatttcggatcaaaaaaaatttatttgaaattaatttacttcaaacacaatttttccggttttgtttttaaaatataattgaataaccgaaaatgtgcattttttttaaacaaattttgtggttgtgttttgcaaatatagcttaataaccggaagctgcgcaattaccagttgtgttttataatgaaaatctatttaacaattttttaatttaataataattggaacaccttttcatttaacgtttttctgatattttcaaaaataatggtaaagaaggaattaccaattttcaattttttgattttaatagctgagttgctgaagttgagaggtattgaccgtctgcttgtggcccgtcaattccccgcatattttttgaaaaaaacaaagtgatttcagagtcataatcttgaagttgacatccgatctgtttctaattagtttaaagtgggttggaggcttgacgcattgacctcatgatcaggaatttgatgaaacataaagacacttgcatttctttttaattctttggcattttgttttttaagcaaacaattttatccgctttctttgccgtccatgactgaatttcacagctttatccgtaaataatttaatagttttttatggatcaaaacaggaattgcattgaaatccgatttctgacttacagacatttttggtcggagtttgctctctcggtggagcaaaaagatgggatttgaacagattgacggaggagcagttgaatgaattaataattgttgtgttttttggttggaccaatccaccaccttattttatggaatttgtgtttttaatctaaattgttttcatgtgattttaatttaaaattaaacagttggtgattttagaccgacttctgttcataaagctatggtctctttggatgattttacgaatacactattcatttttttcaacaaatccattcttgtcctcattattttctcattggttttccaaaacatttgaaatggttgttataattatataaaaatggtaaattgattaatttgaaaactaagttttatggctgatcagtagggggtcgaaaaaaacatggatataaattccttaaatattccaccaacaaaatctcaaatttatggctanatttctcgaaatctcttcaaaagttcagaggtgatccgtcaatcaaatttgctgtttaggtatctgncaaaaagcgagaacgcgagagagagtgagagagagagag

SEQ ID NO: 30326 - DNA, 1629 bp, Heterodera glycines
  misc_feature (897)..(897): n is a, c, g, or t
  misc_feature (914)..(914): n is a, c, g, or t
caatctcaaacaattgctcgccatagcaattgttaaactcaatgttatgacgaaaaatcaaacaaacgcattattttattaccatcaatggaaatcggaaatgcatatgccgtgagagttccatacacaacattaaaatgtgcaaagcgtgtaaaagtaaaaaggattttcaaatgataattacagtagaaagaaaacggtgaaaacgccattattgtacggtataactcaaaaggaagaaatgacagaaaagagagaccaccgagacagatcaaataaaaggtatgctctaaacaagtgcagcttacacgactataaaatccagtttttttctctcgatctgtactctatttgtcttgtcaaaaaattcaactataatccgaactttttttttcataactgaaaatgaaagtggattgatggaggccttaaaataagtcaatagattttttggtcactgtaaaatgcaattgaagagccaaaagggtggaatgtgtgattgattgactgattgatgctgtttctatttccgatttattgcgacgttttggctgtttttgaggtggtgatgtacatttttgaaagaaaaaagggatgtggaggaggaggacgcacactaaagcttcatgtaattcaaacatccgttttggcgccatcgcttggcattccgtccctattgctgttgttggtgctgtttctgcttttgcaatgcgtccaactcggggttgatcacgtccaaaaagtcgttgtacgccttgtccaagatgtcgttgatcaccacatagtcgaacaggctcggctgcttctccactggaatgggcaaaatgaggggggccatgggaaggaaattttcaatgaaatttccacggatttcgaaatttcgttgggcgatttatntaagcattggactgtcncaccggcttccatgtcctccttggcgtgcttcagccgcttcgcaattgtctcttcagtttcgcttccgcgctggcgaagtcgttgttcctgaatttttgattttgctttttgaaaacccagtactgtttcttatggtccgcttattataaatcgggtttcgtctgggaaaaacgatgaagaaaatcccggtcttacaggtccgtagccagaaaataaaaaattaggagggtgggagagggaaccaaagacttttctttatttctgacaatttaggtttggatccgagtcgatttttacaaaaataaacattccaatccgacataccttccgagtcaagttcatatccatcaagtaattttggctcagcgttttgtccgcgtccatccggtacatgtagataaagtcacgaagagcaggcaacggtgggaaatgtggcacgacggaacgcattttaagcatttgctcgtctagtataaaaataaaatataaatacagcaaaaatacagtatacatagtctttgttaaaactcaatgcttacaattagacggagaagcaaacaaaaacaacattatttgttttcatcagtgctatttcaaaattttcaagcgctgagagaaaaagcatgagctttaaatattcattttgcaattttggggtgtcaaattttcaaaaaatatagaatgtgagtccacagtgatgaaatatgtgccgca

SEQ ID NO: 30327 - DNA, 814 bp, Heterodera glycines
aggaaaggaaaagagagacggacaattcgaatgcctttctgtttaatgacacagtaattacaatttttgacccatttaacaatgaattaaaatgaatcgaccaattttttgcgatttttaggtgtgttcgtgcaattcgtcagacttttgcaactttaaaatttggccagacggtaaagaggagcagcagcagcaattcgacgacgatgacgaggacagcgatgagagtgacgacgaagaaaaggcggaggaacaaagtctgacgaacggagcgacgaggagaacgacgacaacaacgcactactcgagatcactggtcaccgtcacgaataatctgctcattttgatgcttcccacaatatttgcagtgtttactttgaacaattggaaatggaaatgaaaaaaaacaaacaaaaaataattcctaaatgaatacacactattatgttaaaaaatgaacataaatttaaatactaaaatttttcataattttaaaaaacccgtcaggaaattcttttggatccaacattaaaaaatgggcggtcagggtcgttttcgtaccgccattttcgtaccgccgttttcgtaccgccgttttcgtacgggggacgttttcgtaccgccgttttcgtacgggagacattttcgtacgagttcttgtacaagcgtcagattcaattagaaaaacttatgactaactaatcgaaccaaaattttaccatttttaaatttcccattcataaatttaatgtaaaaaatgcataaatttaacaataacaaaatgggacaaactagggtcgcatctcatagtttc

SEQ ID NO: 30328 - DNA, 1162 bp, Heterodera glycines
ggaagaatttgcccagaaaaccatttgatgaatgaaactgatcaccatttcaaaatattaaaagaactgtggtaattaggatttgggattgtgttttacagcatatattttgattaatttgctaactttgagccagctcgatttggaatatttttattaaaatttttcaaaatttttcaagaattccgtttcgggattgcctgtccccattacctgtcccaaaattttataaaaacttgtctcaataaatttgtatatatttttattgatttgaatgtaaaattatcaaccaaaaacaatgaaaattctatttttttttgtattagaaattatataaaaattcaaaacacattgcgttacaaataatttccattgtaatattttacaatttttttcattatttttaagattgtattctggattatttaaatatttttctaatatatttaaaaaaacaaaattaaatttgggtttttctaatcgacaacaaatagtatcattaagagtcaatttcttcatatttgttttgctttttattttggattatgaatatgaatagaaaatgtaaggcaaattacaacataataatgataagctagcgaacaatcttagatatattgtggatttcaagaaattttgtttttcaatctaagaaatataattgttttcaagaaattttgcttctattttcttgtcaaagagtttttcgtagttggcgaaatgcgcctaagaattctttagttattatgcacaaatcgcgccaaaatatataaaattaaaaaaagaaatgaattttaaataaaatgaataagaatttttatgataagaaaaagaaagaatttattgaacgatttgatgaatttaaaagtttatttggtcaaagaaaacaaaaagaatttgtgaaggaattggacatttataaaggcacacatttcgcaaatggaaaaaagaattagcgccaaaataccataaaaataagaatgtaagaaaattcataatatttatttaattttcttatttttaagagccataaaatgatgaagcaatatttcaaaattaaagaaaacaatccaaaaattagtgacaaaataattgttaagaaattgggaattgtatatgaaacactgagaaagtggaaaaagaaattcactttaatttagtg

SEQ ID NO: 30329 - DNA, 1261 bp, Heterodera glycines
aacttgagagtaaagaaaaacgaaggatttagttagcttttatccgggtcccggccctttgcagggtttcggcgctgtctagtctgaattttcattaaaatacatttacttcttgggttgaatgagcatctgatttctaaaaattcaaaaagtgtgcccgaaaaagtcaagggcaacatgaatttgattttttaaatgaaaaacttttgaaatttggtgaggtaatgggagacaattttgaaaattgtgaacaaaattcccatttatataacactccaaaaaatatttataaccaatttttgatgctcaattttttgccaaatgtccggcaaaagtgctaccgctgctgctgccactgctggtggcagcggaggtgcggaaacatcacacgcaattcgcgtgtaatttggactaatttgtcggccgggtgtcgttccgatgatttatttgtcaaatttcacaaatgcgcgcgatgatgacgacacaaaataatttccttctccacatcatcatcatcatcaatttttctgctaattgtcgtcgtgtcgtcgctttttgtttggtgaattgtgcggactgtttagcccccggggggggggggacaacaaacaaatcgcacctttttaaacgccaaaactgactcttgaaggacaaaagccattttctgagagtttgagggggacgggggaggggacaatgtgagcgatgagtaagagagttgaactttttaattggggaggggctcaaaaggagggagggaatttaacaataatggaaaaaccaaaaaaacactcacactcataaactgacaatgggaagagatggacacaggtggatgaacaaaagtgccgaaaagaggagagttttttgaagtttttgctgtgactcatcattagtgctggaaatgatgtacctggacttaaaaaagctaaatatggactaaaaagctcaaaaatggccaaatatgtaccaaaaatttggttaaataaatttaaaaaatatcataaaaattacaaaaaataaatttaaacctcaaaaaaatgccaaatttatcaaatctagctacaaaaattgcagaccaaatacatctcaagattttttggtaaatctcattctgtcagcgaaaatttttggaggcaaataaaatatttaaaaaaatttgccaaatttcgaaaaatttcttttttgtggtttatttttataaatttccagaacgtcgatcattaggtgtgtatttttcgcttttttgcatttttcttga

SEQ ID NO: 30330 - DNA, 1436 bp, Heterodera glycines
gcttgagcatttgtgtagtttttaaagctgcatccgatgggtttttcagattttgaaaattttcaaatttttttgagctaggccccctcgaaaatttttcgtttttgaattttattattttttgccgatttttcccaggaaaacggagaccactttcaagcaacagtttttcgagctctatcgattggtggcatttttgaaaaaatttcaaaattttccggaaatagaaaaattttccggaattgagctccccatttccgtttaaggcttataactcgtcaggggttgattttagcgaaaatttgtcttagagcatttttgtagagaattttaagctctatctaaagtgctttatctcatgtttttatcatgaatttaaaaaaagttataaaattaattgtgattttgaaactcaaaaccataggggggaccccatgtttttgcatttcatgaaaaaattttttactcataaaattgccaaaaaatacttttctggggtaatttgaggtgctgaacacgaatatgcactttatattgcgttttggattttttggagggtggtaaaaaaaatttgaaaaatcaataatttttggcccttgaaaattcaacctaaattttaaaaattcataactcgcctcaaaatggtccaattcagctcatttaaagcataaaaaatagcaaaaaatcgggagaattttatgagatttattttgaaatttatcccacataaacaaaaaaatttattccagaaattctggaaattttctatttttcagaaaaaaatttatatctcggttctgaaaagtcattagagaaaagtaaaatactacaaaaatccacaattttttgctctattacataaattttatttgacctttttatcatcttttaaaataaagatacaaaaataaaagtgattttggcattcgggaccaaagggggtggacaggatttcttagtgaaaaatttttttcaacaaaaatcttccaaaaacatgtctttatgggttatttgggccgctgatcacgaatacgtaatcagattttatttttgacatcgttaagacctcagaatccctgtgtgattggggattctgaggcatcattaagagggggcggggggcaagttcgaatccgggcggtaacacattatttttcaaaagtattttttcttgcttatttttagatgtttttaatttatttaaaatagttttgatttaatatttaataataaataaatttttaatttacatttttttatcaataattgttttaaattttaaaattcacattgtacctcttctaataaaatatgaaaaaattaatttaaagaaattctcaacaaaattaaaaaacgggcgcgaagcgcccgtcctgaggctgcgaagcggccgaatgtctccacaaaattaaaaaacgggcgcgaagcgcccgtct

SEQ ID NO: 30331 - DNA, 1703 bp, Heterodera glycines
  misc_feature (62)..(63): n is a, c, g, or t
aaaacgaaacaaaatcgtcgtcctccttcaccgcttttcattcacagcatcagcgcctgacnnaaattgtacagttcgctgaccaacgcctcgtgacggaatgagacgcgaatgtcgggcacattagtgctgaaaattgatcaaatatgtttgctaaaatcggtcccatcgagataattaattcaaaataattcggagtaaattaccgcgtcatgtcgttgccgaatacgccctcctccttgtagttggagcccaaccagtacattttggtccggtcctgacaaatgagaaaaacaaattgtacaaaaggagagaatggtcatccccacctcaaatcccgactggagaacgctgaaatttaacggggaatcagtacaatcgaaagcggtttgccgggtcaatagcagttcgtacaatggcagttcgtacaaatgcgtttcgtacaatcgggtttcgtacaacgttttaatttgacgtttcgtacaatattaaatttaaaaaaataagtgatagtgacagcgacacatacttttcatcaaaatgacaaaaataagcaaattataaataagtaatgagctaaatgagtatccaaaataacaatattaatagcgcaaacaataataattcattcgggggctttttcggaggatttgctcactcaactgaacttggtcaacgaaagttttcgacaattatttcataacttaaatacttgcttttaggaaaggaaatacaatttattgtgttaatttttcaaacatgcacaaaagtggcaataaaaacaagtcgttaaatgagtttttaaagaaaaaatcgactttatatatatattttgtacgaaatccgcaattggaacattgtacgaaagtcccattgtacgaactgccatgacccccggtttgccatgtgaactcgcccacctgttcctggccaactcgcacatgtcacacgaactcaacttccatagaatacgggcattgctgtactcctccaacagaggttcctgaaaatttattaaaagaacaagttcattattcaaaatctcgttgaagcaatttttacttttgtaatgtgcaacctaagtgggtcgtccgttgacaaactgatgttcagccccttcatcagaaacttgagaaaaggcgaaagctgtttgatctgttcatggcgcataaaattgtttatggccgaacagatctgaaactatttttaatccatcagcacgctttaacatccccttttatagatttaacacaaaatacaaactgggcaaaaaattcattccctttgctgggagggtaacaaaattgtggaatcaactagataaagaactaataaaaacaaattctttaaatcaatttaaaataaaacttaatcatagataagtttattttataaaaaagtttcaatcagtaaatttttaatcgtatattgaaaaaactcagtaattcatcctaaaattttgagaatttttatatattttttaaaaaatttccaaatatttttctgtttgaattttttaagtttttcgggggagacggcgcggaaatgctcctgaaaacccacttgatcaggtggcagcatgtgcacatgcacgagtggaagcgcatccgtccgtcctagaggtacgcgctgcgcaacgcctcctcaatggaaatgcccagaagatggaaaaatcatttaaaatattgaaatttaaaaattca

SEQ ID NO: 30332 - DNA, 1234 bp, Heterodera glycines
tatcaaaaagggagatgaataaatattttaaaaatttttaattcctttttaaacatcgccaaaaagtttaggcttaactttttttatataaactgatcagaagcgcaccagattttgcaagggcatcaaaaagacaaggaaaagcaccgctatgatgctaacaccagtaactcttaatttaaaaatttttattaatttttaaaacttcactattttatttttttaatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttcagaaaatctcgcatgaattctcatttttaaattttttatagatttttaaatgtttggattttttttggcttaccaaaacttcatcgaacctggttctttctattctctttcaaatcgccccaaattttttttacagcttaacaaggccctattaagcttatttccagaaaatctcgcatgaattctcatttttaaattttttatagatttttaaatgtttggattttttttggcttaccaaaacttcatcgaacctggttctttctattctctttcaaatcgccccaaatttttttttacagcttaactaggccctattaagcttatttccagaaaatctcgcatgaattctcatttaaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggtctgaaacgcaccaaatttatttacatgttagtttaggcactctgatgctttttctatcaaaaagggagatgaataaatttttaaaaatttttaattcctttttaaac

SEQ ID NO: 30333 - DNA, 826 bp, Heterodera glycines
tgaaagaccaaaaagccaacaaagcacaaagacggagcaacaaaaatgctggaggtgcggtcaaacgaaccatcaccacgcagcttgcccgcagaaaggctacaaatgccgaaagtgctcacaaaacggacacatcgagtcgcgttgtgaagcagtgcaggaatggcgcaaaaagaacgccaaaagttggctcaagaaaattgttggcaatgtccacatagtaacagtcaacattggcaccacagcaaaaccgacaacaaagtcaacattgctaagggtcaaggtctcctttcaaggcaaagtcatcgaatttgtcctcgacagcggtgcagaagttaatgtcataaacgaaatgacatacaaattgatcggcagccctaaaatcaaagcctgtaaagaacaagcagtgctttacgatggaagcacaagaagcttcatcggaaaagggaccggcacattcgaattcaacggagtgaatgttgaacaagaattttatgtggccggcaaagattccctaaatttgctgtctattcaaacaatggacgcatttgggctgctcgacgaattgaaggaaaagatttcctcaaaaatggtgatatgtgcaaaggcggtaaaaaggacaacgctccaatccgaccaaaaggcaccgaggtcaacgaatacctcaccaagctgaaaaaagctttccccgacgtgttcaaagaataactcggattttgcacaaaggcaaaagcaaatttggtcctaaaaccggacgcacagccaattttcagaaaggctaggccggtacctcacaactcacgggaagttgtcgagaaagagctgg

SEQ ID NO: 30334 - DNA, 1986 bp, Heterodera glycines
ttccataattgttgaagcattttgaaatgagcatccatttcatctcttccgtttgttggatttgcagcggaaggggccaattccatggtattttttggcacattgccaatatgattttgattcatacgaaacaattttttgagaagaatgatcaatcgtcgcttcaataatgggtggtgcctaaataagaaagaaaattaaaaaagtaaaaatgtctaaaaatgaaatggattaaattttaaaaacagaatagggccgttagacaaaaaataagttctttttgaaatttaatagttttcaggaattatgaaaaagcttttttcactaaaaggataaaactattcgactgagaaattttggttttcaaaaaaacatcgcaaaactaattttctaaatataaaatttaaaaattacgtcataattgtgagttctgttgcggcacttaaaaatacatcagtccatatgccaaaagcaaatgtcaaacagatattatttgattcagtgacaattccaaatgttgtgacaaatacaaaaaaatttgatgataaatttgtcaaaaataggcataaaaatgttggtgagagttgcgttgctgttttcacattttcagaaaccttcattaattcatatttattaaggcacaaacatttttaatttacaataaatgtttacactttacttgatatcgctgtccgatatgataattttttggcgatgcttcttcaaattgactaatatatcttctacagttgtaattccgaattacgataattaacttaaaaataaaaattaatttaaaataaatatattaaatatttaattttaattgctgaccaaatattcaaagagacttatcactgttgacattgtttgggtgattaaatttaatgtagtaaatgtccatgactgtccattggttaccgtattcacaaatgcgatgatgaactgtaataaaatgccactggtttcatttttttaataattttatttttgattttttagttgttttaattcaagcttatttatttttttactatatactaattttaaaaaataaaaactaccgtaatgatgagccaaatgaaggtgaactgcatctttgagaaattttcatatgaatttgttgagattgttgccagaaaccgttcaatgatgagcacatggccaagtaaatgacgaaataacgcgttaaataccataatgttctacaatagaacgaattaatatcaccatgtaatttgatgaaaaaaaattatttctaatttttaatcaatttatttcggtttatttcgaaaaaagatcgtttatttttaattattacgtaatttttaaaatgaactaacgcaaaataacttagaatgtcattcctttcaaagaattttcgatttatggaaaggagttggggccaccgctatgattttccttaaagaaaaaagtttcgcaaaaaataaatttcttttattgcaattaaacataatttcaagacacaaatttcatgagaatttttgtgtttcaaatgctattaaaaaatagcttcgccttttttaagaaaacaacagtgaaatagggatacaaaacttgaatttattcaggtttgattaggaatcaaagaaatattgattattttatagtataaatcgagcttaaaaaatggccgaactttttccggttgtctaaaatataattaatacactataatttacgtttttatacattgattttaaacaaaaatacagaaaagtttagaatataccgtcaaaatcagatttggcggcgtgaatgagttgttggatatgaatttttgagtaatatctattgatcgtactaaaccccaaagcattaaagcaatactttgggtgatcagaatgcttttcaggttgacatgtaaaattttggcgggacaaatcaccaccaaattcaaaaaagcaatggccaacacaatgccataggtgaacaattcaaaggagaaaaatatatagtcaaaaa

SEQ ID NO: 30335 - DNA, 1594 bp, Heterodera glycines
tcgtgggcccagacaaaagttgtgatgcttctgcaaaagaagacttagccaactgtaaacagcaagccatccaaatgcttcaatgtaaaaaaaaattacatttggatgcaacctttatttttcctcgcctctcttttcgaaaagaaaagctattagcaagcgtgtttggaccaattctaaaacaaatcggagtaattaatttaatctgactttataagataaatgggaatttaagcgaaggattcatgcagaataataatctatagaaattctctaaaaagtagttcctcgcagattctgggaccgtttctataaagctagagacatatgcgctaaccataaaaaagatgaatcattttttgaaaaatttatatagttcgactaaatttgcaaatcgatttatggtgtacaggatgtttgtcgaaacataactcgtcaggcctttaagatagacctgccattgctattcctgcaaatatgcagtctagtcagcccaatcgattgctattcgaatggtttggggtcgttggcccaaacaaaagttgtgctgcttcttgcaaagaagacttagccaactgtaaacagcaagccatccaaatgcttcaatgtaaaaaaaaattacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcaaaataataatctatagaaattctctaaaaagtagttcctcgcagattcggggaccgtttctataaagctagagacatatgcgctaaccataaaaaagatgaatcattttttgaaaaatttatatagttcggctaaatttgctaatcgatttatggtgtacaggatgtttgtcgaaacataactcgtcaggcctttaagatagacctgccattgctattcctgcaaatatggagtctagtcagcccaatcgattgctattcgaatggtttggggtcattggcccaaacaaaagttgtgctgcttcttgcaaataagacttagccaactgtaaacagcaagccatccaaatgcttcaatgtaaaaaaatttacatttggatgcaacctttatttttcctcacctctcttttcgaaaagaaaagctattagcaagcgtgtttggaccaattctaaaacaaatcggggtaattaatttaatctgactttataagataaatgggaatttaagcgaaggattcatgcaaaataataatctatagaaattctcaaaaaagtagttcctcgcagattcgggaaccgtttctataaagctagagacatatgcgctaaccataaaaaagatgaatcattttttgaaaaatttatatagttcgactaaatttgctaatcgatttatggtgtacaggatgtttgtcgaaacataactcgtcaggcctttaagatagacctgccattgctattcctgcaaatatggagtctagtcagcccaatcgattgctattcgaatggtttggggtcattggccaaacaaaagttgtgctg

SEQ ID NO: 30336 - DNA, 2147 bp, Heterodera glycines
  misc_feature (20)..(20): n is a, c, g, or t
  misc_feature (32)..(32): n is a, c, g, or t
  misc_feature (104)..(105): n is a, c, g, or t
  misc_feature (116)..(116): n is a, c, g, or t
  misc_feature (135)..(135): n is a, c, g, or t
  misc_feature (143)..(143): n is a, c, g, or t
  misc_feature (146)..(146): n is a, c, g, or t
  misc_feature (163)..(163): n is a, c, g, or t
  misc_feature (169)..(170): n is a, c, g, or t
  misc_feature (172)..(176): n is a, c, g, or t
  misc_feature (181)..(185): n is a, c, g, or t
  misc_feature (187)..(187): n is a, c, g, or t
  misc_feature (205)..(205): n is a, c, g, or t
  misc_feature (208)..(208): n is a, c, g, or t
  misc_feature (213)..(214): n is a, c, g, or t
  misc_feature (219)..(220): n is a, c, g, or t
ttttaaacaattatagctantcattatgaaantgcttttcttttatggaaaataatcctaaaacaaaaatataattttttaaactaaattttatgtacaagttnntctcgcgtagngcacatgcccaacaattgntgatgagnccnacaaatctcggtcaccncatagnntnnnnnatgannnnnanttcttatttttataactntcnccgtnntgtgnntcggcccaaagaacaaatgtcaaatttagagcatttggaaccggaaaaataaaattttatttattttaatttttcgcatttccaaaactaaacaaaatttttttttaaaaaatttttaatttttaaaaaaaaattttagggttttttaaatttttaaaaaaaattaatttttatttttttttcaaatattaaaaaaaaaaaaaaaactcaaaattttttttttaattaaaaatttttttaaaaaaaaaaaaaaaaaaaataaaaaaatttttttttcgggggggggtggagaaaaaaaaaaaataaaaaaccctcccttttttacacaaatttttttttttgccccaaaattttttaaaatttttttttttttttcgccccccccccccctttataagaaaaaaaaaaaaaaaatattgaaaaaaaaaaatatttttttttttttgcgcgcccctaaattttttttttaaagaaaaaggcgggagaaaaaataaaaattttttaaaaaaaaaaaaggggggggcccccccccccccctttttttggggggttttttataaaaaaaaaaaaaaaaaaaaaaaaaaaaaaatttttttttttttattttttttttttaaaaaaaaaaaaaaccccccccttttttttttttttttttttttttttataaataaaaaaaaagggccccccccccccccccccccccccccccccccccaaaaaaaaaaaaaaaaaaaaaaaaaaaaaaaaaaaaaaaaaaaacctttttttttttaaaaaaaaaaaaaattttttttttttttttggtttgggggggggagttcgtgggcgaatttttttttttttataaaaaaaaaaattttttttttttttttttttttttgtgggggagaaaaaaaaaaaaaaaattttttgtttttttaaaaaaaaaaaaaaaaaaaaaaaacgcaaaatttttgtttttttttggagaagattttttttaaaaaaaaaattttccccccaaaaaaaaacaacaaaaattccccaaatttttttgtgaacactttttttcttattttttggggggggttttggaaaaatttattataaaaaaattttttaaaaaaaaaaaatttaaaaaaatatatttttatttttttggggaaattttttttcaatttttttttaaaaattttttcggaattttttttttttgaattaaattttcccacccgataaaaacttaaaaagggaaatttttttttaaaattctatccctaaaaaaagtttttttttaaaatattttggccatttttccaagaaatttggaaaactttataatttttttatccaaaaatcattttacattttaaggaagccgggaatccaccccaaaccaaaaatttttgtcgggcggattgccatcccatacgactgacgagacattgcatgaatattttaagcaatttggcgaaatcgaagaagtattctatcgaaaatatatattgaatttaagtaattaaatttcaaaaagtttctaattttactaagtttcaaaatctgatagaaaaattttcagttttttcttgccgtcgcttttcgacacagccgtacaaatttaaaaaaaaaatgttgttctaattaaatcagacaacaatttttattcaatttatctattttggttaaaaaaacttctgatttttaataaatttcaaaatctaaaactaaattctcattattttttttggcgtcgtttttggaacagccaaatttttatttaaaaaaaattttttgaataataaaattaaatttccaaaaggctgttgtcattacggatcgacaaacgcagaaaagtcgcggttatggctttgtgacgatgaaggatcgttgtgacgcggaaaaagcatgcaggtcagagccaaaaaatattttttttaattattaaaaa

SEQ ID NO: 30337 - DNA, 961 bp, Heterodera glycines
  misc_feature (955)..(955): n is a, c, g, or t
tatattgtataatattattcaacttttattcctgtacaatcatttttgttttaatttagcataggtctaaaatatatattacatttataaaaatttttttaaaccattatgatagaatttgtttttaattgctttaatattatcttactgtaaaaatttgtgctgaaaatttatcgtactccaacgaaaaatttatgtcagtgctcctctatcaatgaaagttacaaagaattatttgtttatttataaatttatatttttatgcgaaaatttcctttttatgaaaagcacttaaaaatttattacaattagcaaatcaaatgctctcatccgctttccaaacatcactcataatggtcgttaatttgtggtgaacctatattttttacaaaatgaaaaatttttttatagtagttttcttatagttcatacagaagttattttttatataattgctatagataatttttttatttgtattttaaagagatttttttgccaaatatacatgtatattgtataatattattcaacttttattcccgtacaatctcccatatatttttctgcgtactgttttttacatacaaatatatttttgttttaatttagcataggtctaaaatatatattacatttataaaaatttttttaaaccattatgatagaatttgtttttaattgctttaatattatcttactgtaaaaatttgtgctgaaaatttatcgtactccaacgtttaaattagcaatttgttaattaaacatcttttttcatttttaatatagaaatttataggaataaaattaaaaatgttaaatattttttctacaaataaaattaatttcaatctattagtacctggatccaggcctgtagttttcctggcttcaggtcaggcaggtaaaggctaattattggcaaccttatttttccctgtacttttgtacaganaaataa

SEQ ID NO: 30338 - DNA, 1340 bp, Heterodera glycines
ctatcacctcattatacaaaataatggcttacctttctcccccctgatttttaatcattccttttggataaagttagtgcaatgtttaaatacatctattaaaatagtgcacgaaagaaccttaaattatttcaaacgatttaacaattaaaacaaaggttaaaattgttttacttaaatttagaaaggtatttgccaaatcaaaatcgaaatagataaattgtttattcaaaatgacagcaacattttaaattatgaaatttaaatattaaaaaatatttctagttttatgaaatttaattaagcattaattacatattgcccagtaaaaagaataattatgtatccacaaatcataacttatttcagaaaaaaatagaaaaaaaagagtaaaaaaacttcaaacagcttacctctgaaaataagtcttgattcataagaagtatataagtgaaaaataactataattaaaattcattcgacaccgattagatgggcttttccgtctaaaatttgttttaaaattttttgcgattgatttttatagatttttctgaggttaatttggtcacgaccgattattaattggtaccccgggttttcgattatgccggttttggagcccccggttttaaacaaaataaataatattaattaaaagcattttagcctttcaaaaataaaataaaatttaaacagatatttaaaaacaaaataaaaacttgacaggtcatataaaaatttaaaaaaacagaatctgtgaactagggttaagccccgaaccctcggggggcaaattaacgggggtcggggaccccgatcggggaatgactaaattttattttaacctaaaaaccattttttctttttaactgttcgtaaatcttcttttttcactttaatcatctgatttcgttaacgccagtaaaagtgagtccaagctggcctttgtaccaggacttccatttattcttatttctaagaatgttctgatttggggtagcgtctaaaattattctgatttcttaaatatacttatagttttgaaattttatggcataatgtcactctttttcaagaattttaacgtctgccgcaaaatttttttgatcttttgatcccgaatttactgaaatttgcataaatttcccgggctcaaaagaaaaatttaaaaaaattccaaatttctgaaacgcaaaataaggttcatttttctatttcaatattttgggggttttatcaattttttctaaatattttggcatttttcgaatttttcatgtaaaattcagaaacttttaaacatcaatgcaataaaaatgctttttttttgacgcgat

SEQ ID NO: 30339 - DNA, 1619 bp, Heterodera glycines
atttagtgcggaaatggcttttttaattttgcaaaacaataaaaaaatttataaataaaagattttataatttgtataaaatatataatattcaaaaaattgagttttttctttttaatttaaagatttaaaatttttttttgtaattctgcaaaactttttaaatttacattaatgggctcaattaatttaattgttaagcttaatgaataaatttcattgaattatataaatttatatgctttgatgtttttgtttgtttattttactcacatttattttatctaatttattttttattttttcagctaaatgaatgggccaaaaagtggcgaaaacagcggaaaaaagaaacaaataaaaaaaggtgagcaaacggaggaccaaaagagaaaaggcaaaagagaaaaggcaaaagagaaaaggcaaaagagaaaaggcaaaagagaaaaggcaaaagagtgtcataatttgtattattatttggtaatgtttgttttattaatttttgtattattattaaatgaaagtgtttatttgttttgtatttggtcgaaagaaaaaaagggaaaaacccgagaaaacaaacaaaaaatcccgcaaatattttgttgtttttgcagtataaaattggccctaaatgtgcagtaattgatcagtcaaacatttgatcagccatttttcattgcatttaaatgggttcaaagtgcccaatgctttccctctgtgcccttttggcggtgtttttgtgctacggcaccatttcggtggagacgcaatggtaagcccaaaaaagtgatcagattaagtgatcagccctaaaaaagtgatgatgattccgaggctgatccaaccagcagctgttaaaaatgacctcattggtcacatttgtttttttttcgctattttaaatgtgccaattatgtattacaaaaatgcatcttttgatcaacaagggcataatgctgccagaacattttgaaaaatttgtggtttgatgttggggtaccatttggtaagtattacaccgtaccaaataccgagtgatttatagagagagtcaaatctaagccacctaaatcagatcactcttagctgtttgggattaggtcaattgattgataaattttctttggtttatcaaagcttaggccttaggtaaaatttcgagcgatttaactatgtttagatgctattcaaaagtgatttatctgacacaaaaaaggcaaaatcattgaaacggataaaaatatgtattttatctgctgattttgaagaaaaatcagagaaatattaaacatttcatagctaaaattcagttttaaaaggtcgggaattgttttccgcctctgtgtaactaccgtatccattgctttttgctcaggtcatggccttactacggtctctattcttggccctactacggcggctattacgccaagcgccaggcgggctttgagccggtgcagcagccggcggcggaaagcatcggaggcgccgctttgcctctcccgcggccgccgagtgagcaatttttgggcaaaaataattgaaatttgctaattatggcaatttgggcaattagacacttaaacaaaaaaatgagtttagatcggcca

SEQ ID NO: 30340 - DNA, 1389 bp, Heterodera glycines
cgcgataaagccatatgttgtggagagaatgtggcattttccgcagaaaaggatcgataacatttccttgcattcatttatttattcttcatgatgggttggccaaatacaatttcaaaatatcggaggaatggaattttaaatgcaatttattttcagatattttttgtattatttattcttttcaattaaaaaacatcttcaaaatggttctcacaaccgtaagtcattaaactccatttgttttattatttataaatttatttattttttatactattattttattttctattctttgttaggtcctttcaatgatgcgttatgtgtccgaaattgatgatcgcgattttgttgatcgtttgcatagcttttttacaacaaatttactcattgggctgtcagttttagtcagctttaaggtcattttttaaatttgcttttaatattattttataaattaatatttaattccaatattttaatatgattaatattaataaaattttaaaaattataaattaattaaaaatattaatcaatatactcaaaaaataatcgtaattttgagaaaaaaacattgtttaggataaagaaatattctgtataatttttttcaaaatttacattaataatttaaagttcattttaaataattgaaaaaattgaattatttatttaatttccatattcattaattaaatgttttttttattaaactaaagacaaaatttcagcaattcggtggcaaaccaattgaatgtttaactccggacatattttccagctcttgggaagaagtaaatgagagaattcaggatttctcaattaattaattaattacagtacgccgagaattactgttgggcccaagacacttattttgttgcaccgtcaacaaacgttgagagtttggaaaaaattgaaagaaaacagcgtcggatcagctattatcaatgggtgggcgttaacatgcatcgctaaacataatgccaatgattggccactcccatccccgaaaaataatttaaaagaaaaacgagagtaaaaattataaattctaccgataaatcatttcccggtggcatcgcccaacggcaccatcgtacaatgatttttcctgttttgcgccaacgagtgaaaaattcggaggggcgtgggaggggtgaggtagttcaggcctgtagccagaaaaaaaaattcagatcggggaacccgaagacattaaaaaattttttaccacttaattttcaaaatttttaatgccggacgaaaaagcaggaacttaaaatttggaaattttaatgaaattgataagaaatttttcaaaattacgcatgcattttttcttgaaaatttttaaaatttttcaatcggggagaggggggg

SEQ ID NO: 30341 - DNA, 1764 bp, Heterodera glycines
gatgcaaatacatatttttcctggattctctatgctctgaaatagtaggaaaatcctttcttttttgtgtttacgaacaaaagtttggacttttatttacatatgtcgtgattgttatacatatttcatacatgttttcattttttttacatattttgagaatttatagaagaaataataaaaatttatttttgaaaatgtacatcaatgaaaatggtgttttttcaaggcggaaggaatgaatggaaattttttgtgaatgaatgaataaatatattcaatcaatttcatttcccctctctgtgctttggcaatctttggcctccaaaattgaccaaagttttccattttatattatttaatttgcaataagcatatttaattcccgattttttttattttaaacaatttctcttaaatattttgaaattatcgactaatgaaaattccctttatattgtttaataagaacttaaggattttttttctattttatgcatttttaaataaataattttaaaaattttctcatgaaaatctcttcacatttttttttcttttacctttttaaatttagaagaattttttctgtaaattttatcaaattttctacaaaaaaaggcaatgcgaacatcaaattcagcttcttcagcagctgttgctgatgatgctaatggtggtcgaaattcgtcggacgattcaccgccggttgagccggaagaagaagcattggattacatggtcaccattcccgagacggacggggaggtgcaaattttggaattaaatacattaaaaaattaaaactatgaaaaaatgcaaaaatttaattaaaatattttaattaaaaaaattatcattttttttattttgttaaaataataaaattttttaacactaaaaaaaatcattttaatttcttatattttttaaataagaatttttttaatgaaaatattgttttttaatatacattttttcagtcggcgttcagttttcgcaagctatgggccttgtaagttaattttctttttcaattatttaaatgaattttttgttcagtaccgggcccggctttctgatgagcattgcctatttggacccgggcaacatcgaatccgaccttcagtccggcactgttgccaggtacagggtaagcggaccttttgcggaagaaagctaatttcaccatttttcaagttaataaatttagatttttttgaatttgtgctaaattttaaaccatttaattttcttcgttttcttagtccttcgatatgaaaattcttaaaaacataaaaaaattctcaattaaaaatatttcctcattaatggcttttcgttttttcaaatattttcttgaatgtttatcctccctgcttttttttattgcattttttgaaattttatttctttcataaacaaactttacaaattttaatattttttagtaaattttaaattttcctatttttaatttatcattaatttaatttattttcaattttccttttttatatttttcccattttcagctcctttgggtgcttttgttggcccattgcgtcggctttttcctccagcgtttgtccgctcggctcggcgtcgtcgccggccgaagcatggccgaattggcatttgagtattacccgcgggtgccgcgcctttgtctgtgggcaatggtcgaaattgccatcatttgtcagtttaatacactaataagccattacaaatagtttctgaattacggagctttttggggct

SEQ ID NO: 30342 - DNA, 1731 bp, Heterodera glycines
  misc_feature (30)..(30): n is a, c, g, or t
  misc_feature (67)..(67): n is a, c, g, or t
  misc_feature (96)..(97): n is a, c, g, or t
  misc_feature (1560)..(1560): n is a, c, g, or t
  misc_feature (1713)..(1713): n is a, c, g, or t
aatgatggggagagaaaggaatggaaatgnacagtgcaaatggcgaaggacaaacaaagtgtgcccnaattataaagcaaatgcaaaaattattannttttccatccgaaatttgcttttaataattggaaatttttaaaatataattgtaataataaataattaattttcattttgatttttaagttgtcctaatgttgtaccacaaatttgttcttgcatttatttttttgaattgtttttacaaattcaatgctgaagaagcaggtgaaaaaagaaaaaaattattttaattttaattcatttacctatttaataattaattataataattatttaaagaaggtttaactcaataattaaaataaattcagtagaatgtgccaagagaagccgtgcaaatgttctgcaaacgattgttctgtttgatgccagcccggaaaatcaaatggacttccaacaacagaaagaccgagtgatcaaagcactaaggcaaattaattaattaattaaatgttaattacatagaattatacataaatttcagagacattgagcgattctcgacaggaagaaaacgcttttatgagctgatcgtttttcaccggacaccaatggaacgattacaatcggcaaatattgacgaagtgaaccatgaataatataatttaattatataaattatctatttttaaattaagatcacagagcaaatcagcactctttcaatggttaacagccaagaaacatcgcctgccaaagtaatttatttatagtttaatttcattttttaattgttggtttcaaaatgccaattttaaggcgttaaatgaggctcgaactgttgtcgaaaaaatgccacaggcacaaagtgtcattcttctcgcgcacgacgggcacaacaccgacttggcctcggaaacgctcacagcgaggtgaaaaatgccaaaattactataaatgcgtttcaacacttatttgattaattaagtgctcgcctgtcaaagaaagtgccaatttttgcaattgccggtggaaaaacgccgccggcgctggccaaattggacgaatacacgggaggacagcgccggagagtgttcgcctttgagcaggacggacaacagtttttggacgcgttggacgaggtaaattgaaaaaatgttgagcgatttgattttaataataataattatttaggaaattgagttttgcccctcgccttcatcggtgccggcggagaaaaatgaagcggaaccatcgccatcggttgctttggcggcggaagcggaaaagccaattcagaagagcgaagtgaagaagccgatggaaattattcggaaacaagtccgaaactcaaaggacctggtcaaactggagtgtgggacgaactcgggagaagtacggaacaattgcaaatttaataatccattagggcaaaaaattaaaaataaatgtttaggatttatgacctaaaaagtacgaaaatttcgatttaggtgttgttgataatcttaagacaattttttaggattttttaaatatttaatatttcgattttgngattttaaaatttcaaaaaatgtccattaaaataaatataaataaaaaatattttctaaaaattttttctcaaaattctgtgagaaaattgccaaaaacaaagaaaaaatatttaaaattgtttgtttttccattatttcacttttaaaaggntttttgaattttttgctt

SEQ ID NO: 30343 - DNA, 1291 bp, Heterodera glycines
attttgcttttaggggaaagatgactttttgctgctgccacctgttttgtggaaatcgcgacaagaaggccgcctttgtgcgtctcggaagcgcaatgaaacattttgacagggacattgtgccaacatcggatggggcaagaaggaggaggaaaagcgaacagaaactcagactggagacggacgaacagagaatgaggctggagatggagaggcggacgaagacgcgcaagcaaataggggagaggaaacgcagaagattgagcaccgatgataattgggaataggaaaatgtcaatttccgttttatttttattcattttaataatttcaaaaagcaaaaaaaaatgacaaaaaaattgtttatatattgtgtatgatcagtgtgaataaattagcagcgataaatgtggacacattcattttgaaaaagaaaagagagtgaccgaacgaatacaaaaaacgtatgtataggcgattttatggagggggacggggggaaaccggcaaagcccgaacacaataagaacaaattaatattttcccggggtttatggatggtttttgtgggatgagaggcgaaaataaaaaagggaataagttggaatttatatgtacatatttgtgacacacgcacttatagacaaagtgatcatttggaggaagaaaagtgcaaaaattagcaaaaaagggggaaaatggatgagagaatttcctaacaatttgcattttgaggagagcgaaaagcgaggggaggaggaaatgggcacacattttgtgagaggaacgaacgaacgaaacggaggaggaggaaaaggaggacgaaagatcccagaaaatggacaaaaaatatgtcataaaataatatatgttatatgtgtgtgaagaaaagcagcaaaacaacaacacggttgagcaaaaacaacaaaaaattaaaaataaaaacaacgaatgatttgcggggggaataaatgtaacaaaaagaggcgaaaaatgaataaaaaaaataatcgtaaaatgctcaggagctccgctgtccaagtttaattcctccaacgaataattccgtgtccttctcagaaaagttcagtttctgtcgcttttcctctacttcctggtcttcgtcatcgtcctcttccttccttcgtttttgatcacgtttcttcttacgcaccattttggaacaacatcttaacattgaaatataagctaatcaagaaaggacaaataatttttatgtaaattattttatttttttgatatttaatcttttaaaccaattaacttaaat

SEQ ID NO: 30344 - DNA, 1320 bp, Heterodera glycines
  misc_feature (25)..(25): n is a, c, g, or t
ctgaaaaaataattatgaattaatntttgcaaaaaatacctcccctgtgaacctttaaaaattcataggaaatttaaattccttggtactactgctaaatcaacgcagagacgcctttccttgacctttttaggctcctgcaaaacctggtgcacttctgatcactactcgaaaaatgagtaaattaattttcactaaaaagttaagcctaaactttttggcctgtttaaagaggaattaaaaattttttaaaatttattcatctccctttttgatagaaaaagcatcagagtgcctaaaatagcttgtaaataaaatttggtgcgtttcagagcactttctgaaaaaataattatgaattaattttgcaaaaaataataaataattaaataaaaacgaaagactctgattttcgaaaaaatttttaaacccagctagctcggcgctcatttcagtgtaagttagtcctttaccggggagtttccctgcaaagtttggtgcgcttctgatcagtttctgaaaaaaaaagttaagcctaaactttttggcctgtttaaaaaggaattaaaaatttttaaaaatttattcatctccctttttgatagaaaaagcatcagagtgcctaaaatagcttgtaaataaaatttggtgcgtttcagagcactttctgaaaaaaataattatgaattaattttgcaaaaaattggaaaagtacgcaaaattgcaatgtctaaaatttttaaagaaacattatgggacagttaaataattatatgaataagcattattctcagctgttaccctgcaaaacctggtgcgcttctgagcactactcgaaaaatgagtaaattaattttcactaaaaagttaagcctaaactttttggcctgtttaaaaaggaattaaaaatttttaaaaatttattcatctccctttttgatagaaaaagcatcagagagccttatttaacatgtaaatagaatttggtgcgtttaagagcactttctgaaaaaataattatgaattaattttgcaaaaaataaataaattgtgaacctttaaaaattcataggaaatttaaattcataggtactactgctaaatcaacgcagagacgcctttccttgacctttttaggctcctgcaaaacctggtgcacttctgatcactactcgaaaaatgagtgacgcagagacgcctttccttgacctttttaggctcctgcaaatacctggtgcacttactgatcactacttgaaaaatgagtaaatgaaggtcactaaaaagttaagcctaaactttttggcctgtgactctaga

SEQ ID NO: 30345 - DNA, 1051 bp, Heterodera glycines
  misc_feature (1041)..(1041): n is a, c, g, or t
cgggtctgggattcggagttcagtttggaccacatagaagatttttttgcttttactggtaaaaacgtgttttccaggcgtattcggtgtcgctgatcacgaatatgacattaattccgatcaattttcgaaccccggaccaaaattcgaacaaaagtcggaaaaaaattttcaccaaaactgcatccttctatttgtaccaataactcgtattcaatatggcatcacatataatatgatatatgaataatgagggcattacatcggatacatttcagtgcatgttgaatcgattattggacaaaagcggatctatgaagacattattgtcatactttcgttagatctcttgaacagtaatcttaatagtatctatattcgcgaaatatataccgggaaacttcgagtccgattgttaatccattcaaactaaaagtgagttggatgctatttatttatttgtattgatttcatattatattttattttttggcggcgatctcggttttaattgttttgcagtttcttgaggacattttttaaattgatgttttgtcctcaatgtaagcggatttttcccttttgtggactttttctttattgacaataaacaataaagaacaaacgtattggccaatgtcactcacattaactgctaatttttgttgttgttttttgctgctatacttaaaagagagagagagacaatttctcaaaaattaaaaataaaagtaatgaaataaaaataccgaaaataatgattttataatacattaatggaataaatcgcgcgcgaataaacgtaccactgcaaactaaataaaggtaaaaattaatatttttgcataatataaattttattatttttaaagatttcaaaataaatatttctataaaattatctaacaataaattttagttacaatactattatgttatggaattgactggcttagaaaacatggatgataatagcataagatcaaagaccatgagatagttctagctgcggtaaacaaaaattaattaaaaaatgtaaantttattttat

SEQ ID NO: 30346 - DNA, 2085 bp, Heterodera glycines
  misc_feature (7)..(7): n is a, c, g, or t
  misc_feature (63)..(63): n is a, c, g, or t
  misc_feature (95)..(95): n is a, c, g, or t
  misc_feature (105)..(105): n is a, c, g, or t
  misc_feature (131)..(131): n is a, c, g, or t
tttcatncaatcatcatccaacatttctgcgaagctacaatgaaaagggaaatgcccatcganccaattcatcattggcgagtggaggtaacatnccattggaantacgaatatatgaccttccccgggtnctttctcaatgtccgccgagatttcagcgggacctacaaatgagaagggacgaccaatcatcatttgcaatagctgtgtggaaagtaaacacccattggaaatacgagtaaattgtccttctcctgaccttttcacaacatacacctaaatttgtgcaggaggaaagggttatataaataatgggtgaatggatattcaaccaatcagcgttcaatgggtcattgcagattggttaggtccattcggcagccagtggtgctagacactagacggtaccttgtgtttactttacttttcattcctttcgtttgtgagatagacctaattatacaatgaaaaaaaagagtcatttctttaaagttttattggaaaattgtgaacaaaatgttgaacatacaattcgggactatttaaatgattaaatttatttagaaattgatcaaatgtggaacctgatgataaaaagtaaacaaaacaaatgcaaaaatgagcacatgactttgatgaaatggtttgaaaggctttttggttatacaccgctccgggaaatgaattgagaaaggagctaacaattgatccgtttatcggtagcgctagactgtcaaaataaattactttcttctttaatccatatgcaaacattgcgacccagtgagaaccgggaaattgatgagcatctaaattaacaatcaatgagcaaggaaatcttaatgaatttgggtcaggtaattggtcgcatgggaagcatccaaggaacgtccggcttgttttctctgaagacatcaatattttggtaatctgattgctgtccatttgccttattgcccttttccgttaaagttagcttaagccaaagaattgaacgaagctgatagatgatgaggctgatgacggacaaggcaaaaaggatgatcatagaccaacaaaaaatatgcgcatagacatttgcctcttttggtaattctttgcagaggggtacaaaggggaaattaaagttatcatgatgctgttgttgttgttgttgttttaaggcactgcttgtttctatactttttgtagtaacttttatttttattgttgaattttgggttgtcgtttttcgggttgttgaaacatttttaactaaagtggaggcgatcgttgcttttgtagtatttttttgaatttctgaagaatttttaaaccccaaaagtcttttccactcattatattggggaatttcctcagcttttattccttcttcaacaatcaaacaaacaattggttgaaaaaacaagacaataaagaataaatgaaacattttttttgaaatcaaatggttgtatcagttgcaatcgttctgtttttatctaaaaagtagatggagtctgcttctcccataactatcagtgtaattcccccatcgggcactggctttttgaattttatgttcactgctgtacatccctttttgatcaggtcgaacaaaccgccatgatcatctccactattagtcatgttaaacacataaatacaatgagtgtgcaaaaagaaaaataatcagttccatttccttatgtagagttggcaaaaccaagcgcctcttgcgtatcattgtaggggcggacaaatttccaattttcacagtcaatgtcatacggggcctggggataggagcgaccattggccacaacactcaactcatgtacattaaagtgctgaaagttgaatggactccttttgatgttccccacataatctgagtttgccacaagacccattgttacgcggcgtggaacttggtccatgaacaagtttgcacataagactgacttttttgcagtagagtttcaatccaacaagctcaatgctatatggttgacccggaaggtatgatgtgtcaattaacaaaaaattgtcgtcatggggtcggggtgaggatgtcaatttcgcaatgattaatcaaatattggg

SEQ ID NO: 30347 - DNA, 1435 bp, Heterodera glycines
  misc_feature (55)..(55): n is a, c, g, or t
  misc_feature (93)..(93): n is a, c, g, or t
  misc_feature (123)..(123): n is a, c, g, or t
taaggtgttgtgtcggtgaccgattattacaaataaatctttttttctcccgttntattagaggtcatttgtaatatgtcctggcataatttntaataagttggacaaatttatgaaatgacncaatattactcaattcttggcatcattctattcatgtttttttaaaccataacttcttaacttttttattagtatttgttgaaattttcttgtttatagtaaaagttattacgaattaaaatacgtatctaattaaacagaatcaatcgggttaattcccatttcctgggcaaaagcatttttcagtgtttaaattttgtttctcataggacccaacatttatacaaccattcgctttgctttacgtggcctcaattttcgcgcagttccctcttttctttacgccgtttgaatgctttttgaaatgggcgttcacactttggcattttgctctttgccaattcttggccaattttgtgtggcgcattcgattggccgaatttgcgcagtttaccgtcgttaaattggcactttttcaaatgattttggctcaattttatgccgatttttgtcatcgggtaatcgtttttttaatagaattcctttttttgtgtcttttcagctgatttttggctcaaattttgcgtttttgccgatgatggtcccttctgttgcctgtgctcttctcgtcttttttgcttattgccatttcattctcattgtttttgcggaatctgttcaaatccattttttcaaatttcgttgtcgccgcaaagaagtgatttttaaaaatttatttaaaaaggcacgagaatatttattgtcagtttattatttttgaattttttaaaagcgcatcgcaatagaaaaattgaaaatttatttgtttttaattcgattaatattttgattttttaaaaccaaaacacagacaataataaacagattaaatttaaataagcctttttcaaattattttaaaagtaaatttccaaattcattttccgaattccattctctctgctgccgctgcacaaaatgacaatttgttgcttggcatggacaaagtgaaatttgttgccggcgttgacgtttctcagtgcaaaagtcagcctcagtttgccgtcgtctctttggtggtgcaaacattccccgggcttaaggcaataatgatttgaacaaataaaaatattttcaaaaataatttaaatttcttgccgtcttttaggtgctttatgttgcggatgaggtggttttgttgggccaaccggcccattacatcaccgaatatttggctatgcgcgaagcggggcccatccgtcgggcaatttgccgccacttgaagcattgtcaaaaagtccaactgttatttgtggatggcaacggcaaatggcactccagaggtgccattgacaaaaaaataaaatgctaa

SEQ ID NO: 30348 - DNA, 1336 bp, Heterodera glycines
aattttctgaaattctgcacgataatagaggacacataggctatcgaatgatagcaagattattttaatttgttcattctaagaaagttttgataacaatttttgatgattaaaataatttatttttaattaactaattttaattagaaattatttttatttcttttttttgattattcgattgccctatgtgtcctctctattagcctgaaaaatatcaaaaaatttcgataggtttcaaaaaacttatggccaaaaatattcgaaaacctggccacatgtgtacttttggccatagctttgctcaaccttgaccaaattttttgaaatttagccgagctaattgagaattcttagggatatcgaatgataccaagtatgtctattttagttgactttgacaaaagttatggacagttttttgttgaaaattcttatttaatggttttttatgacgccctttttgatggctttttttttataacggctcagcaccctacacacaagcaaataatttaattttgaatacaaatttgagtttttttttttaatttatttttattttgttacctgtcgccatcggcggttgttcagtgtcctgcgcctttcttatcactccacccccaacgatggcacaaaaaagaacaaaaaacgttgacaacgcggagagcattaatgcattcatttttagaaaattgtaattttaggatgcaaaatctttaatctcttaattggaataattaaaaataaaatcatttttaccaacaaagcaaaaataaataaaaacagaaatatttttaaattaattttttgaaagaatttctttttaaataacaaaaatttaagaaaaagatccttggccttgacttttgagttgagaaattcttcgggtttttgggttttttaaaaagggttaaattacagggatgcacaagagtctcgggtctcgagaaatgtctagagtttttgattttggtttcaaatttattggtctcgagcaatcactacgtattataattggggatctgaaagaataggagatatcgcccaccatcttcccagaaataattatatgattttgaagataaatttaataaaagtacatttttgatcagccaatgcccacactaatggaatgaataatgtccacaaaatgtatagaaattatgggtggggacgggcgaattagcgaaagggtagtgactaatgaatgactctaatcgaaaagccatagcaaattccacaaattgttttttacataatttatgcatttttaatttgctccgatggactgggaaaatgggaaagtaatacaataattattctgctgattaat

SEQ ID NO: 30349 - DNA, 633 bp, Heterodera glycines
  misc_feature (464)..(465): n is a, c, g, or t
atgtatcaccttccattatagcttaggtcgtctgatcagttgccaatttctcacgcggcgtctgtcgaacaccgccgggggtctcctaaaaatataaatgcagagaattgcacgacttttcctcaattctttcttatttctaaaaagtcccccccccccttttccataagtccccgccgatctttgctcacttcattaactgtcaaaattggtcatttgatttgcatttttcatctccattttcccgtccgtccctctccattttgtggggttctctgctgcccttcagcagcagttcagttgttgtgttgtaacacatcgtttggttgggggagtcccccgacattttttctcccaacggtcgtcgcccgcggggggggggggggggggttaaataggtgtatcgatcgcccagatttgtcaggagtctgggcggccagtcacatttttggaacgctgagtanngaaacaaaaattgtcgctatttaactggagataatattaaataggtagcaattcgaaacagaaattgtgaaatatgatcagtttctttccatttttagatgcagagcacaagaagaatattaaatagacatattgtacataatgaatgatgactatttatcattattc

SEQ ID NO: 30350 - DNA, 1240 bp, Heterodera glycines
  misc_feature (1093)..(1093): n is a, c, g, or t
caattaaaaattcattaaaaataaaaaggcctttacgccccgtccttccctctcattattgaaattatttttattataaaaatttcccaaaaaagaaatacgcctttttttgggatacagatgcaatttaaaaattcataaaaaaataaaagggccattacgcaccgtcctgcctctcatgatcgagagtatttgtattatagaaactatccaaaaaaagagatagccatttttttgggatacatatgcaattaaaaaattcattaaaaaataaaagggccattacgcaccgtcctccctctcatgatcgagagtatttgtattatagaaaattatccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattatccaaaaaagagatagccatttttttgggatacagatgcaatttaaaaattcattaaaaaataaaagggccattacgcaccgtcttccctctcatgatcgagagtatttatttgtattatagaaaattacccaaaaaagagaaatccatttttttgggatacagatgcaatttaaaaattcattaaaaaataaaagagccattacgcaccgccctccctctcatgatcgagagtatttgtattatagaaaattacccaaaaaagagaaagccattttttgggatacagatgcaatttaaaaattcattaaaaaataaaagggccattacgcaccgccctccctctcatgatcgagagtatttgtattatagaaaattacccanaaaagagaaagccatttttttgggatacagatgcaatttaaaaattcattaaaaaataaaaggggcattacgcaccgtcctccctctcatgatcgagagtatttgtattatagaaaaatatccaaaaagaagaaagcattttttttg

SEQ ID NO: 30351 - DNA, 1032 bp, Heterodera glycines
  misc_feature (69)..(69): n is a, c, g, or t
  misc_feature (115)..(115): n is a, c, g, or t
  misc_feature (130)..(130): n is a, c, g, or t
ttaatttgtgcaaaaaacattttttaatgaaaatatataaaaaatttcttttattttaattttatggcnttaacccctgttaaaaccagtcagtcccattgtgctgaagtttgtntcgtaacaacagccnaattttcctatttttcaagaaaaactcatcataatctttctaaaacataaaataactttaatattatatgataatagcctctttgattgctctaattagcacttaaaatctcagaaaattgtttttaaaatttttcaaaaaaaccccggggcgctgccactgaattaattttaacaaaattcaaacaataaaaaggtttttcaagaagaccgacagaacgtcggtccatccttccatccgttcatttgcttaagtgccgtgccatttccaatttgctttttgcttttttaattttttgaatttccgcctgctttttctttggcacttcctcaaaaaaacaacaaaagtgatggcactttgccatccggaaaattggcccaaaatcgcaattccaaaaatgccactcgaaggcaccaaaaatttgccaaacaattcggaaaaaattgtattttatttcgaaatctaaagaataacaaaagtttaactttaaagaaagttattttcccaaattattttttttttgaaaattttcatttcaaaattaaattattattaacttttataaatttctacataatgcgaatagtaataaatttaattttccaaatatttttcaacttttaaaaattcaaaaaatgaaagcattgcttttgcacatgcaaaatgtttgttcctaaacattttcccgccgctgctgctcactgaaatgcgattccgcatcagttaccatttttaaaaaggcgtcaaaagagccgtgccaaaaatggaaaaaatgtttttttttggcatttcgttgcgtgccatttttcaaattttgttgttttatttatgtgtgcttttttggaacagcagcagaagcagcagcgcatttgacggcttattgttgttagcatcactcactg

SEQ ID NO: 30352 - DNA, 959 bp, Heterodera glycines
  misc_feature (16)..(16): n is a, c, g, or t
  misc_feature (71)..(71): n is a, c, g, or t
  misc_feature (79)..(79): n is a, c, g, or t
tttccgctataattantaattgttaacatttgtgaaattttgttttaatgtttattttaaagcaaattttntaatcatntcaggcggatctattgaattttttattccagctggcgctctttagtaattagttacttttattttttttaaaattttttagatcttccaatttttaacactaattaatctttttaaatcatattcattttttctcatttgtaggaaagtgaatgatttactgattttttttattaaaataaaatgcaattatatatgattctttttttttaatttatttataaattgtgacatttatgcccatttttataatagtttttcacagcaatatcgggcccataataaagtgaatttcagaaaacttcatactttttccaattgctagcaataaattatgaattgtgctttatttatttattaatattataatggccgatttttgtaatttttgtgtcagttttataaaaatttgaaaaattgttttgcaatttattaataaattttttctaaaataatagttttccgatttaaatacttaacaataaaaaaaaattattttaatgattaattaattattttttattactcacgttccaaagagttatttgttatttttctcataagacttttataaaattgtgccgagcttttatttatccattttttggtattaatagataagatcaataattatgatttgtttctggcttaataatatattagcattaaatattattaaataaagttcttactatattgattaaattttgccaattttttctgtaaaatccatatttttattgctataaatttgattattttaaataaatgtttaatgcattttatttaataaataattttatctcttgcttactacgggaaaaaaatgtgtgatgaaacagcgcacttttatgtagactgtattatttaattaattaaat

SEQ ID NO: 30353 - DNA, 1233 bp, Heterodera glycines
tagcttacaaatcatgatccgcaatttgtgtttttttgactggtggttagattcccgttcccaaatttcttattggtcaaaatgaatgtcgtattcgtcatcagataccccgaaaaccccataatgcttgttttcaggagtttttaaatcaaaaaaaaattagaaaaaatttgacccaaaactgggatacaaacccaactagtaccgattatctttgagtttgagaaaagtcccggctcaataccagaagtcccgtccggtctcgaatacaaatgttcgaaacagcttatgacttgtataaattgcatacagaataaaaaactatacaatttgggagaaacgaagaagaggagagagaaatggaaacgacaaccaatcaatcccatgtgtaaataataataggtcaattttgaatgtagcaatggcgttgtgttaatggaaaaactaataaagaaaaagaggaaagagaaatagtacaaggatttgtctgactgtgtggggcgcaaaggcgggggaaagagaaggagacgcgtgcggttgaatggtggaggaattggagtggcaaagtgcaaaatgtggaataaaatataaaatacttcaataatttaattatatattagtagggcttcgatttttaggctctaaaaactgccaaaatatgtaggctctaggctctaaaaaactccaaaaataggcactaaaaaacctcatttttaggggtgtaaatgtagcgataaagaaaggttagttgcacgcccttttggcgattctttaaattgttctcttgtagtcacataacaggaaagtaccgaattttttagaaaattttccaattttaatgtcggaatagtgaaaaaatatgtgacaagatgccaaaaatagtgggaaaaactattttgtggccaactcccgaaatagttttttttagtggcgaagttccaaaataatttatttttaatattttaatagaattaattagttctaaattgatacagtaaaatcaattgaattcctagcatgaaaaaacataagaataattaatagtttctatatccatatttttccatattttgcgatttatgtccatatttccatatttttccatattttggcatttttatccatattttatgtccatattttggcatttttcaaaaaaacctctattagaaacgcccccagcagcttaattagcctttttgagcccaaaaccgaaaattttttcaaaaatca

SEQ ID NO: 30354 - DNA, 1001 bp, Heterodera glycines
ccggctttacttattggaggtttctgcatttgcccaaccccatggcgtttaatctcctcctccccttattattgcatttctccgcttattttcagcttttattttggcggctttcgcgtcattccgcgccaaaatgtcctccgccaccgccgtttcgtccccccaggcgtcatttgcttcggcactttcccccgaggcgtcttttggtgtcgcttcgtctgcctctctcacgccctcctcgtccgccgctgtctctcccccgtccgatcactccatgcttctcgtcccctctgatcacctcctctgggctctttcccttctcttttcccttcttatggcctccctttgcattgtcggcgctgtgatgaattccatttctctgttcattttctcacgccccgcttctcgcaaacggtccattaatgtgagcgttttctttgcaatgttttggcacaattttagcatattaaacaaatggataataagtaaaaagtgattaaaaatggacagaaattgtaattatttaaaaagtgactttattaaatgataattaatcacttttggcttcgttttcccttttcaatttttaattttacttcagattttgctctgcggtctgtccgcctccgacttggccctttgccttttggccctccccgtcttttccatgtcccaattggaatattttgtaccctgtgagtaatttaattcaatttaatttaatttgctcaaatgtgaagagggattagccgagtcacaggaggaaaagggaaggaatttggccatactttgcggagggggggggggcagaagcaccgctggcattggcactttgaaaccaaagatcgattcgcattcaaatttggcagtgaataagcgccaccggaagaagtggggaagggattaagtggcattttcaacagtcggaagatagatactccacccctcactaattgcataattaattaataaattgattgcccttccgttgccagcacttc

SEQ ID NO: 30355 - DNA, 1238 bp, Heterodera glycines
aaagcgaaattttcttttttcacacaaaagaaacattcccccaccaaaattttaattcaaacaaaaagaatttttgaaggtctgttctcagtctcgagtctcaggaatcaattctcgattttcgagtgatgcgaaatgttgacgctcgagttaacccctatttttgtgtttgcaacaaattctatttacaaaaggccataatttctggagatttatcgaagattagcattttttaattttaaaaaattcaaaaatggtagaaaattgcaaccgaatatggcaaaatttcaattttctggcattttggcaggggaaatcatgaatacttaaaaacttttgagtatggccaatggcacagaatatgtgaacacttttgcaaatgaaagagaaatggatggctttttgtcaatgagaagcgatgaaatattcatataaatatgcatatattaggggggattatcttttggggcacggcataatggcacaaaatagggtaattagcaaatttttaatgggcggcttaaatgacatacaaaaaataataattcatttttagccaattaagcgaaagatttgcgcgacaaaaattttgtatgttttgaaacatacataatgacaaccccagcaggcacaatgattgttatgttatgatgatgatgtttgcggtggtggtgaccttggcatggcataggtcatccgatgagaatggcaattctcgagagtggagggggtggggagacgactctcgtccgaaactgtctcactttactcctccatgttcctctcctctctctgttctttcacagtttggctcctctctctctctctctctttttctctctctctctctctccctttctctctctctctttctctccctccctctctatccctctcagtgtcactctcctaatccttttttagctcaattttcgtctctgcccctctctctcgctctctctctctctctcgctctcacattctctctctctctctttctctctctcctatctctctctctcgccctctctcacattctcactcactctctgattaactcacactccaaattctctctctcgtctctcttatttttccatctctttctcttcctttgctctttcttcgttccctttactaatcttttcatcacactatcacattccattttttcacttaccatcacactctctcagttttgcctttttctctcattccactctttctcagttttgcct

SEQ ID NO: 30356 - DNA, 1303 bp, Heterodera glycines
tcacttccaatcactttcctctctcactttttctcctttccaatggctcgtctcttctcgcgcatggacggtttggccttgggcatgaatagggagttaatggggtcaaggcaaacgaaggtggaggtgattggaaggaggaagagaaagggcaagggaagggaggagtggatgagacagaatggaaaagggacgagagggaaaaggggagggagaaacaaaaagagagagggagaagaaaggagtaaggagagggaagagcaagggcgagagaagaggagtgaacgagatagaatggaagagaatagagagaagaaaggagtggaagagcaaggaggagaaaagcaaggtgattgagagatgaagagaaagggcaagggaagggaggagtggatgagacagaatggaagaggacgagagggaaaaggggagggagaaacaaaaagagagagggagaagaaaggagtaaggagagggaagagcaagggcaagagaagaggagtgaacgagatagaatggaagagaatagagagaagaaaggagtggaagagcaaggaggagaaaagcaaggtgattgagagatgaagagaaagggcaagggaagggaggagcggatgagacagaatggaagagggaagggagaaacgaaagagatagatagaagatgaagaggtgaggggaaagggtaaagggaaaagcatggaggaaaaaaccacacagttgctggaccaggaaaggaagccacacacataaatggggatgaagaaaagcaaaaggaagagaagaagaaggaggatgaaaagttcaaggaatggaggaagaattggtggaagagaatgaagacaacacaatgtgagagaagaaggggacgtggaaggggaagagggaaggaatgaatcagcgagagcgaatgctcccctcacaaatgaggggagaggagggggaggggataaaaggtgtttattaaaattacggtaagggaccaatacggtaatgagccagaattaagagtacggttgcacagtttctctgatcattcttttgctggtcaacattctgatcatcaaatgaatttcttttctcttttctttctcttttcgcttttgctttgtcattcttttcattccttcaattgttttttatgtctttttttgatttctttttttgcctacggtaattcttttgtttgtttattttcttctgattgaatatttgtccctcgcgtcgtccaatgggcgaaagtccaaaaatgtccagcccaacggcggcggcggagtctgtggccaatgcacggaggtgggag

SEQ ID NO: 30357 - DNA, 1021 bp, Heterodera glycines
  misc_feature (1008)..(1009): n is a, c, g, or t
tttaggacaattttctatctcgtacccccgatgctaatcgtccgggagagctctttcaaaatttttcccattaccgtaagagctgcggaaatgtgaaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggcnntatctcttttta

SEQ ID NO: 30358 - DNA, 881 bp, Heterodera glycines
tgatccgaccgtcataaaggagacgatttgcaaaagaaagggcttcatccaacacatcaaggcaaacgacagagcgcataagccagcaaatgaagtcgtaagaaatgaaaatggcagggggaagcgtttgcgtgtttttgggcggaagggaaattgggtttgattccatttgcacctaaagcaacacaaaaaattattcggtgtgccaatgaattcagttggcacttgccatccatgccgccagaacagtgtccgggtcgggtgccaacagttcgggcagagaaccatcggccgaaattgtggcggcggacagcgatgggttgtcacccaacaaagaggaggaggacatttggaagctgttcagcagagggcaattggacgcatctgttgcgaatttcagtggagtgtcgggccgggagccgccagagggtgccgctggggcagtgaagcaattcaccgccgtgccgccggttgggttgccgccgctgaagttgtggtgggcatgcgctgcactgttgctgcgcactcggttcacaccttccaagggaaaaccaaatgaacactggcaaaatgggaacacttcgtacattcaatgaaacgcatgaaattgctctccaattcgtcggcagaagtgagcaactcgtaaatgtcgccccgacggtggctgagcacttctttcgctattttgctggtgtccggaagagcaagccacctgaaataccataaacattactaacttttgcacgctcatcatttagcatgtgtctaatacatgctactctggagtgcaaaacgcactttctatctcactctggtgaagtaatgtgaggacaagcggaaaggcaggtttgcaactccgagtcgagccggctccagttcag

SEQ ID NO: 30359 - DNA, 1666 bp, Heterodera glycines
  misc_feature (68)..(68): n is a, c, g, or t
  misc_feature (1652)..(1652): n is a, c, g, or t
atttcgcctgccattctgctgaccaattaatagcccaaaagcttcatgatccaccgcttacattactnttatttatgctttcaacaacaatcgattgtcaaaaaaagaaaaagcaatgtgtaagccccgcattaataaaagtgacgtgggacggtggtggaggtgtaatgcaaaagagcattcacgacggacggacgagcacaccaacggttttcctccttagtgcatttttgttgtgtgtgtgcagcattaatattagcctcttaatgaggccaaatcgcgctaatcgctgatgtgtgctgacaaataggccggggtgtactcactcgaccaacaagcaaacaaccaattcaaaaagggcacacaccaattaatttgcttgcttaataatgctaattagctgtggcttaaatgggcagatgaaagttgtgattggtctataatccatcaccacacgctcttttatgctgtgttgttatgtgcctgtacagcaggtactaattaggtgcaaatgtcgttttattggcacatttgtgaaaacttagtttctctcctccctattttggcatttaatgtgtgggtgtgttttttgtgtgtaaaatcgacagccggcatcagcagctcgtgttaatacatttgcggtccggacatttgcggcctgctggaaatcggacatttgcggcccgacaaatgcggtcggacttttgcggtccatttcttaagggctattttcggacatttgcgcccgacatttgcggcctacttgaaatcggacatttgcggcccgacaaatgctgtcggacttttgcggtccggacatttgcggcccgttttaagggccattttcggacatttgcggcccaagagaaattggacatttgcggccaacgaaacgccaaattgtcattcctttttcaaattaattataccaaatatttttatttaacacatttcaccaattattttgttcaatgacttataataattttcaactaatttttcgaaatatttttaactttttttcacaatttgattatttaatttaaaagagcttgctgaaggctccaaccagcacatttatttttctcaatgaataaccaaagtgcacacaaactaccaatcttcaaagccagcattttttttggccgaagattctttcaatgaagatggtgatctgtagggccgcaacttttagtgaaaaaactttttttttgctcaattgttttgaagaaaggagctcaaaaaacgcatttctgcattaaaattttttcatttggacgtcacttttcgtcactagaaatcactattttggggttttgtcactaaaatagttaaaaatcactattttggcgttttgtcactattttttcactatttcgacattttttggaaaattccttaacaaaaatgcaataagaacaaaaaatacacccctaagaatcgatctaaaaaaattttaaaaaaatacacccctaagaatcgaccaaaaaatttttttttaaataaaccactaagaattggaaaattttttcaaaaattctcccccaaaatttttttcttgacaaaatttttgatttaaaaaatgtcaatatttgctaagagaattttataaagaaaatgtagctcatttgcaaactgcaccagtgaataanaattatttttgctc

SEQ ID NO: 30360 - DNA, 1188 bp, Heterodera glycines
tgggttttctgatttgggggataagcctcttcactcatcaattttaccttttccatttttccctttccatcccttggcagttccccgtcatcatgatccctgtgcattttaatcgtcggtacaaacccccgcaatattttccatccatgcgtcgctcaatcgtgctgcgtccgttcatcacccgcgacttcatgaccggcaaagcagcactgccgggtcgcgacattcccatcgaagtgatcactcacctttgagagcctacaaaatgcccttttaatttagacaatttgggaaatggtgcaccgaattgagggtgaaatgccgtcaatttccgcagtttttgttgatttgacatcggtggagtttaattgttttattctatcactcttaacttctattttttacagaaacctcccgggacgaccgaatgggaatagtgaaatgttctgatgagacaacaaagggtcattcttaaaacgcatctccatttcgcccctttcttttaacttttctgaaaattaggtttttgttctgaggccgtgtttgttctcccattcgtttattgttttgactgcgatgaacttttgttcaaatgtctttttaataaattttatttttaattctttcattattgtttaaaaaagaaggtaaataaactaatttacttaattgagtaaataatggaattatctcatcagaattggcctaatgaatgaccaacaaaagtcgcattttctactaccaccaccccgacctcggcaatttccactacggtccgcagcatccgatgaaaccggcacggttgggtgcgttcgccccttttgacgtgccaactctgaccctttaaaatgttcagcggccactcacagtttggtgctcaactacgaactgcacaagcatttgacgtgtgtccatccgcccaaggccacccaacatgacttggcccgcttccatgcgcccgaatatgtgcagtttttgaagcggatttcgccgctgaacgcggatcagtacgagggactgttcaatcgctttaacattggcgaagattggtcggaacgcgggggggggggggagggcgggtaacaaattgtacggcattttcagtcccgtcttcgatggcattttcgacttttgttccctttacaccggcggaacgctcggtggttgctaaaaggaatgtgtccttaa

SEQ ID NO: 30361 - DNA, 923 bp, Heterodera glycines
agtcagatacattttctcaagggtcataaaacacacatttcatccaacatttcgttgtcgctatcccagtaattttgaagcaaattctgtctcacaaatcgactaaacaattttgacatcgctcaaaatttcaaaatcgctctgccatttgcaaaattggcaagatgccgtagaaatcagcatccatcagagtcccctcaccagcagaagactgctgttcaaccctccccccggtttcaagggattggcggcgacctcgttcccattagctacctaattagcggtaattcctcccccctcctctttgttcccaaccagcgcccaccaataagttagtgctttaccctccctctccctcgtacgtctcgctcatttattattattacgccccgaattttgcgatgtttggcccactgctgcagggccacagcccaactcctatgacccccccccccgccctctccgccgatgggacggacggactgtgtttattttatactcgcttcacctccgccgctcatctcatcacatcccatcgatctcggccaacacatccatccatcctcagcattctttcaattttctcgagaacaattgggaggaagtgaggtgatgcacccgctcagcccacccaacatcacatcatattgccatcgattatcctgggaaagtgaatgggtgtgagatttgaagatgaagcatgggggtaaagcatgatgggtggagatgagaaagtatagaggacatggggagggaagcctaacaataagcggcaaatcgggacaataagaagaaacagcaggagatgaagcatggggctaaggcggaagaccagcacatgagagcaaggaggagtaaagaagagggataaagcatgcgtagaagtgattgaacaatagggatatgggcaaaatgtagattaa

SEQ ID NO: 30362 - DNA, 889 bp, Heterodera glycines
ttttccttaaaatcgaacattgcagctataaaatataattcccttatgatttaagtaatataatataaaatgaactatgattagttcaaggcaattctcatgaccctttagtaaagtggacagcagataatacaaaaaattcttatcagtttccgatttgcatatggacgagaattttcatcatcggcaattaattccctcaaaatatttaccacccacccattctcctgtcgatttctgcaatgtctgaagaaggcgaaattcgtgaggattcgccggaagcaccggaggcagttccacctcaggctgatcagcaagaagttgatcagacaatttttcgtgagaagaaatcgacgcacaaaaaaacaattcttgtccacgacggttatgagtacgggttcgacaaattaagccgtgcagaccccagtaatatttttctattttctgcaatatttgcgcgcaatttcccaccgaatggcagaacctattcaggacaaaaatcaatgatttttcatttttatagtttttaaaacgtaactaagaaccttcatttttaaaattaaaaataattttttaaaatttaattttggtgtcgtattttccgggtgtcgcattttctgttttttttaaaaaaatttacggtgtcgcattttccgccggtgtcggattttcttggtgtcgcattttctgttttttaaaaaaaaatttacggtgtcgcattttccgccggtgtcggattttctggtgtcggtgcgattatgatgagcgaaaattatgttggcacttttgccatttcaatatgtatttgtctaattgtttctatatatttgacctttgcttgatcgcaaatgcgtccatttccgttgtgttttatgtgtattaagtaatt

SEQ ID NO: 30363 - DNA, 1558 bp, Heterodera glycines
tgaatgattcgacgaaacatgaagagaaagggggtatggatttgaatgatgagacaaaaacggtgttaagatgaggattttcgcaagaaaaattcgaattgaaattcaggatttcattcgtaattgtgtttccgatatagtagcctaaagcagccaaagcatttggtcccaggacgaagtcataattaaaaggtttttgagtgattaaacatgaaattgttgtttcaacgtctcccatcctaattggcacataaatcactccaataactgaaattttcccaccagtaaatgatgcgactgaaaacggtaatttggtaaggccagaatttggacagaaaccccaatctgcgagattaattcctttttccactgaagttcgatacaaaaattcagggtttactatgccagcctcagcacccgaatccattaagcctttagcctttttgtctactacactcagtgtgatatccaaacattttgacgttttaacaattgccgggttatttggtggaaatttggaagaatgttcaggatttcattcgtaattgtgtttccgatatagtagcctaaagcagccaaagcatttggtcccaggacgaagtcataattaaaaggtttttgagtgattaaacatgaaattgttgtttcaacgtctcccatcctaattggcacataaatcactccaataactgaaattttcccaccagtaaatgatgcgactgaaaacggtaatttggtaaggccagaatttggacagaaaccccaatctgcgagattaattcctttttccactgaagttcgatacaaaaattcagggtttactatgccagcctcagcacccgaatccattaagcctttagcctttttgtctactacactcagtgtgatatccaaacattttgacgttttaacaattgccgggttatttggtggaaatttggaagaatgagtggaaagagcgctaaaaaacttttcgtaatctgttggttctttttgttcaaaatgaccgacagaaatcactggtgaattgtcctcagtattttctgtaacaacaattgcgttcgaaccatacccgggacgaaaactttgtttttgggcgtttaatgggacggcatttgcattagttgcaggtattgtggaattttgagacccttggccttgaaaatttacgtcttgtctcggtttgttactctgtggcctttcgttgccaaaatttctgttttgctgattgctagggtaccggttaaaattcagattcactggaaaatttcgtcctccaaaattgtttccgtaagaatgactcggtggcccagttcttccaaaatattttggttgaggctggtaagaattttggaaatttctttgaccaaaataacgactttgttcgttttggtatgagatttggttcgcgtttggcaagtggaatggattttgtgaatttcggatttgaaccgtacgttcctcagtcatctcttcaaccaaactaagacaattagcggaccattaaaagctcctcgtatgtttgggacggttttgacttaacactccaaaaattttg

SEQ ID NO: 30364 - DNA, 1183 bp, Heterodera glycines
actaacaagggaacctcgcgagctgttagtcggaaaatgcatatgtgtgatataccactggatataggagggtcgatttctattgtgaatttttaattttacgggacgatagcgaaaaacaaaaaagttatggggcctcaaaaatcgaaaatttgcctgtgttttcacttttgtgatggtggtcaagtggtgcacgatggcgaagtggtgactgatggttcgagtccgcgtgggtttaacaattttttattatttttactaactattttaaagtgaaaataagtgggcaaaaaattaaaatgcacaaaatatttaattacaacgatgtttgacgaaaataaaatgatcaaaacagagatttttagaacaccatgcgcaccgaataaaaggaggagaagtacagttttggcaagcaatataaacatcaaaattcttaaaacaatattcgggtggagttttaaaagtcactgccgctttcagaatcaaaatccaaatattcagtgaggggatcagtggggctttcagcgagaatggtctcaagattttgcacaaagtgtgaaacctcagcattatttttgtggcggttaaaatgaaaaatgtacaaatttatttaaacaaaaggttaaatgtttacatgaatatttgcaagaaaaattacaatcgtaaacataaaaccgaattaagtattcttgatttagaaaatctatgatcagatggctaaaaaatgtttttttttgttttttgctattttctcgtgatttttttttagaatcgttcaaaaattcgtccggcgaaaattttgtccaatgcatttcaaacttcaaactttggaattttatgtatagccaggcgattcagtgctcagatggttctgtcgttgttgtggttgtgggcgatttggtcgaagtaccgtaacaccgccaatgtggctgacccggttacggttgaacagtttcatgtacagtttaaggcaatcttggcgcacagttttattcagcgtcaaataaatgaccggtggaaagcctgcgaaattctcgatgggatttatcgctttaaattttaattagaccgaaaaaagttttgttataaaaaatcataggatgcgtcttgttcttattaagggcgggattgtccatggccaaaacattggacaattgggcagtgcacaattggacattgaaca

SEQ ID NO: 30365 - DNA, 1816 bp, Heterodera glycines
  misc_feature (261)..(261): n is a, c, g, or t
caaaagtctgacgtgaagaaacccgtgcagaaaagatgggacaagcgggaggagagacgaaccaaaaatggccaaaggcgacggaagcccggctggccaagaaaagtgagttttttcaacaatttttactcaaaatcattttttaaaatttcagccgctacacagccgaatcccaatgcctaaatgccacagcaggacgaagcagggccgtcaacatctgctgcatcggccgaagaagcgatggagccaccaccaccaacntccagcaccagtgccaacgccggagatggacgaggaaatgttggaatttggcgattcgctgccgtcgaaatcagcgacgccaatcggcgatttggtgccgttcccgtcgacacccactgcaccaatggacactggagagatgacaccgccaccagtggccatcgacgagcgatcaccgcgcatcgaacagctggaaaagcaactgaaggaccgggatgacaccattcaatttctgcgcgagcaggtccgaaaccgagaagcgctgatcagtgatctgcgtcgtcagctggagcaatgtgcggcaccaccaacggcgacaccaaccacaagcaaaagtgagtgaaatttcgatgccttctcttttcccaattaattttctcaaaaattgatcattcattttttgtcaattttagcaacgccaaacagaggaagaccaaggaaggccatcgacgaactccaacgcagctcgcgaaaatggttgacggagcagattttggacgccattgatcgggaccgatcgagatcggcaagtcggtgttcactggagcgcatccaccgagaagtccggtacaaatacggccattatacaccaaaaaaggcaccagcgaagaagggcaaagatgaaatggaggccaatgacggcttgcttttgatgacccaacttggcacacaaaaaacttatcagcggatgaaagcaacccttcgtctgatccacaaaaaattcgacattttaccgccattaaaaaaggtgcatttgggttgatcagaaagtgcaatttggtgttttggttggtcaccctcaaacgacggatttgcgcgccattgcgctacgagcaaattgaaaccaatggaggtgttggctttgtgtgtgttgatgtcagatctgcgcttgagtcccgattttgtgcggccaaagacaatatgatcagctttggcaacaatatttttgtgaaaattagcggagactacggtcaaaacttcaccaaaattactgtctcatttttccaagctgtgcggtcaaattcgccatcaaacaattttattgttgctgtttttccggccaaagacagcagagaaaatttggagcgatatggagaggcactttgggggcaaattgagcaaattgatgcgttggcggggaaaacagtgaaatggtagagacggaaggctaaactattaccattttcaatttaaaggttcattggtggcgacatcagctttatttggtcattgattggtcactgcggttcagccgttacaacttttccgtccccaatttgcacgtgccggactgatcagatgcttcaggagcaaagctgccaactcaggtctattgatcagacaattgagcttgcggaacaatggaggacgaagttgcaaaatggcgataaggcgactgctgctgttcgatcggcatcaatgggcatcacaaagccgcctctgcttcgttcaattaactttgatcggatcatccctgccccttttcacgtctttcaaggcattgggaatgccattgttcgagaacttgagaggcaggagggatgtgcaccgattg

SEQ ID NO: 30366 - DNA, 1036 bp, Heterodera glycines
caaaaaaacaaaatttttaattcaaaataaaattatccgtctatatttatttggcaaaattgcagcaataaattttcacaaaaaaatattcaattttcaaaatataaaaaaaaacattcacgtgaaaaagcatcgctttttccgcttatcaatccattaaataattaattgtttcctttgaaattacattttcggtgcatattacaaaaatttattggcattccgttatcaattaaatttactaattaactaattgcatcatttggtttagtaattactaataatcgctgctcatcatcgtcaactgaccacaatcatttctttattacttagttctttcatcaatttatcagctgctgcagaaatgaacacaaagaaaaaataacaaaaagtttgatgactattaacaaaacatatgaccatgggtacaaatattctaaatttaaattttcaattatttatttatttttttaatttcatatcacttacaatacacaaaaatcgagtttttttccaagggtatatgtatatagtaggggaggggtgtagaccggaggctccaacaaattgaggaaccagaattttttaaaattttttgtttattcatttttagagccaaagatttaacaaaatttactttcgctagattttgtgccaaattgattattgaatttatcatttcaaattaaaaaatgaaacactttcaaaatttccaaactcaaataattttcatagagcaattaattaattagaagatatttgcaattaattttgatgatgatcaatgacgcaaaaaatgatcactgatcacaggaatcagagcgcgggagggggatatttttttgaaattgaaaaaataaatttttgatcattttttggaggacgcaaaatgcggcggaggtcagcagcaaaacaacggcagaagaaataccttgaaaaaatgaacaaaaaatggggtaaacccaactcatccagacccaactcatccatagacccaacatcgatacccaactcatccatacacaactcatccata

SEQ ID NO: 30367 - DNA, 1488 bp, Heterodera glycines
aaataaaaatacgcgcagcagaaatgtaaaaggcacagacggcgatcgaacgcaaaagaattggcgatttggaagtggacttgaaactgtcgtaaaacatgtaggagccgagcaagaaggagccagtggcaaacgtcactttgcagtcaaaacaatcttcaatcggctcttttttctgcagtttattcaaattatttgcatttgacatcatttctctagcaaatttggctgaaagtgaaaatttaacctgaaaatatttaataatttaaacataattaaaagaacgttttgaaaatgagctccctcctgactcctgtaccaggggtgggacaactctcgcctctcgtctctcgcctctcgccaactctcgccatttttggtactctcgcctctcgtctctcgcctctcgttttttgggacgagaggcgagagttgaaaatacacccctaaagattgaacttttgagcagccagaaaaattttcaaatttacgcgaaaaaaaaatcttaaatcttttctttccttccttaatgttttctctatttttggatagctccaattcaaatatggtctgctggctaaaccttctgcctttcattatttttctcttgggttcaattccccaacggtacagaatttttttaataatttctttatctttaaattattttcaattgaaattttaattaataaaaaatatttcaatttaaaaattattattttttcttttttttaaacagcctaaaactgcaaatttaaccaaaactttgatcattttttgacaagttctgttaatatattacactcaaaattttagaatttttccggcgcgcctatcggcggtgccgattcggtaccgccggaccccgcacccaatgttccaaaaaatttttttttggaaaaacagcgccacaaaaaaagcgacttaaaaacaaaaaatttaaaaaacaagttttggtcattttttgaataaaatctgttaacaaatccgaagacaattttcaaaattttttcggcggcgcctaccggcaccgcccgaccccaactgtccccgaagttttaaaaaacgcaccgcaaaaaaaaggtggaaaaatggacaaataataaagtttgtttctaaaataaatatatttcatgaaaatattttttaattttcatgaaaaaattttaaagatttttgtttggattttcatgacttggactcggtttaaaaactaggactctgacccggctttctgtacccggcaataccctgacccggtatttgcccaaatacccaggcccgtacccctaatttaatatacgattttgaagttttttaaattaaaaataaggctacagaaaaaattgaaaaactctcgcctctcgtcctctcgcctctcgccaactctcgtgtttttggggactctcgcctctcgccaaactctcgctctcgtctttttggggactctcgcctctcgccaaactctcgctctcgtctttttgggga

SEQ ID NO: 30368 - DNA, 1693 bp, Heterodera glycines
cagttttcgtacgaacgttattgctttttttttaatctattccatttgtttcttcctgtttttctttttgactacttcattttaatgcaacggaaaatcattttttgattggtctatcggtagggctggcaatttcggcacatgcctccaaatcgtaaaattttacggatttttctaaatatagtagcagtaaactgccagcctttctctattcagcgctttgcattttctcttgcataaattattcaattcgagcattttaaattacaatatggttttttccaaaccaccatctttttgtggatatactttaatgcatatttggaattttttttagtgttacaacttgtaacgctaaccattaaaattcagaccatcgttatcactacagaagttacaaatccattaatccgttctttttctcctactaaataaatttaaatttttactctggctttatgtttatataattaaaaaaagtaatcattgtcagtaaaaagtttcttatatttaaattttaaaagggttcagttcactactcattttgtattctctagaactacccttaaaatacataaaaatcatgcagtttacaatacgaatccatttcacattatcagattcttcagatgcatttttgtgctagacagctgttcattccaaatgtctcggccattcccttggccaatgcctttcgttccgtccatcgaatttcattttgccttccgtcccttttcggcaaaactcccaaccgaccaacacacttcctgagtggcatgccactgtcgtctgattcgaagaatgtccggctcgttgaagagtctgcccaacccatggaatggacggcggacgaattggcactgaaagagaaagcgacagccaaaaatgcatggtttggtggcactttaagatggggccaaatgaaattaaatgactgaaaattagaatgttttacttttcaatttgttttggaagtcccatccctaattcattatcaatctttcattttgctccaggattttgggttctttccccatttccctcctttttaggaccccaatttaccgttaccgtggctttgtcggcgtttggttcattttgcgcttcaacttggtgttcctcatcttttctctggcttctcttccgctgtccatttctcagcatattcccatctccccctccattggtctcatccttttttcgtccctcgtttttgccggcatcaaaaagtgagtccattttcgttttctccaattttccatttttactcccccaccccccgtttcgtcacagatatttcacgcgaattgtcgccgtcatttccgtggacaccgcctcccggtccatctatcgcattggctacccctccgtttttgccacacggcgcagtcgcttcgcccgctttttggacgttcagccgttgtccaccaattcggacagtgtgcgaggcgttgcacgccttcgctttaccgatgggtttgtctccactcttttgggatgcttttcggctcaacattcaatagtccgctatttcgctcctgagaaatcaggcattttttccattgaataatccaatttttcaaatttagcgtgaattctattcgtttgttcctaatccgtggcacaaatgtctccatatcacgcaaaagaaaataagtcgagttttcgctagcacttgcttcggtttatccaa

SEQ ID NO: 30369 - DNA, 1511 bp, Heterodera glycines
cgcgagatttgtctggcacgatgcggacaactccaatattggtgtgcacgtcatacatcccaaacaaccaaatctcgcgcactctgtgcccccggtgatactttcgacgcgcaataagcgcctcgtcaatttggacaacatgaccagcccctcccaacctaaaccaaaaatgatctaatttaaaaaaagaacaaccgaatggggttgtcaagcaaccaacggctgcaaatccctctgtaagtttgaccaatcgatcaatgtgtgaaatgccaatctgatcatttgtttttgcgtatgcaacggcaaacctagatattggtcctacatatattatgaaaattttgtatttactaagagcccagcaatacatcaagaacatgccctttcgaagcggaaaatgcgcttcctcgaaaaatgatcccgccctgattgacactttctgccctttgtgtgttgggcaacgccattggcatccgtcaaatgtaaaggttggatttttgacttgagtcatacgccgtgcgcatctattccggccacagatgggggcaatttgccgtaagaggccaaggtttcgcatataggctattgtatgctcatttgtttgaaattgtgaacaaaaatcaaaaatgtccatggctaaaaagttaacaagctaatattaaaagtagtttaaattattctcattgtcgcctttgatctgctggtcattattattgaccgggtactatgcattcaaatgtttgcctggtttcataattttttgtttacactttcatccaccaacctactccatccttgttattcgaaatatattgacctaagtatgtaaatttagtaaatcaattcgatttcctttactcatattgtagttacagtaccaatcagtgtatcagcaacatttgcaaaaaaaaaaaaatgaaaatttgaatttttcaaaatgttcgagttcgggtcaggggttcgaaattggtcgaaatgcatgtcatattcgtgctcagcgcatcaaataacccttaaaaatgtgttttttggatttttattccttttttttgtgggaccaatgatctgcacaattgcccaacaatgtgtgtacatatttactgaaaatgcatgaggcgattatgcaggttaattcttgactacagaattgacactagcagtgattccgacataattggaaacataaatcgtggccaaataatgagctaattttccgaaagaaaactaaatttgtaattactttcttcatctccatttttgtgggttttcctcggaatagttccagaattccttgcagtgattccgacataattggaaacataaatcgtggccaaataatgagctaattttccgaaagaaaactaaatttgtaattactttcttcagctccatttttgtgggttttcctcggaatagttccagaattcccttgcagtgaattccgacataaattgaaaacataaattcgtgggccaaacaaattaatctaaattttataatccgctttcttt

SEQ ID NO: 30370 - DNA, 732 bp, Heterodera glycines
  misc_feature (22)..(22): n is a, c, g, or t
attccctaaaaatcactaaatntctgcctaaaacctaaaaattgggtacttatgcactttacagaccataaaaaaatcatataaaataatttctaaggggttagggtcgctgatcacgaacctggcatccatttcgacctaattcgaaccccgaaccgtattcgaattattttcgcaccataaaatgattttaaaatttgatttttcgaattttttttaaaattcaaaaatgaccgaatttttggcgattacgccgattttaaccacccaaaaaactcagttattaaatttcaacaattcttatgtatataaaacaaattatttacgcatttatatgacgagacgagttacatttacaatatgggtatgtataacaaacacaatagaaatagcgctacaaaacaacaacaacacacatacatacaatacaatacatattatatacatgattatttgtcctaataaatatatcacggaatacaatcaaatacatagatggatcaccacaacacaacagcacattgttcaattctattgcttctgcgcctgctgctgcttctttctttgggccagtcgagcgtttactttcgctaggtccgtcattgtgttgttgggcaatgagtccggcacgaaccatccttcgtctggcttggatgctgattgtgaagcactggaactgttggcgttgtgcccatccatcgttgagacatgtttcccaagacttttcagaac

SEQ ID NO: 30371 - DNA, 1054 bp, Heterodera glycines
agaggaaaataattattctatttagggataaaagcatgtgaatgcacttataagtgcatatgattagtctgaatatgcctaagcgcatttggttattatgaatacgcttaggtgaagtgcatatgattagtctgaatacgcctaagtgaagtacatatgtttatgatgaatacgcttaggtgaagtgcatatgcttgtgaagtgcatatgattattctgaatacgcttatgtgaagtgcatatgtttatgctgaatacgcttaaataaagtgctatgcttgtgaagtgcatatgattagtctgaatacacttaagtgcatatgaatgattagtgtcttattgacagtggtaccaatgcactgttttccttagacttctaatgaatttcagctggttattggaaaaattaaattaagcgctgaatttttagatttttctgtatatgagaggcttattttcctgctggaggcgccgcctattttttaaacattttaaaagctttttaaggtaaaaaagttttttaaagtctgattagttttaaagtttttgattggcattttctgaaatttttagaggcaattttccacgtatcgcccagtgctggggcgcgaccgcgatgcgcgatccgggattcgcggcatttttttttgcgcgatccgcgaccgcgggattttttatttatatgtgaatacagcatgtgaatgaagttaatgtgctttttttaattcggaaaaattaaaaaagtgctgaatttcacattttcttatcttttttttctttttgtaaaataccaacttttacagcaaatccagggtgaccaagttttttttttttaaataaggacaaacgaggctaaaactaagatttggaccccaaaaataagatttttttctaaaactaatagtagcgcgagggaaacgcaataaaaccatgaaaaatcgacttaaaacaatattttattagcgcaaaaacaattgaaattgattatcaaaagtatttttcccatccgccgatttcctccaacaatttgtgattggaaatgagcatttggtac

SEQ ID NO: 30372 - DNA, 1518 bp, Heterodera glycines
ctattttattgaagaatttgcatttatagaatttcacttttgtatttggagaaagcgatcggctgggataagaaagtacatttcccactacgtatttaataatattttttaaacgatgtttttcaaaataatgtttaacttaaatatggaattttgaaactaccgggctcgagcttacagaaattgaccggcccggaccccccggctcaaaaaaccagcccgggtctgatccctaatttttacctaacaaccgaccggtccggtttctgacacccatttcgactcaatcgaaccctaacccggcctcaaaaaataaaatcgaattctgccaaaatgcacgaaatacggttattggctctgtgtagattaagaattttttaaatttatttatagatggtttcattagaagcgcttcataattttacgctgttgcactaaatttgaatcgatcaaacaaattttctaaagtaacgtattgggcaagtaaatatggaagacggtcaatcacagcaaaattttgtcagcagtattacgtactttttaactgcataaaagccagggactttgtgttatcaatgaattgacgttttgccgctaatgacaatcctttatttaatggaaagaatttttgtacaaaggaaaatttaaataaaaaaaatagatagattacgagcaaagttgatcagtgatcacaaattttatccacatcaaaatgcctttattcaaaggtccaaattcaattaaaattcagttctccttcacccctccgaaaacatatccaaagtcgcttcttttgcgcccggaattttgtttttcgcttgcaagtcgtccaacaaagcgttgatgctgttctgaaaaaaccgtgacgtcttttgggaatttgcaacttggggacccgactttttgggcaattgaggattcggcatttggagacagtcagtcggtgcccaaatatccggtccctatgtcgggcgggatccccaaaagtcgggtagccgaaaaacgcagggaattcaacaaacaacgaaaggtcggcttattatgtgccaatttgtccgcttttcccacctggtccaactgataggcttccatgttgccaagtgaaatcagtgagtcggccaacgaggttagttccgcgatttgcttggtcttctcatcctcctgcacattcgcacccgactttttggccgcccaacggcgtttgcgctcctccgctgcgtttgactcttaaaaatagattttaagtctagaaaaatgcttgtgttaaattcaacagtattatccaatgctgtgaaattgtcctaaaaatccccaaccctccgatcactcacttttttcgttgttcagtctcttcagcgcagcgccaattgtctctttttcgtttagcaattcgataagtcgtcgatacacttccttcggctccacttccttctcatcgtccgcctttttgtcatcctcgtcatccaactgaatgacaaaattggtactttcctgttttgaaggcacatccatcttttt

SEQ ID NO: 30373 - DNA, 1201 bp, Heterodera glycines
cgacaacgaaattgggtgggttaattaataggacgcgggcgtgtggaaagatctgctggtcgtacttaatcttttaatttgttttcagggaattgtcttctgccgttgcatccgaactgagtaccaaatcgttgtgaggaggcaattcaagcagagaaaggcacgcgaagaagagaattgatcgatcatttcataaattgttttcccaataaaataagagaatctgtgccacttaattatgccttcgtattgtacgctattattgccatgtcgtgtcactattgtacatttcaaatgtttgttctgtgtgttttgcaaaatgcatatatttatgaaaataaattttgaaaaaactcatacgctccgtaactgtttttaagcggcagaatcttgttgaagttcttacgggttttttgaaaaacataccttatttgttcgtcctttttcgaaaatccacaataaaagagacatgtttggattgatttgaaatcataattacttaaatgaatgtttggctaaaaattagcgttagcgagcttattgaatcgaagccgacattttagtcaaccgaaccaaaactgaaagcaaaagccaatttcaaagcttaactcaaaaatcgaagctctaacttactttttcagctattttcctgatcaatcaaataggattcgattagaattgaatttttttctgtgcttttttagtttgcgcttccgtggatctgatcactttttgatccaataaaataaaagatggaatatttcgctgtttctgccccattttccctgatcagtttgcgctgtgccttttctcactgatttgggttgtccagtgccgtcattgcgtcctgcgcgaacacataaaggccaagcgcagcgcaaatggcgacggtcgtggccaaaaagcggcgctggtttcgcattttgtaccaaattgggaagcgaatggcggtgaagcgttccaaagcgatgaaaaaagtgaggggaaaagcggcgaaagagcagaaatgggcgccatttggagcagaaagcaaaggccgtagggaatgaacggacggccgaaaagagcaagcacagaaaaaggggacgaaaaagttggactgttggacgcaggagcaaacggcgtagagggcgagcagtacgttgcagttggagtgcagggacctgatcagcggaacggacagtgaaagattgatcagacc

SEQ ID NO: 30374 - DNA, 1217 bp, Heterodera glycines
ttttataaaaaagtcaagaaaacaaataatagtaattcgtcataaaatttcgaaaaacgataaaaattcttcaatttttttcttgaaatttcttataaataaattttcttagatttcacgaaaaaactacttttgtaaatttggaatgttttttaatccccgcgcgagattttgatgtaaagccgccggacaaatcctgttgctttaaaattaaaaaaagtagtccacacgaggatggtatcccctcccgaaatcccgggactgtcccttcccttcccccccccctccctttttttattcccattttccgtcattcacttccctttcgttttgccagatgaaacggctctgtccaaaggatgtcaaagtgcgcattttggcgccccaggagcggatattctccacttggattggcggttccattttggcgtctttggacacattccgcaaaatttgggtgacaaaacaacagtacgaaaacaacggaaagataatcatggcacggaaaactttttgatggatgcttcggtggaaggacagccaaattcgaataaaatgatcaaatcagcaaattccttttgtattcgtaaataaattaaatatgtattcgccctttttgacataaaaatgcttcgctttgatttcattggacttttgccattgttttgtttggtcctctcaaaaatatgcaatttcctaatttgtccatttgtaaatttgaaatttgagcttttctttgtccaaaatcattttatccgacaaaaattgcataatggataattggacgtgcgcatttgttttgtttgcctttgccatttatgtgttcaccagcagcggattttgtcattgcaatgaatgaatgatggaatgaccttgggccgaggggggggggagaaaaccgaaacgaaaatacaaaagaattgaaatgaattatgaagttatacggaagaggggaggaggacagacaaaataattgggcaatttgatttggattatgacacaaattaaaacccaaagcgaacgatggattgtcttttggcttttgctctgtgccgttttggcttccgtcctccgctcccttcccttcccttcccttggctttctcatctccgtgcttctcctcccgtggtgcccctttctttggcatttgtcccttcgccctttccttccgccgtttcttccgtcgggattgcgttgtttctcgtcgtgaaattcgg

SEQ ID NO: 30375 - DNA, 913 bp, Heterodera glycines
agtatttcttgtaaatgaaatataaaaaaacaattcatgcattatgttttcagcgcataaaataggtctaaaaatatttttttattttttaaaaatttcgggtgtaccataacgaaaaaataccactatcactttaaataagatgaaccttaatgtacttctcccagttgcgctttgtcggcccatccagattcgtccgtgtggtggtttcaaagctaaggcccttgtagttgtacaccgtcgcttcgaagttgccaattttgtcctgaagaatcaatatgttaaacgataataaattaaatttaataaattaaatacattaatttaacatattcgtattaaaatttatatttttaaacctacaaaaaaaaggtatttttcgctagttcgggatggaagggtgcggggggagatgtttgtgccgcctcggggacaatgccgcgggagagaggtccggtgccgtgtcggaagggttggtgccgtttcggggggaatgccgtgccgtttcggggggaatgctgcgtcggaagggtcgatgccgcgccaatttgtcggtgcggtccggtttccgggcgccgattgaccaaaaggtcagtctgttttgatggaaaaaaaagaaacatgctcaaaaccccgttatgaggacatttttgaaatttccaaaagctgtggggttcggtcgtcgggtgagtgggaagatgttggtgttttttcctgctcaaattttaacggggcggcggtgggggaatattctgacaaaggcatttcgtttcccacgcttggtatttatttattatcctattattaattccttaaatatttcgccaaagaaagatcattcaaattttaccgtaattggcgctcattaggaataaaaaagaattcaaaaaaccatatttttgttttttctttt

SEQ ID NO: 30376 - DNA, 1313 bp, Heterodera glycines
caaaattcttccaatgagaaaatgacaaagtgccccgtatttgcatattttccatcgttttttggtaaaattcagcgttggactttttcacttggacagagaaaaggcgcggaccaaacaaaaaaaaaaacgtggtcaagtgtcccttgtccagacatttgcgcctatgtccaaaagcggagtttttgaaattttaggccaaaaattgcaaaattgacattttttggcgtaaaagcgccacaaatccctgtttttttggcgcttaaatttttgaataacacaggagaaaaaatttttttggcccgaagagcaaaaaaaaaaatgccccctccgaaatttttttctgggctacaggcttgtgtggtaccacattttagggccaaaatggccaaaaaccctgtcattttaccattgcccatctcggccattttgtccgcacttggctttggcgatgccaactgattgttgtgaggggcactgctgccggacggcggcccatcgctggtggaaaaacgggcataggcggcgaatccagtcgctttattggaactgggaatgtcaaatcgtgaaaaattttgtaaaatttaaagtaatgctaatttaaatgccagggaatttcgggcgctactttaaagaaggcactttttgaaaaaattttcactttttttttgcctctttttttttgtttatttacatgaaatgatgaatattaagcattaacaacacaattatggtgaataaaagtatattcacgattttttatttcaaaaaattttgcgaaaaaaagggtcccccctttggtttttttgataaaattcaaaatctttcactttttttttgtcattcgtaccatctgttaaaaaaacaaattccgcgtccaaataaacaaaaaaaaaattagacaaaaaaaagtgaaaaatttttcaaaaagtaccttctttaaagtagcgccgaatttcgcattaaaaggcattgggaatatttgtggcaatttttaaatgcatcataactttttatagaagcatccaaattaaatattcttagtatcattctatagcccaaagaatcttctattagcctgcaaaattccaaagaattctgttatgcttcaaaaaagttatggctaaaaacgtttagaaaaccagtgctttaaagttttatagttataacttttcaaaaacctaatgaaattctctgaatttttgcaggctaatagaggcctcttggggctctcgaatgataccaagaatgtttaatttgcatgtttcttgaaaaagctatggagaattaaagttgtcaaaatattttatggt

SEQ ID NO: 30377 - DNA, 1344 bp, Heterodera glycines
gttcggggggactgccccgaaaacaaaaaaatcgattcttttcagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctcgccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggtttttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtacgcttctgctcaattagcaaaaaatatgagtgatcaaactttcactaaaaaagttaagcctaaattttttggcatatttaaaaagcaattaaaaaatttttaaaatttaataattttcctgcaccgaaggtactcactcggcctcttcgcggcctcgtggtgggccttcgcccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaact

SEQ ID NO: 30378 - DNA, 236 bp, Heterodera glycines
aaaaaaaaaaaaaaaaaaaaaaaaaaaaaaaaaaaccaacccccccccccccccccttcttttttttttttttttttttttcttttttttttttgtattaaaaaaaaaaaaaaaaaaaaaaaaaaaaaaaaacccccccccccccgtgggggggggggggggggggggaaagaaaaaaaaaaaaaaaaatttttcccccccccccccccaaaaaaaaaaaaaagcaaaaaaaaaaa

SEQ ID NO: 30379 - DNA, 1511 bp, Heterodera glycines
  misc_feature (22)..(22): n is a, c, g, or t
  misc_feature (33)..(34): n is a, c, g, or t
  misc_feature (44)..(44): n is a, c, g, or t
  misc_feature (54)..(54): n is a, c, g, or t
  misc_feature (91)..(91): n is a, c, g, or t
aaaaggaattaaaaatttttanaaatattatcnnatctcccttntgatagaaanagcatcagagagccttattaaacttttaattaacatntggtgcgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaaataaaatcggttcggggggaatgccccgaaaacaaaaaatcgattttttcaagtgtccgtttggggtactcaaacaattatggggagcaaaaatccaacgcagaattaaagtacaggctatagggaagctattcccgagggattcggtctccccataaatctgggcgcatcggttcggggggaatgccccgaaaacaaaaaatcgattttttcaagtgtcctttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattatgcaaaaaacaaataaataatgaactctcttccttaataattttcctgcaccgaaggtactcactcggccgcttcgcgg

SEQ ID NO: 30380 - DNA, 1056 bp, Heterodera glycines
ccccgatgctaatccgttccgcagagcctcttcaaattttttccattaccgcaagagctgcggaaattgtgaattaattctcagaaaaatggctatctctttttaggacaatattctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgtttccgcaagcctcttcaaaatttt

SEQ ID NO: 30381 - DNA, 1472 bp, Heterodera glycines
aaagaaaatttttttggcaccatcccaaaattcggtgccaatttttctgctgaaagctgttttttggctcacccaatccgtgccggtgtgccggatgtgcccaggtccaggatttcagccaatgattcacgacgcatgtccacactgctgcgatgctgaaaaattcgtcttcaactctctattcttttgtcgagactcatgaatgtttttgtgtgatgctcgagagtcttgactcatgaaaattatcatgaatatagattgggttattaggcacaaaaatatagaaaatagacaggaataattggtccataaattgaaaatttaaaaaaaaaagtgagatttttaaaaaaccttcgaacacaggcccaaaaccgtatctgtgcctatccctaccggtatatgcaaaaaatgcaatttaagtgttaaaaataattaaaaaatacacttatatcaaaatttaacaaattaaaatttttaaattaaagaaaaaaaaatatttttaaattaaactactaaaaatgataaaataatttaattaattatacagtttttaaattaactaaattaaaattattaaaaaaagattaaatcatattaaaataaataatttaaatatacatctcataaattaacaaattcaaaatatttaaaaattaaaatatacattttaaaattaaactaattaaattcaattaacatggtcgaagcccaccacccgttctcgctaaattttcgtttgaccacctccccccactcccgcctcaaatttattcccacctcaaccgtcgccatgtcaagcagctgctcctcgtcgctgtcggcaaccgactggttttccaactcgttcggtgcctccacctgttcatgattttttttatacattaaaaattttggggatcaatttttagagaaaattttcaattctcagggatgcattttatgaattcgaagtaatttattagcggtgtattttcattttagtgtgtttttattaaggattttaaactcctaaaataggcacaaaaaaaaatcgccataaaaaccataaacaaaaaataggcattataaaagtcatcgtagacagcacaaagcaggcggaataccctttattttttgcagccactcacctctccagtgaagtcaattgtcggcgcagtgttatggcattccctgttaaaaataacgaaattaattcttcaaaaaataattttaaaatattataattcttataattaaatataattttttctgttaacttacatgtgtttggccgttgaattttttttatctgcggcgtaatcacagtaaaggctaaattgtcatattaacaaatgaaaaatatacatttttttactattcaaattttttgtttgaaatgtgtatagttaggtggtttgagtatttgatgaaatgttaaaaattggtaggagatttgttatagaagtatttttttaggtataattaaattaggt

SEQ ID NO: 30382 - DNA, 969 bp, Heterodera glycines
tctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctcgttttaggacaattttctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctcgttttaggacaattttctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaaatctgtccgcagagcctctt

SEQ ID NO: 30383 - DNA, 927 bp, Heterodera glycines
aatttgatcgtttttaaggatcagaagccccattttcactcaatttttcgaattttgaaccggttcaaaaacaatttttttgccatttccgcacctcaggagtatttttcctgagcattacaggccacgagagaagtaaaattgtacggtaggtgttattgacgggagaatttacaaaaaacagaatcaatgaagcattttatggttaagaactaaaaaacaacaatcaaataatactattttcaccttctgctgctggttataatcagcgtttgtctcaaatgttctctcaatttgtgcaccattgtccatttctgtgaaaactgatttataaaaagtttaaaaaataataaatatcgacgaaaaactttcttaaatttagataaattaatataaaaatttcatattcaaccaaaatttagcccatcataaaatttaaattttaaaaaatggtaaaatgaaaaacaaaaaatacagaaaaatatttcactccccaaatttgtaagtgaaaatagatttttatgaccaatgaaaatatatactagtgttctcaattgggaatatatattatacaaattgaaaatacacttaaattagcaagtcaattagcatgatttagggtaattagtcatgactattaccttttcgattgggttccagcttctccaattgtgcgattcgtcccaaaagtgccttctgatcattttgcaactgttcaatttggacaaccaatgcttaaacatacaaaattagtttttattttcttattttttcttcattttcttacgctttgtgttcttttcgtcctgcttttgctgctccaatttgtctattttttccagaattgctccaaattggtcaattgaaactgtaattaatttgttaggatttttcgattaaataattgatgaatcaattacatttttt

SEQ ID NO: 30384 - DNA, 958 bp, Heterodera glycines
cgcatgattccactgttccaagcaccacaccaaaagctaaacgatataaccaaaatataaggaaaaattttttaaaaaatattttctccatcttcttttatgatactaaagcatcagagtgctaaaattaagttgtaaataaaatctggtgcgctttagagcactttctgacaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcgagaattaaagtacaggctatagggaagctattcccgaaagga

SEQ ID NO: 30385 - DNA, 1567 bp, Heterodera glycines
gcaatcgccaaagagtcaacgaaagagtcgctttgcccagtcattcattcattcgcttgttgtgaatttgcgcaaataacaattaaaaaataaatgcaataatataatgcccttccaatattgtcatcatacgcaaattattcgatgtccatcgcggacatttttggggtatggaagagagaaatgggaagaatgagtccatgaattaaaaaggtggagaatgaatttgatggacggacgacgggagaaagcgtgaggaaagagtgggatggacgggcgaatggagaacaaattggaatcggaaaagcatttctgaagataatggcactatttgattgttttgaagaagtggttgtgaacaatgaaatacagtgaattagcgggtgggcaaaaaagacgcgcaacgaaagggaagagagagagagagagagagagggtggaagagagagagagaagacgccactgggcaagtttatctgtcgcgtttccaccgttaaaaatgatcaaattaaccaccgggagaaaagagcgagtgggcgagggacaaccaaaaggaccaaacagagaagggacgggcaatcaatcacaaccgaaatggaatgagcattcagaaaaatgttaatgaatcattcgggaagacgacgtgacaaatggtggaaaaggcaattggacgaattgggggagacagcgcaaataaatggaggagaatttggccggaacagacaaagaaagacgcaatcgaagaacgaggaaagcataaaaagaacccattggaggagtaaccgcatgaaagcccccccccccaaatgaacttgccctgagttcgattgcttcctcctgctccttcgtcttcttcgtcatgtattccttctcgagccgtttcattcttttcacgttcaaatgcacttttgacgcgatggcaaagagcagttcgtggtcattttcgtacctttcccggacttccctttggaaatacttaaaacggaaaaaagaatattggcaattcgaaaggaatggcgtagtcgtacacctttagcatcccttccatgtccaactgaagcaagtcgatccgcgattgttggagaatggaaatggcaatgcgaaaaacagcgtcaattccgtcgaccaaaaaccaatccatgatgcgattggcgagctccaacgagacggtggtgaggaaaacagtgagaaaccatgaggaggcgtacatggaggtgtcaaagcccatgttgttgctgaaccaatttatcagactaattgacaccggcagaacaacgtacaaatgcatgtgcaaatctggcatttgctcctgcacgatcacttccagttgaaacatgcacaagcccaactcggtcattgtcggcttgtatagctcccgaagccgatacgtctccatcagacgcatgaacacggcgaatgcctcctcctcaggcatttggagaagcaattggccgacgatgaaggcagagccttggcaatatccaacctgaaaaacaacaatataaaacggcgatccctttgaatttgccctgcctctctgtcatgcaaagagtacgccttgatcacg

SEQ ID NO: 30386 - DNA, 1720 bp, Heterodera glycines
tttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactaaaaaaatatgagtgatcaaactttcactaaaaagttaagcctaaactttttcccaaagttaaaaagcaattaaaattttattcacctccattattgatagaaaaagcatcagagtgcctaaactaacatgtaaataaaatttggtgcgtttcagaaccctttctgaaaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgcccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaaaaagtatggggagcaaaaatccaacgcagaattaaagta

SEQ ID NO: 30387 - DNA, 1278 bp, Heterodera glycines
aacataccagacaaaagggacagccatgtggcagctttgtagaacacgtactttctaaagtatgaaggatcaaagatcacccgatcagaaatttcgtaaaaaattgatctgatcagcattttgtgcttttgtaccgatgcaaatcgttgctacgaagcccagcagtgtttacgaatatggcaaatagtgtggcggctgctgccacaatgatcagcactgcggcagttcggacaaatactgtacaaattggagatgggggaaatttgaatttggcacatcacaaagccaaacgtgtgttccgtgccggcggctgacattggccctcgggcgccgcgtttggcaccgggttggacagtgcaccgacagaccgatcagtgcattcttggaacaagcctgttgtgattggaaattataattttgtagaataacctgttttaatttttttgtaaaaaaaatttctagggatgggattttgcagcagtcactgtctcagattttaaagtcattcccaaaaaattaaataattttttgttttgctaaaaacctccccaaatgtgggataatatggaaaaaaaataaagaatcatattagggatggttttttaagttttttaactacaaagtattacgtttttcttacattaagagaaattacagcttttggaaattgactaaacataataagtcaaaaacaaataaatttttggatttaaacccataaattggttctaatttgtaagtgatgcaattaataaaaaaaaatccgccaattaacggtgccggaaaatctttgataaaaaacatagataatgatagcaaaaattggcaaattcatatgaatatgattatcatcataatattcccctttgacaaatgagtagggtaaatttatcgctttgtcatatacataattaatcagttaattacccgtgtgaaatgagtatgtcttcagccaatatgttgtgctcagagcaatgacaagcagaaaaagggacaaacagaggcaaaccagtgaaatcacctttaaaatggaggaaaaagcatatatttggaggaatgggtaagtaatgaattaattagtcaattcattataatatttaattcttagggtgttaattgtataaaaaaaattttttaatggacaataaaatccaaaaatgagtcaatattctgaaaattaaaaacatttaaatgaaagaaattatttgtaaataaaactataaaaaaataaataaaatcagataaaagcaactcctatttttgagacataattaaaag

SEQ ID NO: 30388 - DNA, 964 bp, Heterodera glycines
ccttttgaatgtgtaaagtttccagcaagaggtgtcagaaaagttaccacagggataactggcttgtggcggccaagcgtccatagcgacgtcgctttttgatccttcgatgtcggctcttcctatcattgcgaagcagaattcgccaagcgttggattgttcacccaccaatagggaacgtgagctgggtttagaccgtcgtgagacaggttagttttaccctactaaagacctgttgctatgatagtaatcctgcttagtacgagaggaaccgcaggttcagacatttggttcatgtgcttggtcgatagaccaatggtgcgaagctaccatctgagggattatgactgaacgcctctaagtcagaatcccgcctaggcaagatagcaatattcttgctccccggtgtcgggaggtactacttatgcgccgcttgcggtgcagcacaaatgccccagcatctggcccgatgtgcgtgcttaattgctcgcacattgccaaagccgtagcactcgtgtgccatggtggaacgtcggggcgcaaaatcacttgtatacgacttgactactggtcagggggttgttagcagtagagcagcttttacactgcgatctgttgagacttagcccttgatcggatgatttgtcttctttttccccctttactttttgtgccaacaacattttaggtacaagtacatgagaagggaaggctctcttaagggagtcaaatgcctcgtcagtcaccatgaaattaggtaggataagttcttgactttgctttttttccatttattccaatcgactagtgctttaaggttttgtctttgactttgctttttttccatttattccaatcgactagtgctttaaggttttgtctttgaatttgcttttttgtccatttatttcaatcggctagtgttttaaggtttgtctttgaatttgcttttttgtccattta

SEQ ID NO: 30389 - DNA, 848 bp, Heterodera glycines
aaagaatttttgtgcgctttgtctgtccgactgtccgaacaatgagcgggctttgatcaaaagaatttgatcaaattgattttggcatttcataaaatgtttttttgttacgaaaatttctcattctcgatcagagttgttttattttttctgaataattttttttttttttgaatattaggcattttcaattatttcggtaaacaccttggcattttttaaatgttaaactctgctgattggtttcggctttgatcaaactgatttcttttggcattatcataaaatgtgttgttttttataatttttcttatttttcaatgagagtttgtattatttttcctcttttgggttaaaattatttatttaaaaatggagttattattagggcggggaaaaatatttggacataaaatcgcaaaatatggccataaaatatggcccaaaaacagcaaaatatggacataaatggcaaatattgaaataaatttttcaaaattgactatactttcccaaaatttctttaaatttgttgaatataaagtaaaaccttcaaaaatggctaaatacggtattaaaaatcattttagaagaacaaaaagacgataaagctaaaatttgaatttttagcgaaaaatcaaatcgaaaagcgaaattttagcttttttgcttatttttgagataaatttcttaattgttaagaaaataaatttattcaatattttcgagaaaattttgcgaaaaagtgatttttttgaaaaattttccggttttggggtcaaaaaggtcaagttagctgatgggggccgttctaatagaggttttttggaaaaatcccaaaatatgga

SEQ ID NO: 30390 - DNA, 936 bp, Heterodera glycines
  misc_feature (8)..(8): n is a, c, g, or t
  misc_feature (38)..(38): n is a, c, g, or t
  misc_feature (45)..(45): n is a, c, g, or t
  misc_feature (57)..(57): n is a, c, g, or t
  misc_feature (63)..(63): n is a, c, g, or t
  misc_feature (84)..(84): n is a, c, g, or t
aaatttcnaaaatttttcgagctagcccccctagaatntttcganaatttttttagnctgaanaagggtggtgaaaaatttttntctgggggtatttgagggtgctgagcacgaatttgacctttgtttttcgtttcatgatttttggaatttttaaaaattctttattttttggcaattttttggccctcgggattttggcctaatatttgaaaattcataacaaatcgaagggtggatcaattttcgtgcaattatattataaaaatagagaaaaataaggagaattttatgggatttatttgagttttttatcacaaaaaacaaaaaagttattccagaatttctggaaattttcgatttttcagaaaaaaattcgtagctgccttctgaaaagctattcgggaaaagtaaaatactacaaaaatccgcaatttttttctctataatataaattttattttacatttttatcacatttttaaaaaaagatacaaaaataaaagtgattttggggttcgggaccaaagggggtggacaggatttttgattgaaaaaattttttcacaaaaatcttccaaaaacatgtcattaggaccattttatgacgctgatcacgaatacgtgatcagattttacttttaacatcgataagacctcagaatccctgtatgattggggattctgaggcatcattttgagcggggagggggcaggttcggatccggacggtgtacattaattttctaccatttattttctgtttttcaattttttttcatttaaaatatttttaattttattaataataaataaaaatttttcatttgaattaaattattttttggtgaaaattttattaaaaataatttttaaattttgaataaaaaattaaagaatatcatgtttcaatttacattgaatttggaaaaaaaa

SEQ ID NO: 30391 - DNA, 853 bp, Heterodera glycines
ttgagtcccagtgattgaaatgcaagagaattgagtcccagtgattgaaatgctggagggttgagtcccagtgattgaaatgcaggagaattgagtcccagtgattggaatgccgaaggaccaggtgaggttaggtcccagtgattggaatgcaagagaattgagtaccagtgattgaaatgctggagggttgagtcccagtgattggaatgcaagagaattgagtcccagtgattgaaatgctggagggttgagtcccggtgattgaaatgctggagaattgagtcccggtgattgaaatgctggtgagttgagtccgacgattggagaaaaagcaaaaaaaggatgcgaggccgcgaagcggccgagccagtcgattttatcaaacataatcttacactacaatcgtactacctagcgggggatgcgccgaaggcgctgaccccgctagtgaatccaaaagtaaagccccgcataaaatgtgggaaaatgtttgctttgctgaccaataaataacattaatccagggctgccagccgtccttgaatggcaaggacgtccttgaaattggaccctctttcttgaaaataaaaaatgtccttggatgccaaggacgtccttggaaataagcatttggaaaagttataaaaaattcaaagaaatttgataaatttttgtaattttcaacaatatttaattacttatggcattatgtcaatgaaaatgtaatttttttctcatggttgagaatttttgaaattttatgacataaagtcacaattttaaattttggtcattttttgacaaatatctgtaaacaaatcgcattaaaaattacaaatttttccccggc

SEQ ID NO: 30392 - DNA, 1255 bp, Heterodera glycines
taaaaattcgatcaaattcaatcacaatcaaatcaatatatttttaatttaaatcaatgctgtggttttactttaatcaactcgcattggacttcatatcgtcggatgatcaatgcatcagcagcattattttccaggcaaatttgtgccttaatgaacacaattacagtatacccccacccatctgccatatcgtaggcattttttttgtctcaatttatacccaaactgggattgtggaattagatcccggatatttttaattgatgggaattctgaaaattttctagagccctgaaacagaaacaatatctgcgcaggatttttgcaggaaccctggatactgtaactgtatttttgggggaaaactgcaggaacacggctcttttttccgctgttttttccttttcatcaccatttcaaattctgtttcagttccggcatttttcaaaattccgggctctaaaattttctatgctctccagcagtttcggcgctgatgctgtgtccacgctcacttggtgcaagttttccgcatttgcggccgcaatgaatggcaatgccctgctgcgtgcaaattcgtccaaaaatccgaatttgctaggtggactaatgggacagttgtacgggtgccggatgcgctcctgtgagtttaacacacattatggtaattagtacggcatttttgggtgatgattcatgacggtctatttttccataattttgatattgctattttaaatcaaaaatcgacaccgtttgaagaagttttgacgattatcaaaaaaattttgcaaaaacggtccccctttatttttcgtgggttaccaactgtaagagtgccaaaaaatattcaaatattcgttttttttaaatcactcttatccacctgctgggtacatttgctgccagaagctgtcagtgaccagccactctcacagactcggcccaacacacaccatatgaatagaaaacagtgaaatttgcgattgcgtattgtaattttggtgaatgagctccgaagggttcccgaagagggattattggaaaatgtgccactaatagtacagtattttgaatttgtcaatttatttttgaaaatcctagtgcgttttccaatgacgcattccccccccccccctcacaaaaaaattgtaaattttatgaaatcgtaaatcaacattttaaattgtattgtattatgcatactggcaggaaacaatgaaatcacttgctgatgtgcatgtctgacaat

SEQ ID NO: 30393 - DNA, 956 bp, Heterodera glycines
gcccatcgtgaagtcaatgtccaagggcgctggggcccactcatgaagtcaaaggccaagggcgctggggcccatcatgaagtcaaaggccaagggcgctggggcccatcatgaagtcaaaggccaagtgcgctggggcccatcatgaagtcaaaggccaagggagctggggcccatcgtgaagtcaatggccaagggcgctggggcccatcatgaagtcaaaggccaagggcgctggggcccatcgtgaagtcaatggccaagggcgctggggcccatcatgaagtcaaaggccaagggcgctggggcccattgtgaagtcaaaggccatgggcgctggggcccatcgtgaagtcaaaggccatgggcgctggggcccatcgtgaagtcaatggccaagggcgctggggcccatcatgaagtcaaaggccatgggcgctggggcccatcgtgaagtcaaaggccatgggcgctggggcccatcgtgaagtcaatggccaagggcgctggggcccatcatgaagtcaaaggccaagggcgctggggcccattgtgaagtcaaaggccatgggcgctggggcccatcgtgaagtcaatggccaagggcgctggggcccattgtgaagtcaaaggccatgggcgctggggcccatcgtgaagtcaatggccaagggcgctggggcccattgtgaagtcaaaggccatgggcgctggggcccatcgtgaagtcaatggccaagggcgctggggcccatcatgaagtcaaaggccaagggcgctggggcccatcatgaagtcaaaggccaaggacgctggggcccatcatgaagtcaatggccatgggcgctgggcccatcgtgaagtcaaggccaagggcgctggggccatcatgaagtcatggccatgggcgctgggccatcgtgaagtcaatggccaaggcgctggggcccatcatg

SEQ ID NO: 30394 - DNA, 1702 bp, Heterodera glycines
acattaaacacgttgaaattcgagtagtaagattcccccttctaaaacacatcaaaattttccaaaacgaaaactcaaaatcgacttaagctagaaaaagcataggcgaaagaaagcatcgtttttattgtctaattaacaattttctttcgagtcgagttcctaagcattacaatacagaaatatgcatcatctatcgaacgccgatcagtgcccgctttgctcttcgtcgttctccactttgagttcatgatgatcgtcccatttaaagtgcgccattttctttgcggccttctgaaagaaaaacaccgtcaaagttcaattcaacaattggtagcaaatatttgcctttgcggacgaatgggggggatcaacctccctatttttttttgtaaggttttgtaccaatttctttgtttcgttttttacaaatgcctaatcgaaaattttaccgggtcaacgaaagaactgcggacgatgtatccggtgagactgccccgtccaatgatctctccgacgaaaaaccaacagagcacttccacgaaaacagccgaataaacgagaaattccttaatttacgggcaattgacaaatgcaagtgaatttcctgaaaaaagttaccttcaacttaaactgtctgtaggcctgcgttctcatcactgtgtccaatttggcataatccgctttgatctttatatatgaaaaaatataaatattgaagaatgtataaacctgaggccaatcctttggagttggaggagccaattctcggacacacactttcttcagaatgtccttaagtaaaacggagtcggattagtaacataaataattcaaatcattcaaactttgtaacgtggaagtcgcggttcatgatagcgataaataactccaagaatattggcaattttctcaggaaaactcaacttccgcgttgccatttctatcttaaaatatctaatcaatcaaataaaattgagagatgagcaatggcacacgaaacgggccaattgcgtctgagccaggtttaaagcgtcataacttttttctttgttgaccaaaataaaaatatacaaaaatcctgactttttgtggttttagtgtttcaatttttataaataacaaagggaggaaataacaaaaaaatggtgaaaagtacaagtgacagaatgggtcaaagggcgaactatttacctattttctcaatgccagtcttttttagagaaaatctcgtataaattaaatttggcattttgtttctgttattttttatgttttttacggtcaaaagctctcattttttcgatacaaaattttttatcttttttatcagtgctatttcagtggtgattgccttgtgatatttcggttttgttcgaaatgtcttcgcccgttcgccaaattaaatgtgttgttgttggtgatggtaagcttgagcatttctatcagtttgaaatcaaatgttttacattgtactttaaggtactgtcggaaagacgtgtatgctcatttcgtacacaaccgactcatttccaaggtagaaaaaaactcacaatcagggatttccctacttaataaattttcatcatggttaaaatcatataaacccgggttcagtttatctcttgctttcagggaatacgttcccacagtggtcgacaattattccgccccatttaccgtcgacggtcattcagtgaac

SEQ ID NO: 30395 - DNA, 1615 bp, Heterodera glycines
agtgcaggcatgagaagctgctgtccgtcataaaagcagcaaaattgataatgattgaactaactaataatgctaaaggtaaaactggatgttgacgatgcgctgctcgaccgtccgtccgtcgagtcggccaaactgaaggagcactgtgagtggatggtcgaagagttcgagcaggacattgaccgatggttcatcaacctcagacataggaaaactttagaagtgagccaaaataaaaaaagagcattagtcaacgtatcctgaatacttgaaaaaagggggggactatccgtacactaccctataaaatttttgtttgataccgaatgtgtaggcggcaattgtgaagattattggtcccacaaaaaaaaagaattaaaatccaaaaaaaaacatttttagggttatttgatgcgctgagcacgaatttgatcttcttttgactttgtttcgaacccctgacccggattggtaatattaaggctggtccctccaccacttttcgcaacatttttttgttttaaaaattgaaacatgctcccaagggtttttggggtcactggtcacaaatcctgtatccatttcaaccaattccgaatcccggacccgaactcgaacaaaaagttgaaaattcaattttcggatttcacatttttgttcaaacctttgtttaaatacatgaaaatgaactaaaagtcaacaatccttccataaaaagaacatttaaattattttagactaaaaaatgaaattccaaaaaagtggaattttcgacttttttgttcgaatccgggtcaggggttcgaaacaaagtcaaaagaagatcaaattcgtattcagcgcatcaaataacccctaaaaatgtttttttttggattttaattcttttttttgagggaccaacttcacaattgcctgcatttcgtttccccatcgttatttccacccccccccccctcccccggttgtttcctcctccgaaaaaatattgaaaatttttcaagctaattttttgatcactatgcacttgatacctcaaaatgtttggttgttgatatatgtgttaaggatgtgaaaaagttgatctccgattatgatactaacatggtgatggacaacgccataactttggatggctttcgctaccttcatcaaatgtttatacaaaaaggccgccatgacaccgtttggactgtgttaaaacgatttggctacgatttgaatttgcaattgaggcaggattacctacttccaaagttctattttattctctcgaataccagtgatttaattttttagaagtattgccaaaggctcttccgattgaccttcagaaagccttttctacgtgtgggattccagtaaccttttttccatcgttacctcaactgctttggttggagcgctagtcgggcttttcgtcttcaaagttattcaaggctaatttggcaaaagattatttggcggttgtttcctttcccatattgccgttgaattaaacggggtaaataatggggccaatcctttagcgaattggcccaacaaataaattttttttttttgtcgttggatcctttccaaatcgcctttaattgcataattaatggttttt

SEQ ID NO: 30396 - DNA, 1121 bp, Heterodera glycines
aatttaaaaagcgaatgggaaggaaaatcggagcaaattcaaatcgaaatgggcaataaaaatgccaatgatagcacaaaactccgaataaaatgccgaaaagaatggtccctttgggttattcacccccttccctttcattctgtcacatggacacccaaaggagtccccgccccatccgtcttttaattctttccgatccgattacttccaaatcgccccccccccccgccatccttcgtcattcttccgtcggtccgtccatcccttccctccattcattgttgttcttccttctataatcggcacttccgttgtcgtcggcacttttggtgtcaaatggaaaatgaaacgaatgaatgcggagaaggcgcatttgcttctctggcacaaatcctcttgtgcataaaacaacacattttattctattcgggggaaggggaaattcgcctgatttgcattttatccaaaggagctttataaacgggagagacatcgcaaagggagtgacaaaacatacctccgcaatttcgaatttgaggagttattttgggggtgagcaacggacgaatgaatgcgaattgtaagcaaagcgacgaaggcttttacaaaagtgaaaaattgcgaaaagtgagtcaaaagaggggggggggggataaagcatcagcggaaagagacggaagccgaatggtggacgacttccgaagtgtttgttggccttggtcacactgtccctgccattgtttgattttgatggtctctttgcactaatacctccgcggtgccattatcttttttctgttaaatgcctttggcatttggccaattacgttaatcccatccgcaaaacaaacgcaggagacgtcacagcgaacacgaaagagacggaggcttcttcacgcgattaattagttcattatttaatactgtacgtaaattgggaaaaataaataattaaaaccatgaaagcgaattaagggattatttattatttaatcagcactttgtcacacaaacaaataatcttgggttaattaaaattaattaactataatgctaagtaataaaattatggcaattgtgaagatctttgctcccgaaattttttacttatttttttt

SEQ ID NO: 30397 - DNA, 1794 bp, Heterodera glycines
  misc_feature (1670)..(1670): n is a, c, g, or t
  misc_feature (1672)..(1672): n is a, c, g, or t
  misc_feature (1689)..(1689): n is a, c, g, or t
  misc_feature (1694)..(1694): n is a, c, g, or t
  misc_feature (1702)..(1702): n is a, c, g, or t
  misc_feature (1704)..(1704): n is a, c, g, or t
  misc_feature (1706)..(1706): n is a, c, g, or t
  misc_feature (1725)..(1726): n is a, c, g, or t
  misc_feature (1730)..(1730): n is a, c, g, or t
  misc_feature (1732)..(1732): n is a, c, g, or t
  misc_feature (1734)..(1735): n is a, c, g, or t
  misc_feature (1737)..(1738): n is a, c, g, or t
  misc_feature (1741)..(1742): n is a, c, g, or t
  misc_feature (1749)..(1749): n is a, c, g, or t
attaccaatcgccttcttagcgaaaaatttggatttacgaaaaatattacggaatttcgtgtcaacccggatgtggagcgccccgatgaagcgatgaaggatgcgatcgacaacatgataaaggtggctttaaagactacggaagaaaaaatgaagcgaaaagtgcggatgtttggagttgcaattacgggtgccgggcttgctttcccggtgtgggtgccgtatcgggcgtacccccagaataatgcggatgttatcatggaggagattaataagctggggcagagcggggacggggatgaaaataagaaaatgcttttattatctgaaccgattactatgaaaattacatgcgttacaatgcccagtggagaggggccgaggaatgtccacaaatttgactttggattcaaggaacattagcggatagggtaagtgttttaataaaataaaattaaaatagaaaaaaatcaataaataaatttaaaataattatttctaaaaaatttaatgaagcaaaaaaaaaattttttttaaagaaaaaaaatgaaaaaataataatttaatgaaacaaaaaaaaacagaataaaatttaaaataaagaaagtaaaaaataaatttaaaataattattttaaaaaattttaatgaaagaaaaaaaaacttaaaatatttatttttaaataatttaattaggcaaaaaaaaaaagtaaattttaggattgtgaatactgataaattttgccttttttacgcactggcgtcgtcgatgaattatttaattatggataaatattcgtttattcgttttatgaagaacttagcaagacaaaaggaagcggctgttgaacttttacggaattgtggaattgatggaaacgaaattagttatggtgtggagcaattgccgaatgttcagaaatattgggtgggttaaatgaaaaaatgcaaaattaataaatttttcaggatgagatttaccccggaaagtaccgggttgttgcgtttgagaagtctgcagatccgcgaaaatcgatctgtgttttgtggaaggcccctatgggacgagagaaggtcgtaccgatatttttggagaatggtcactgggatggtctgaagaattacgtctgtttttttaatcgtgggagaaaattttgtattgattgtgagtgcttttttgacaaggatgtcaaacatactttcgagtgccgggcaaggtgttattattgcaatagagtggggggaatgccatgtgaaaaggagagtggagtgaagattgaatgcccaaagtgtcaccgttacttttacaattgggagtgttataattatcatcagggacatcagacttgcaaattatggaggcgttgcgtgatctgtgacaagacatatttatttaacccgaagaaggaacatgaatgtggtgagacttattgccagctttgtagtgtgagccatgaccccaagcgggggtgttatattatgccgatcgaggagaaggaggaaaaagatgtctacagaattgtagtttgggtaagttctacaaataaaatcaacaaaaataagtctttaactccaggattcggagacttcgcaggattctatttacaagggggaccagaaggagcatgttattaattatatttcggagaaatttacttttacacaatactntnataacaaaaacaccacnaattncaaaatcncncncgaggagattaaagaggannccancnanncnnaannacatganccgactatggagaagtgagtgattttaactctatacgaattatga

SEQ ID NO: 30398 - DNA, 2449 bp, Heterodera glycines
gaaaaataagccattcaaataaaattcattaaacaatcttctaagtattaaatatgtttacattttaatatttttaaaatataaaattaaaaagatgaagcaaaaacatttaaaaatgaattaattattagaaaataataataatttctgaccaaaaccaaagcagaacaaaaattttttcattgaatatgttgatgatgagaacacattgaatggtatattcttgaagatttcccattacgcggacctgtgcttttattcattagcctttttaaaacatattataccaagtctttctccgaaatacggacaaaaggtttcaaattttgtcaaaacttttggtcaattttaaaagaaattatggagacgatgggttcgacagacattgtcgggaaaattcttaaaaataaattgccaaaaaaaaattttgttgaaattttatgtctgccaacactaaaaaaaggaaaatggtgcaaacaaatacccgccaaataaggacaaattttataaataagaatatatatttagcatctctgtgtgtataaatttaaaaataaataaatgattatgcacctgaaaatcgcagagcgaaacacgtgggaaaatgccactttgctcccaattggtgccattcaacaaatcaacaacggcaccaaatccatacaattggtaacgatccgtttcgagaaaactgaatcacaataaaaataaattattaaaagaagaaaaaaataatctcaaaaattgaaaatatatttaaatcatatattaaaaagggggggggggtcggtaaaaatttttgcgaaaaggggtcggccgccgatgaccttttttttgcttttcaaaaactgttttttttccaaaacattttcgggaacatgggggtcggcggtgccgataggcgccgccgggaaaattttttgatctttgggtgtgatttgttaacagattttcaccaaaaaatggccaatttttgcgattttgagccaattttttaagaaaaataggaattttggggttcggcggtgtcgccaggcgccgccggggaaaatttttaatgaatttgttaagaaaattttcaaaatttacgacaggccccctttgcaacggaaagggggctaaaaaatttttataattattttaaattttacgcaaattctgctcaccatatgcaattgacaccgctcaaattaatgctgacattgttcaaattgttgatcgaattttcgtccgtccattgtgccgtcgtcgtctccccaatttggcatcgtttaattatccatcggtcgtatcctgctttggtgaatgtcagcttttcccgggttctttcattcaccaattcaaatggcaccatggttgacgttgacggcgcatgagcagtaaactgaattttgtagctggcggcattggtggcacggcgaaattgctaaacaaatttggaaataaacaccacaaattggcaacaatctttcgaatggtaccatatttgtccacgctataagctaatcaatttaaaacaacccatataagtcaggaatgccaaaagattaccacttattgtttagaatttttacaaagaaaaaatcttagttaaatcgctaagattttctaaatatgaattactgatttttcatttttataaaaaaaaatttccaaaaaatcgctaagatttttctaaaatggcgggggggggggggtgaaccggaaaaggacgtttcggtgccagcgcccaagttttagcttgtaaaaaagttattaagaaaaaacttccaaaattttgggttttttgttatttcatgttataacttttttggtaattgtcttatcgctaacaagggaacattacgagctgtcagtcagaaaatgcctataaacgatataccattggatagagcagggtcgacttctattgtgaatttttaattttagcggtgcattttgcttccttcgagagttacagggcctcaaaaatcggatttcagttgggtgtgcaacgacattttgatggacattctcccactttttgaccatgctcaactcggcttaaaattggcactaatttcgccacgtttcaatgtgttggtcaacaaacatttcgatggcaaaagccaattgacgctttggagacaaatcagaattcaaaaaggtgctggaccagaccaaaattatctgtatggattgatcgcaaatctatgcaatttcctttcaaatctatgcaatttcctttgccagactatcagctgcccaacaaaatccgctttgaggaccttcatattgagtaaatcaaacaaatcaacgaataattaactaataaaagcatacccttaccaggtacattgaccattccgtcatcaaatttctccgtgccaatcaacaaatttttggcaaagacaccaatttggagttgtatatgccatacccctataaagccaaaaatatccagccaatt

SEQ ID NO: 30399 - DNA, 1166 bp, Heterodera glycines
  misc_feature (1027)..(1027): n is a, c, g, or t
  misc_feature (1090)..(1090): n is a, c, g, or t
ccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagtattatatttaaagcctaattagcagaatgtgaaattctctcatttgttactttatgatcatttttgtctaattcgcaaaattacagctcattcttcgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgctttcgaatcgatcattccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcaaaattacagctcattcttcgcgaaatataaactgaatcagtgtttgcggaatgaccgagctgataatcgccaataatcttcgattacaattttcttggtcacctttttggaattccaccatttcaactccttatcctctanatataaactgaatcagtgtttgcggaggaccgagctgataagtcccaataatctccaatttancattttcatgatcacttttgtgatatttctcatatttcaatttcttatatccaaaatgtatctgtataagtttaca

SEQ ID NO: 30400 - DNA, 1108 bp, Heterodera glycines
atagcgatgatgggtgttgagcaaaaagtgggatagcgatgatgggtgctgaccaaaaagtgggatagcgatgaggggtgttgagcaaaaagtgggatagcgaagatgaatgctgagcaaaaagtgggatagcgatgatgaatgctgagcaaaaagtgggatagcgatgatgaatgctgagcaaaaagtgggatagcgatgatgaatgctgagcaaaaagtgggatagcgatgatgaatgctgagcaaaaagtgggatagcgatgatgggtgctgagcaaaaagtgggatagcgacgatgaatgctgagcaaaaagtgggatagcgatgatgggtgctgagcaaaaagtgggatagcgatgatgaatgctgagcaaaaagtgggatagcgatgatgaatgctgagcaaaaagtgggatagcgatgatgggtgctgagcaaaaagtgggatagcgacgatgaatgcttagcaaaaagtgggatagcgatgatgaatgctgagcaaaaagtgggatagcgacgatgaatgctgagcaaaaagtgggatagcgacgatgaatgctgagcaaaaagtgggatagcgacgatgaatgctgagcaaaaagtgggatagcgatgatgaatgctgagcaaaaagtgggatagcgatgatgggtgctgagcaaaaagtgggatagcgacgatgaatgctgagcaaaaagtgggatagcgatgatgaatgctgagcaaaaagtgggatagcgatgatgaatgctgagcaaaaagtgggatagcgacgatgaatgctgagcaaaaagtgggatagcgatgatgaatgctgagcaaaaagtgggatagcgatgatgaatgctgagcaaaaagtgggatagcgacgatgaatgctgagcaaaaagtgggatagcgatgatgggtgctgagcaaaaagtgggatagcgatgatgggtgctgagcaaaaagtgggatagcgacgatgaatgctgagcaaaaagtgggatagcgacgatgaatgctgagcaaaaagtgtcatagcgatgatgaatgcgtgagccaaaaagtgggatagcgatgaatgagtgctggagcaaaagtgggatagcgatgatgaatgc

SEQ ID NO: 30401 - DNA, 958 bp, Heterodera glycines
tcgtccacttcggcattaccagcgacaccgacgagcgccacggctcgtaaggaatgggggccagccaattccggaaactcatagactaaaaataagattattatttttgaaaaggaaattcaaaaagccaaaaaatcgagcaattgcgcttttttacgatttcagggacctgacaaatgaattcatacttttttagagtcggaaaaatcatttgtatatacgcggattcgaaccgccaatttgaggaccaagtttggttggtgtggtgggcatgctcgcagccaaatgatttgttagggttcgaatccgtgtgcctgaaattgtttttttccaactaataaatcccaattcatattttgagttttgaattgaaaagtcagtgtaatcttggtttttgggtcccttaattattggagtgccgaatttgccaattttcagccactaaaaagagtgccgccactcttccgacctatgcaaacgatgcgcaagcattgctggccaacttttacgttagcattcgaatcaatcggcaacagcgacgcaactttttgtcctctctgctcaagatgttctctgaagaacacaaagaagtgagaattggcaaaattgtgtgcaactccaaattttttttaatcaaaaattccccaaattttttaaatggttaaacttttaaaaaatttctggaaatttttcttcgaaatttgccataaaatattgtttagaaaccgagctggaccggatccggtaccggattttactggattcggaaaccggtccggtgattttttgaaaaaatagggattgaccggttttctggattgatcggattttgagagaccggatcgggaaacggattgcttttgaaaatatcaatccggtccggcagatttgaaattctccgtttctaatatttttgttttttttattttggaaaaagcatccttttgaaatttttaaa

SEQ ID NO: 30402 - DNA, 988 bp, Heterodera glycines
attactgctcaaccctagtttttatttatgaatgaaattttttggagtaaaatataaggctacagaaaaattgaaaaacactcgcctctcgtcctctcgccaactctcgtgttttgagggactctcgtccctcgccaaactatcgctctagtcttttagaggactctcgccgaactctcgctttcgtcctcagtaccattttagcacccattttggatgttttttataatcagggagcaaataaacattttttgcagccttttttaattttttatgcctttaatctcctaatttttattctttttttccaattttttgtgctgattttgccttttttgtgcttttttcatgcttattttggaaaaatttggtgctgtttacagtgcttaatcggtgattttttgtgctgaaaactgagcactctagtaataaactattaaaaatattcaaagcattttaaataaatttaataaactcatttatatttcctaatcttttgtgtacattttataggatttttttctttaagattaaaataagaaatactttaaccgtgctgagtcgattcacaaaaaaactcagtgtgggcgatccaaaaaaaactcagtgtgggcgatccaaaaaaaaactcagtgattgattggtcattttccggaagcctatcgcaccactttcgggcaccaaaaatgcctgatccggaatccttaccggcccggttattaacaatttttgtacagtttttcaagggctatctcacaggccgggtccggttcttaatccattcacttggagcccgtcatgggtcgagtacatatgtcggaggaccctcagcctcgcccccgaccctgtcggtggccaaccaagctaggcgtgccggtaccagcgtcttttttgtacagctcgacgacctctacaaaaaggtatcaatcgcgtccagcggtgtctacttaccaataaggaaaaaattgacgagaagtgatgtgaaaaa

SEQ ID NO: 30403 - DNA, 1218 bp, Heterodera glycines
  misc_feature (1200)..(1200): n is a, c, g, or t
ttttaagtttatttttaatgttattaattttcacaaaatctataaaaaaaaaattccgttgtgttggcaattcaccgaaattaataaataaggattttgatattttttaaagttttaaacaattgttaccattccgaatcagtcatcaagctaaatgtagttgtcttatttttaattaaaatcaactaataggctttgaaaaatgctataaatattttagaccaaccaacttattttgtgattaataggagggcttcctttttaggctcaaaaaatagcaaaatagacgttaaatatgcactaaaataggcaaataaattttttattaacgctttttaggtagcaaatggtaatatttctaattgtatgtgaaattaataaatattttaaagttttttcgaataagcacaaactttaaaccataattttttataaagaaaaataattaaattgtagaggatcaatttttctaaaaaaaatttgggtcgtttcttagaggtgtatttaagagttttccgaaaatcctgaaaataggcgccaaaaatggataaataggcacaaaattaggcattataaaagacatcgttgactccccaaaaccagtttttcgtgcttatctgagcgtatcaagcgcgcagaaattcttattcagttccaattaatttttctacaaaatgtaaaaaaagaaatgaattaaaattgtttgtattgtacgatagattaacaaaaattgaagtgctacgcatgcggcaggattcgaacctgcgaaggaaatatccctttgcgatgtaaacgcaacgccttaaccactcggccacacatgcggcaatgtcattcgatactccaatgcgttaaaaacattcaatcaggcaacgctccggttttagcgctaaacccgagtttacttgtgttaatccgggttaacctttttatatcgcggtgtgtctctaggttaaatgtttcttaacccgtgtttaataaataatctcgggttaacagcgtcagtgtcctcgtctttggattcttaaccgggttatccgttaactcgggttttgttaactcggatttaccaacttttaacccgggtttatctccgtgaacccgggtttaaaataaatttgtgtgctcgtttaaccttgtttattttcttaaggatttttaaccctgagttgaggcattgttaacacattttaaacaaantaaataatttaaatataa

SEQ ID NO: 30404 - DNA, 1328 bp, Heterodera glycines
taatttgggggcaatttgttaacttattctcaacaacaaaagaatggtttctacgattattaaactcaataggtagcattttcacttaaacaattataacataggtctcaactcaaaaaacactatgaggaaccatagattctttatatgaaaccctcgagctagacaaaaaaaaaaatccagtgctcattattcccggttcccggttgccctatcgggaccgggacctgagcttttcaaaatccgggaccgggaaccgggaccggtacctcggaggaccgggaattcccggcccggtcccgttcccgtggcaccctacaaaaaggtaacacaataaagtcaaaagaatattaagataaatatttttaaaatcaaaaattcttgttaagaaaataaacaaatagattttggagacaaatttttgggaaaatttttcatttgttaggggtgtatttttgaaaattttcggaccgattcttaggggagtttcttttttattgcatttttcttaataattttgggcaaaacgccaaaataggtcaaaagaggtttttttagattttttttaggctttttaggctctagaaaataaaaactagaaaatattgcattaaaaactcgaaaagtagcttaacgaacccccccccccaaaaaaaacttgttttttgggcatttcaggacaaataaaattatgtcaaatcccagttgggtaacagtgtattgatatcttcggggctctgtcagcctaaagattccgttttgatgctgctctcccattgttttgcttctgttttgatggttcctcctcctccttcttctttttgctcttttccgctgtcctccttcaaaatgtcgttgctccttctgtactgctccaatacagtcaaatggtgcgtcttacccccctccccctttccatgtattttaaaccagggcttccacaatgaacaccaactccgaaatataagattttaggctcaaaaataagaaaattttttaaaatcagttatttttacaatttatttgatcaaaaatgtttcaaattttatatttttagtctcccattatcaattttaagaattttggggaggaaaatgcaaaattgtaaaatttcatagcattctgaatcaaaagatcaaaaaaatttgcgtcagaccataaaatttcttgaaaaatagtgacattatgccataaaattactataagtatatttaagaaatcatcgctaccccaaaatcagaacattcatataaataagaacaaatggaaaccttggtttaaagtccagcttggactcactcttagtggcgctaacgaaatcagatgat

SEQ ID NO: 30405 - DNA, 1601 bp, Heterodera glycines
caacaaataaaattaattttgtggacggtgaatttgcaaataaatttatttaagaaaacagcaaaaattggtcggaggaaaaatgcacaataaagtcaaatgaaataaaatgacgaaaaatgccaagagaagggaattgacagggattaaataatagtcaatgaatagggaagagaaggaattgattaacaataagaagagagtgcataaagagagagaaatagagaataaaaaaatgtgcactgctaagtgagagaacaaacacggtgttctttggtcacacctaacacctcccttcttaagctgacttccttctcagagtcgaatatacccggttttgcgggatttttcgactgatcattttcaaaattcaattcgacgggaaaacggcgacggagttggttggcgtgttggtgtactgctcggccaagagatggtgcaaaaattcgataggtcggagaattctcgactctttcgatcacttttcctggcagccaaacacttttgttgtccttaaaattccaaaaatagacgggttcttccgcttggaaattcgtcgtttttgttccgtgtttggaattgaattggtgttccatttttcggatgtaaattttctttgaattttgaaaattttccaaatcaattagttttgatttttgatttggcggatgaatgagtgagagtttcgttcggagtcgtcgtccaagaaacaattcgtcgggcgaatgtccatcaagggccgcacttggcgttgtccgatatgccaaaagtgctttctctgcccactcctttccttcttttcgggactttttcatagcccttttgaagatgtcgacgaatctctccgccgctccgtttgacattgggtgatacggaggagtaaaggtgtggcgaattccgaattcctcacaaaattccttaaattcggccgatcgaaattgcgtgccattgtcggatacgatttctctcggaatggtttacgatcgatttcagcaccgaaatcgtaatttgactcgtcgtgcgattcattttccaaactttcggccattttgaataggcgtccacgaaaatcaaatatgtgtttccgtctttgcatggcccagcaaaatcaatgtggacgcgttcgaaaacttcagtggccgctttccatggctgaattggcacttttgttggatttttagctgcgctttgacagtcatcacattgtcgaacagccttttcgatgtcactatcgattttcggccaataaacgtgaaaatgaggcatccatcaatttccgtgatctgatcacgttttggatagaatggtgccaaatcatgattttcacatttttggggccaaccattcgtggtgaattgttgaatttgttgcaaaatgtgatcctttgatgtgttttcggcaacttcagatgcagtgattggcaactgatcagtttttgcctggaaaaccaaattgacaaaacattcggttttgttgcaaatgttggcgattagaatgtcctcatttggccgtgggtaattggcgatgagtctggacaaaacgtcgacatttccaaatgcggttgtgctcacatagcgaatgtcaaattcataattgaaagg

SEQ ID NO: 30406 - DNA, 1335 bp, Heterodera glycines
  misc_feature (16)..(16): n is a, c, g, or t
cgttatttgtgatcantaaattatgtcctgctgatattaaaaaattacttaggaagccatccctaggcaattttagaacacctaattttactagggctagttcgaggtcatgttattaaccgggcaccccgattttcggctaggttggttttggaaactcattgttcaaaattttgaaaatagggacgatgtttttggaaactcgggaccgggataaccggttttaggcctggaaatcgctcaaatacgggaagaaattaggaaatccagaagaaatcctggacaccggactaatcccggtctcaaccaactctatgtagatttaaccttaattttccaataaagacttcgaattcgcgcctgtgttttcaatttggtttctatttgattgaatgaatctctttttccgtgttcaattttgtttttccattcattataagaagcctaatcaaatgaataaaatttaaaaaataaatatatacctaaataatttaggaaaaataattaatttgccttaattgtcttcgtttgcttcttcgcccactccattcgtgccgcttccaattcaaactttgtcagacttttgttgttcgaaattttctcgaattctttttttgcctcctttgtcgcatcttttagaaaaggaaatcgatccaaattcgctttgcttaaaagataattattttaattattatacaacaatcagcagaaagccaatttttaaaaatttcatgaaaccgtaatacgttcactgcgctaaacttcaaaaattctttttaaattttatgtaatatgtgaaatttcactcggctaatccaagaaattttttttttattggaacacaatgcaatttaagcatttttttatctcagctacgtaatcaaaatttgaaaattactaaaatatgatatacaaaaaaaaaattgtatagatgaattattcatttttttacctgttttcataattttccccatccacgtaaattttggtttgaatcggtccaatagttcctgaaatccgcgcaaaacttatcgaaatatttaatgtagataataaaaacacaataatatacatttttcatatcataataaaataatttttgttggatatttttttaagaaatgaaaaatgggaaaaatttagcaaatgcaaaatattattgggccaatgatattctgctgtcaatcgaaaagccacgttgcgatgatgaaaaaaaaattggcaattttataaacatatatccataaaaaattcttagatttaaaaaattatgattgaatttacaacagggcacccagtggtctgctgttttttcagagtggtcgtgattttttt

SEQ ID NO: 30407 - DNA, 1079 bp, Heterodera glycines
  misc_feature (74)..(74): n is a, c, g, or t
atgataaagacaatgtaaataaattattatttataaatataatcttttgtttttataataaccgtgaaacattntaatatttctatttaaatctctttttaagagtaacaatcttttatcttacaaaaatgttaaaataatataaattttgagaaattttctcttgaaattgtaattaaactaatattttttattcattttctaaaatgatttaaatgaaataaaaattatttttaaaaattatttatatttatgttattcaaatattcgccattttattcattaagttttattttcagtttatttgaaataaagataataataataaattaatattctttcgtcgttgtcgctttttaatgcactttcggtttttgataggcttcttaaaatatcttcttttttaatccattttttaaatgtattcgttttactttgtgatgtttatattaagcatccaaattaattctccttataatttcaatcttgtgccctatctcatgtaagctctcacttataccattatactcattttatttaataatcaaaacttttgcttaaattatttaaaataactatgtaaataaatttttattttataagagggggctaacggcgccgataggcgctgccgggaaatttttttaaaattcagtgcaatttgttatcacatttggaaatattatagataaaaatggttttattttttatttatttttaattagcaattttaatttgtatttaaatttattaatttgattttttgttttactctttaaaaaaaataacaacgatttgggggtgtcctaatcttttaatttatccttcagtttcttatgcttttgtttcttgttagtattttatatattttaaattataaaacttggttcaaatctaactaaattaatattcaatggtacatgatcatttaaatatgcttatgtttttatattaaacttttttttaagaattgggtaaatttaaattaatttttaagtttaaaacatttaatgcaaaaattaaccgtttattctctttattgtttttataaaatatttattaataatctttttatagca

SEQ ID NO: 30408 - DNA, 1228 bp, Heterodera glycines
  misc_feature (1161)..(1161): n is a, c, g, or t
  misc_feature (1193)..(1193): n is a, c, g, or t
  misc_feature (1214)..(1214): n is a, c, g, or t
aaaaaaaagttaaaccctaaaactttttgcccttttttaaaaaggaattaaaaaatttttaaaaatttattcatttcccctttttgatagaaaaagcatcagggtgccttaaattagccagttaaataaaatttggtgcgttttcagagcattttctgaaaaaaattatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaatttattcatctccctttttgatagaaaaagcatcagagtgcctaaactaacatgtaaataaaatttggtgcgtttcagaaccctttctgaaaaaaatatttatgaattaattatgcaaaaaataaataaataacgaaagactcacatcctcaaaaattttcctgaaccgaagctagtcactcggcgcgcatcgcggcctcgaggtaggccttcacccccgaccttcagagcacgacaaagattgcaacaaaaattctgctaaattagcaaaagcaatcgaacgcgaacgaacgacctactaaaaaagtccgaagcagacaatttaattcttttcctttcacttcgcggcaaagtgccgggcgctgcggataagtttctgaaaaaaaacataacggcctaaaccttttggctagtcagcaatcgttgcttaacttgccagatcggacgggtgttaaaaatttattcatctccctttttgatagaaaaagcatcagagtgcctaaactagcatgtaaataaaatttggtgcgtttcagagcattttctgaaaaaaatatttaatgaattaattatgcaaaaatanataaaaatttctaaaaatttgatcgtccatanataatttgtaattgatcaggngctcaccaaatttt

SEQ ID NO: 30409 - DNA, 1717 bp, Heterodera glycines
cgcggatcgcggtcgcgctccaaggccctgtacacacacactttgagaaagcgaaaactgagacggagacggagggagagagaaaaagagagagagaagagagagagaaagaaaagtaagagagagaaagagagagagcgcgggggatagattgagagagggagaaaaaacaattagtagaataatgtaaagaaaaaaggaaaagacaaacaaagaaaaacagaaaaaacaaaaaaaaaaaacaaaaatgagagaaggagaaagaaaaatgccatcggcaaaatatgtacattttcgcgcacaccttatgacaattacattttctactctttggcgtcaaaacctttaaaaatactaatgagaacccataaacaatggcgtagacaaataaagaaaaggtaaaatggaacgaacaaataataataataaaagaagtttcagccaaattgcgttaaagttgaagaatggcaattgaaaaaaaaacattggcattcaatggactgaaactgaaaaacattcggcactgatggatgagtgccgccctcggcaaattctcgtggaatttctgtgcttttcgcccgaggcgtaaagtccgtttctccctaattgcttgggggagcaaagaaaggcctaaaatgggctgagaaagggcaaaaatggaaggggggggggaagggaagaaaaacattgggccaaatggacagacggcgccgtctgccgggcggtccggccattttggccgccgtcggctgtacgatttccattcatttgccgtcggcggagaaaaagcggcggcaattttattgccacccctttttcttttcaacaagaaaacaaaaacgaaaaagcaaaaatgggaacaaaaatcgaaggattaacgtacattttgagaattttaaaaatggcgtaattaacgggcgaattgactaattagcggtgggacaattccaatttatttgccctttgcttggggcaaaatattattcatttccttttacaaaaattgagaagaaaatgtcctctgttgtgagtgatttggttgaaaattgcacactttagcgacaaaatgagcagaatgaacttttagaaggaaggttaaaatggtccttcggcagccaacacattaattactgcattttgtcacttaatcagcggcgcagtgaacttgggcgagtgtcgtcgatcaaaacaacctttcgccacggggctgtggaagaaggtcgaccgaggcgggtggggtaaggagaaaaaccaattaatttggtgtcgagagtctcgacaatcggcgacggcggcggagcattccatcgccgcgctccgttcgccaaaaataatggcgggaaaggaggggaaatgatgattgaagatggactagacgagaaaaggacggacggacgaccgaaccgaacagttacaaagggagggaaggcgaccggggacgtaggggggggggggcaaaaaagggggggggcgcataaagaaaaaaagggggagggggagggaattctgttccgatcggcggagaatatttaaagggaagggggggggggaaaaaggccacaccctttaattcgttcggtcattcgatggagatattacaaaacgaccggaaatacaaagagggaaatcggaatgtaatgctgaaatttcgggaaaccacaacgaaactcgaacacaacacaataaaaacattatcggcatttgacactgaaatttt

SEQ ID NO: 30410 - DNA, 1290 bp, Heterodera glycines
  misc_feature (87)..(87): n is a, c, g, or t
  misc_feature (117)..(117): n is a, c, g, or t
aaaaaaaagcgaagacaatttgtcgggaggaaatacaaaataaaatgaaaaatgaggggaaaaagaccaggagggagggaatgacgntctatttatgggcgagtgacaacaacaaanaatggcggggaatttgaatggacagattgccataataattcaaataggctcatccgaacaattaataattaattgtacattttaaagaatttactgtcgggaggggatgtgtttggctgcgcaggattttgttggttgtcatcttaattttgacaaaaaaatttacgggtttttagaaatttaaataaatttaatgaaaatcatttgtaaacatacaatagggtgcttgtcctcccactgtttgtaatttacaaattaaatttgaaattcgttaaaataaacattgacttcctggattcatcggttgatacatgtacttttgtggattcagtgcacataatatcgacggcatatttgtaacaaccgaaccaaacaatccgacattgtccactagctggtcaattacatttaattattgcaaatcttataacatttgttgagattatcgaatcgactaattaattaattaaagttaattgcattgatttttccaatgcggattatatggtggacccgctgggtaatcgccatggtttgcctgagttgggtgcggcactggcgacggtgccggtgtataagcattcgtcataggcactgggcgtggtggctgtgttggccgtggtctcgtcgggcgtggtctcggaaaccgtggtggaggcctaagccgttttggtaaaaatccgcgctcgttttcttctttcccaacgctgtcgccattagcatttccatttgccatagccaaaaacagaccacgattttgggatattcctgtacaaaaaaaaagcattaaatttgtcattttcttaggtttgtacaatttttgcaccaaatattcttatcgaaggaattataatcatcaccaaaaaatggagggatcaaagctgagagaattatcatacatttagttttaaaattaatttatttcatttaattgttacgacttggcgaatcatatggtggttgaaactggcgatagtacggaattggaaaatgattaagctttttgccattttccggctcaaatggcagcgcagaaattgcgctcttaattgagataatcatttgtctgatcacaacgaacacaaaaagtgagaccaaaatgagcaaattggcacaggcgattatactcagaagaaaggaaagcatttcgattgagtgactttggaaattaaa

SEQ ID NO: 30411 - DNA, 1180 bp, Heterodera glycines
ccccctcggtaagggaaaaagagaggcggtaccccccccaagacccccctcggtaagggaaaaagagaggcggtaccccccccaagacccccgcggcaccccccccccccccccctcattcggtttgtatcccccttttgggtcaaatttttcaaaagcgtaaccagacagtcagacagtgcactatttccttctttattttatttttctcacttcttcccttttcccatacgtccctgcatccccccccgccctcatttaaaatttttatactgaattgaaaatttgtaaatctgattcttctgacagaattgccacgttccggcccgcccgaggcgctgatggaattgtacggcatttcggccaatgccatcgtcaaagcggtgaagaacttccaataattgtgccaaaaatgacgcagaggaatttggcagactgaataaagacacttattaattattttcaattttaattgaaaggtattttatagtttctcattttgttattttgacctattattatatttttaattatttggcccttctctgttgaccttctttattattattattattatattgccgttattcatttttatacaaaatatgaagtgcactttttgttgttgttttcataataaaaattagacaacaaaagttcgctgacccacgaaatgtccaagtctcgaatttgagtttattattcagatgggcctaaggttaggcaaggggtaatataaaggatatattcgtattcagcgaccccgaaaaccctaaaaatcctaaattagactcattttgtttttataaattttggacatttcgtggcttggacactttgtgggggtgcccaaaagtttggtttaattgaagtgtaaaataaaagattttgaaaaagcaataagttaggcaaaaaatagaaaagcatctcttatggacaattaatggctctatgcaactttatgagaccaatcacctagtcaaatactctgctagatatatcgacggatttagtagcctgatcgtacgaattctgatttcttgtaattgtctttttattgtgccggttagcgactgtcaccgggtggacccgacccacatcatcattacggccatggatggatctaacggaggaagaaagaatggatgtatagttttagtcttttattctatccgttttt

SEQ ID NO: 30412 - DNA, 1141 bp, Heterodera glycines
  misc_feature (11)..(11): n is a, c, g, or t
  misc_feature (35)..(35): n is a, c, g, or t
cggaaaaatgngaatatcagatggggtgcgctctnttctaaaaattcctcttttcgtctaaccatccctccctattgtgcactatttcgtttcaaaattgaataattttttttggctttttgaaataaattgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttgtcttttgaaataaattgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatgggggcgctcttttctaaaaattcctcttttcgtctaaccatccctcccttttgtgcactatttcgtttcaaaattgaatcattttttttgtcttttgaaataaattgtgaaaaatatacgaaaattattttcggttttaattatgcagtacaatgcttttaagccccgccgtgaggcgggacagttgcaaaattttgtaccaccattttactgtggaaagtcc

SEQ ID NO: 30413 - DNA, 1239 bp, Heterodera glycines
cctcaatcaccgtgttgtgaagcatggtgatctcatcttccagatgagttgggcctcacgaatccgacgggcaaagaatttctccagcggaatgcttgggagcttgtctaatgacacttctctacccagacgaaacgtggaatgggctgttttcccatatggcagcaaaatggctgcacacccagtggatgccgtggcaagcactttgtaggtgtatggggcctttcgcaagcgcctaataatttggccaaacaggaatgtctttcctgtacctccatcgccgtatatgaagaaacggcgggggacagtcggatccctagggttcgactgtattgccaacaaaacagcatcaaagaccttctgttggtcgctgttaagtggcggaggggcttttggctgtggacgaagatttggttgccctggaggcaaattcaaatcatcatcgccaaagaaaaactcttcaattgccgcgtcagtatttttggcaattgagtttggcgggtctggcaggccaaaatgcacacagcttaagttaaagcagctgtgcagccgccaatcaaggtcggctagggcttcaagctctgctgctttatgctgtgccggagtaataatgccttgcggattgtacatttggtctttgtacttgttccacaattctatggcattactcggctggccatagaccatgatgctcacaaaaagccatctcatctgatctggccagcgcgacagagctgcctccgccagagttttgtcccaaattttgccgtcttcaagaagaccatgcattattgcagcatcagtgaatgaggtacaaagcaacccattaaccatcttaagatgatctggatctccaggaaagtgacgcataagtgaatagagcgcgaacctttccgggtccgatgggggtacagcaacaattcggccgataggtggcctttttatttgctgccttttgtacaggacccatttgtcctttgcccatcggaactgctctgggactttttcaaaaagaatgtccttaaactttgggtcattcttccactcattttgccattgtttccaatatgctgaacaatgcgtttctggcagttcgccttgctggatttgttgagctttgctcaccagctggaatgccctatatacaatgggctgttggtttggcaaatgaattgcccaatttgacaacatgatgtgaaagacgggcaaatggcattgaatgaacaatggcatatgctt

SEQ ID NO: 30414 - DNA, 1168 bp, Heterodera glycines
  misc_feature (102)..(102): n is a, c, g, or t
ttttttccccggcggcgcctatcggcaccgccgcgcccccaaaactcttattttttcttagaaaatggcccaaaatcgcaaaatttggtaatttatgaaaanctgttctcagcggcgccccaaaactcatttctcattagaaaaatgataaaaatcacaaaatttgatcattttttagtgaaaatctgtcaacaaattttaatcaaattttcccggcggcacctgccggcgccgcctgccccctcttcccaaaaagtttttttggaaaaagcgcgcctcaaaaaagcgttctattgatttttaaatttggaataaaatttaaaaaaatgatttttgctttatgcttttactattaaaaagttgtagaaaaaatttcgctttcgcatttcgcctttcgcattttcgcatattttagcttttcgcatttcgcttttttttcatttcgcatttttcagtttcgcaaatttcgctttttatttttcaatttggcccatccctggtacttacttacctacatatggtgaccgtctctgcgctggaaattgcaacgggtaatgtacatctgcttctggctgtgcccgattcttctccgccctgaaacggtcgaacacgcaggccacttcatcccccgtcagcacaccggtcgggactgaaatgacaaaaatgaacttcgtttttgaaaaatttcttctacccgtcaaaaagaaaatgatatttttacaaaaaaaaaaaaaacctgtaaaaggtcaacaaattcttcttatttgcaacctcttacagtatgtattgataatatagaatatataaattaacacatatgccaaactcggcatttttaggatgtgtaaccgaccctaaacacggagaataattggcacaaaaattattattattatttaaaaaaatcgaaattctggtccaaaatctcaccccagcctggcccgctcccaaggggggagagagagattctaccccctcaccgcccgaaattaaaaatggccaattttttgaaaattttgcacaattttgtaggaaatttttcccggctgcgcctatcggcacgccgttccccgttgtactatttattatttttggaaaattttaccccaaatggcaaaaatctgtcattttgtggtgcaaaaccgctacaaatcctgccttttttttt

SEQ ID NO: 30415 - DNA, 899 bp, Heterodera glycines
tttttctgggatagagtataaatttaaaaattccctcaaaattaaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccattttttctggga

SEQ ID NO: 30416 - DNA, 2041 bp, Heterodera glycines
  misc_feature (49)..(49): n is a, c, g, or t
atatttttttattaatctattgtttagcaatttttcgaaaaattttgcnttaattttaatttattgaaaaatcccgaatcccagccgggatctcggccataaaatgacacccgcgatcgggaccctgacaaaatcgggatttgtatcccggtaattctatcccggcctaatgccaatcccgaactccggtccagattttttcaaaattccgtgctctagttttttttccaaattcaacagaaacggccttaaaatttgcatttgctcttgattcaaatttttacaaaaccatgccctttcaagtttcgtcttagacaaaattttccggccataacttttttagaattggtaaattttacacatttggtatttattgaaagctctatttattaaattttaaaactttatttatctataattaattattgactcaattatcaaacttaaattttgcatgggaatttaattaatcgtttgtgttaatattattaaaatcctttgaacaggacaaaaaagaaaagcggacaaaagaattcccataaactaacaaatggcaaatgaaagttctttttactcacgcactgataaaatttgtaccgtaaaaatttataaatttcaaatgaaacgcgaaacaatcgaactaaaattccatgttaaatttaatgtcgaagtttcgaccgctaattgaggagtcattatgtcttttatgaaaacagcaaatattttaaccattttctgtatatattttttttattaattgacattaatgaaccataatattaattgatatttatttcaattaatttttattttcgatctcaccaaatttggttaaaaaaagatataagccaatacttttttgagcattaattcttaattagagagttcttcaaagaattccattttgaagttgcgtgacaaatgaaaaatgaacggaaaatccctttttggataacctttccttcccatcccttcgctggtattttaagaaaaaagataatatttcaaatttgtcattttacttttctttatttcttaatattaaatgtaaatttttaaaaattgtgctcatagcgctttaaaatttttgtgccgcttattggcatcgatttttagtcccaggggttctcagattttagcggattaaaggacaaaaaagtgccgttcttaattgaaatattacttttcttcctttaaagattatttggaatatttttgggtcggaaaaatttggctttttacataaatctctttagagacgcaatttcggaagaaaatgttcattttttttgacaaggcagcagaaaaagctcgtcatttgctttaccacttaaaaccactcaacacaaaagatgtaatgaatgaatgagaatattcgttccattgtttcttttccgctttttcccattttttcggaaaacattcaaaaattgccaaaaaaaagtgaaaaattttgctgtttattttggctctcaaattggctccaatcggtgaactttaagggataggataattttatagtctttcattggtcaaatgcagcaccaattttatttgttgttcaataaaagattaagggatcaattaaattaattgtttttattggggaagcgaattcgtctcaaatatgcaaattgacctaatttagcatcaaaattaccttgagtttttattttctcatccgctaataaattcataaatttccatcataaaacggactctccttggccctaataattgcttttcatggccaacttttatttgcctatgccaattttaaaagacgctcacttttccgcacttttttccatagagcaaataaatgacataaaagcaacaattaaaatttgtttctgaagagaaattctcacaaaattaaaaagaaaatgccattggacaattcagaaagcaattagttaataaccttaattggcccacttggctaatgagcgaaatgaataactttttcgtcactttggcggagtattgtttgcttctcctcttctgcgctctgtccaccgcaattggctctgtttgcact

SEQ ID NO: 30417 - DNA, 1347 bp, Heterodera glycines
  misc_feature (1154)..(1154): n is a, c, g, or t
agttggaatgggcatgcgtggcacccgtgaacagttggaacccgagggcttggcgaatgggcatgcgtggcacccgtgctcagttggaacccgagggcttggcgaataggcatgcgtggcacccgtgaacagttggaagccgagggcttggcgaatggccatgcgtggcacccgtgagcagttggaatgggcatgcgcggcacccgtgctcagttggaacccgagggcttggcgaatggcatgcgcggcacccgtgctcagttggaacccgagggcttggcgaatggcatgcgcggcacccgtgagcagttgaaacccgagggcttggcgaatgggcatgcgtagcacccgtgagcagtcggaacacgagggcttggcgaatgggaatgcgtggcacccgtgagcagttggaatggccatgcatggcacccgtgctacagttggaaattatttaatgaccagcggaagccaagaaaagaaaatagtctaatggccagtggaagccaataaaagaaactaatggccagtggatagacactttgtccctgtggtgaccaaatggtctaaaacagacagtcatgcatttgccactgccctacacgcacaaaaacacggtgtcgacactttgtcccagcaagtgtgtagacactttgtccgttttgaatgtcaacacttttccgttttgaccaaatttgcgaaaaatgtgctttttacgtctgcgcccatcctttacactaaaaaaacaccgcttcccgcgaaaatgccgactttgcattttgaaccccccagcggctaaagggggttcgacccttcagacttgtcgaatcgggtcgaacttttttttataatgctacccatggcgcggcgcaactttcgccaagcaaccgcaagacagctactctgcagcgccaggcgctaggcgccatttgcgaaaagttagcaaaaacaggttagcacaactcagcgcaaagcgcccggcgccagacggcaatttgttttcccagcctttcagggtgcgggacgcgcggggaaaaaaattctgactctccagcatcgctggcccaaaagattgctctctatggcgcaaagctggtcaacaaaaagacagcaatctcggcgccaagttgtcggatcgcgccaaattttttttttanattctccccacggcatggcacgcatttcgccaagcgacgccgagccgctatctgtgcaccgccgggcgctgcgcaacacttagcgaaaacaggttagcatatctcagcgcagaggcgaccccaaatttttgtgtaagacacaaatgtgtagcgggagctcagttgccgaatgcaaaaagaattgggtcgatag

SEQ ID NO: 30418 - DNA, 895 bp, Heterodera glycines
  misc_feature (876)..(876): n is a, c, g, or t
gggtgaaacaattaggaagattattaattaattagatgaaagataattaggctaattatacttaattaattaatcgatgaaagataattggctaattatacttaattaattaatcgatgaaagataattagccaattattcttagacggttcaaccaaaccggaagcgaccattaaaattggcaccgacagtgatttggaagtgacttctccatgggtaattaattgatcaaccaatttaatttgattgattgtttccatttttgttgtcaaaatcactgctaaacaacggcgtgcgtttggccggtggcatttacgtgttgaagttggacattgtgctgtccaaccgttgccttgtgctcagactgaatggcactcagttcaagaattgtctaaagaagggcaaaatgccatggaacaaaatcaattggatcaaggtgcaaatgataaatttaggagacctaaagagagcttaatcccacctaatccataattcccatgttatataatcccaaaagtgcataattatcatgatcttgcccagacatttacacccccagacatttgcgcctaccagggctggacgtaactgattttcaattacggaaatccgtaatccttaattacggcaattttttcagttacggccatccgtaatccgtcattacggaggtccaaaaaggccgtaatttggcgtaatccgtaatacgtaatccgtaattttcaaaaaaattttttaatttaaaaaatttttaaatttaaaaaatccaatctaaaaattgttaagattaatttatgatcagaatatctgcttgtttttttgaggtgaaaatcccaaaatagtttttttcgcggtgtgctttttccaaaactgggngatgggggggggggggggg

SEQ ID NO: 30419 - DNA, 1001 bp, Heterodera glycines
  misc_feature (965)..(965): n is a, c, g, or t
  misc_feature (981)..(982): n is a, c, g, or t
tggtcaagcccgcttggttgcgctttatttttagtgatacttgatgaaaaatcagtgacaaaatcaatgattttacaaaaactcagcagatcataatcagcacattctttggctcaaatacagtttatgagtccaatcgactttttttgcatccagtcaattttttacttctattccaccaagatttgctagtctgttttcacaaaattttgaatattttctcagaattataagtcacatacacgtaattgttttccgtttcataattggttcattaatacaacgacctttctttattgtattttttttgttagtgttaggacaaattccgcaaaaattccaagggttcgcttttcactatccgatttattcaatgagtaagccatgccatcccacatattgagttaatctgtttgttttcatttttttttcttttttaaggttcggttaaattacgtgatgagaaatactataccatcggcaattaaaagagaagattgagaagctcagacgcttgggtaaaaactaaaccatttaatgtttttaaaacgaattttcagcaagagaatgggaagaggtggaaagagcgttggacgaattgattgagcaacgccgccagcggggcgtactgcccgaggtaaccgaatgggtaccgcccgctggcggagggaggaggagagggaggaggtggaggggaagtcgacaacttcgtggaagtgctctgttggtttgtcgtgggagattggacggggcagtctcaccggatacatcatccgcagttctttcgttgacccggtaaaattttcgattagatattctccctattttaaattttgatttcaaaatttaaaaaaatcacaggtcaacggaaagctgaccaaacatggccaccggcggataaacaaattgatcgaacgcaagaaacaatggacgcaaaattcatgatcagcgctttttcaaaccanaaattcattgtaaaannattttttaaaaataataaa

SEQ ID NO: 30420 - DNA, 1566 bp, Heterodera glycines
cgatcaaattgaaaggactgccgtggggccccgtccaattcgctgaatggcggccgccgtcttcgaccattgcctaagctttgtaagttttcatttgcaacattttttgttcatttcgtctctaccccccccattccgttcactatatttcatcaatttaaaatttattgctaatttgattttctaattgctaaatttcctaattttattcctccttccaggtctttgtcgaaaatggatgtgcaaaaaacaggcaaaaatccacagcgccgcccgaacccggatttggcctccggcgactttgtgaatgccccgccaaagcgccgaagaaacaccaactcggtgagtttacaattaggttctgccaggttaagacattccggttttcaaccgcatattggcaatggaaacctttgcagctttagttcactaaagattggcatgacctccccagttttttttagagccgtctcgaaggcaatcccccgcaagagcaaccggggcaagtccagccgtccgtcttaatggttcagcaacaacagcccgttttaccgatacagcagcaacagcagcagcgccaatttgtgaacgtaagagtgtgttcaggggtggggcgagggggaagcgggcaatgcaatgccgatgttagcatagcctggggctatttatttattatctggttttgaacccgagcattaaccaaaaaaggggggggggaatgtacattttggccaatgcaatgccaaatattatcattaccatggggctatttattgtcgaattttggaatcagagcattaaccaaaagggtgctgatccacattttataatatccaacccccccccccccccattttagcagagtccgcaaataagcttcagcccgtttgtcgaccctcagctgctacatcaaccgcaacaactgccgccgccggccactcgcatttccatttcggtaaataataatgatcaaattagttttcattgccaatcacacttctttttcagtattctaagccttttacgatgggggagcagcagcaacaacaacaacagggagaagaagatgtgatccgggagcgcattcggcgccgtcagctccaagaattggccgcaatggaattggccaagccgctccccgaagacctgcaattctgtgcccaatacaatgcctatggtctgaccgacatcggctggctgttgatgggatggcgggaccagatggtcattgggtaaggaccatttttgggcaccccctagtcgcattaggcattcaaattcatttttcccgtcccgttttaggaccctcacgggtgtggtggccgaatgtggcccaatggggaccgacaagtccaaattcaaagggaggaaattggtcttgaaatttgatttggacgcgacgcagctcctcagcgtcaaggaatgggagcggcatgaccgggccagcgagcttgcccgtgctcagccgcgcgaccgtgtccagcttcaacgcctcaacgttgtctccaacaaagcgggcaccacggtcgaaaccacgtttttgttttccacacgtacgggcaattt

SEQ ID NO: 30421 - DNA, 1879 bp, Heterodera glycines
atgacttaccccgtagggcactaaaacataaaaattcctctagtcaataaaatatgaaatgcaattacagcatctaatagtcttgattttaactacaaatgtttataataactattgtatgtgttcatttttcgccagttttggacaatggccatcatccgtttgctggcgacacttttgactcgggttttcgttactttgtccatgagaagttttccatgccgtatctgtccacggaaggcataagcgtttctccgggcatcaaagtgttctccgccatcagtccaactcatgtaaatcaaattcttaatattttcccattctttctttttacaaatttacctcagctaattattcccaatttttcagtacattttattaccccatgaaatgtggggcaattgttcggatcagtggcccgaggatttgcaggaaatcgtgaatgatggggcggctgatgaaaggcaaagcgaataactaattatactgtataattagggagcccattaaggtactcgtcgttgaaatgcaaaacgttgtgccgtgccaaatacttcaacgaattgtgcggctgcagcccgttcagttacaacatcgacgaatgtaacaacaagcatttaattgttgaattatttctccattttttcagttttctccgtttgcactccctacgaaatttacaaatgtttgggctccaccgttctgaatgacaccaaactgtcgcagaatggtacaaatgccaaaacaacgtcttaactttagcacatttcaaattcaaaaaaaagagtgccaaaatatttcagagcaaatccttccgaattgcccgcaatgtaaaatcgaatgccaaagatgggtttaccacacgtacaattcgtacaccgaagcatttgtccgcaaaccaaaggacaaatggaggcgaaaagctgaacaatggcaatgaatgtttaaaatgaaaaacaattgacagtttgaaggtcgaccatcgcttcgctgaacattttctaccgcgacatggcttataccgagtataagcaagtgcaaagcctttcgatgactgaaattctcagtatttattcagcatttgattatttagattaattaattaacatggcttttagccttttttcaaatttgcctctccaatttcaggtgacattggtggcaatatgggtctgtttttgggcatgtcattgatctctctgatcgaattcgtcacttacatttgcaaaatcagttggcttttcgtctccaaaaggcgaagggatcatatggcaagaaatgaaatgccaaaataattctgaaattaattttaattaaatatttgtaaatgtttaaagttggccaaacagcgaagagacgaacagagacaaaagcaaatggaaataacgttggaaaatgccgtgccgacctcacaatttgacacattattcggcagaatttcgagaagcattaaacggaaaactgcacgagacgaaaaatgtaaagaatttgggaagtataagagagaagtcgagaatgaaaaaaggccattttggaagagaaaatgccatttggagggactacatatgacaatttgctgaaatattttactatgcgaaaattattgtttatggagctaaactcttttagcaatttttgttttgcctatgaacaatcggaaacaaagtgatgctgaacttggcattccatcaattcaaacgctgaatttggaaggccacacaaacggcggcctgaaaaggtcccaatcaatgctttctacgttttttgaatcgaaaaaagcggtacgaaagttttaaaatgaaataaaaaagaaaatatccaatttaattgaaatattttttatgcaacttttaaatcggatgggtaaacttcccaaatg

SEQ ID NO: 30422 - DNA, 611 bp, Heterodera glycines
tattccatcatcagcatcgcattcaaccgctcgctgccccctctcgcgtcccccctcccctcccccccgcttgggcccccgttctagactcgagaatgaatgaatggaaggaaggaaaatgtcgagaattgagacacaccgaccgtcgctcaccactcgccccccccccaactactataaccatcatcaccaccaccagcagcagagcaaccaatttgccacgcctcaacgctcgcccagcgtcgattggggtgagctccctgccccctcccgacccccctcagcccactctcaacacgacaaaatctcgacacagcactgatgggacggggggaaagggggcgggggaggggacggacagtggcaagcagtaggcggacaaacggacgaccatgggaatgtgggtgggtggatgggatgatgattgtgacagtttttgtggtgggagtacgacgacgaaacgtgggggggggggactttcgtcctttctcggcatcgaccgattggaaaatgtgtcgaaggagaccgaccaagccccgtaaccccttgcacccccctccaaagtgcccagaaggaaagtgttgatgaataatgagaaattgaaatgaatt

SEQ ID NO: 30423 - DNA, 1552 bp, Heterodera glycines
  misc_feature (68)..(68): n is a, c, g, or t
  misc_feature (74)..(74): n is a, c, g, or t
  misc_feature (90)..(90): n is a, c, g, or t
  misc_feature (96)..(96): n is a, c, g, or t
  misc_feature (101)..(101): n is a, c, g, or t
  misc_feature (106)..(106): n is a, c, g, or t
  misc_feature (1321)..(1321): n is a, c, g, or t
gacaaaaaaaattaaagtgtattatggaactttatccgatcacaagtgagtaaacaaaaatagcaaanatgcancagtcattaattaganaattanaattnaacanaatgaggaaaactttattaataattcatcgtgtttttgcaaataaattccaatgaaatattgcaaatatttcaataaaattcacttatttttctttttcgacttcgtttccttgtgccattgttccattcccatgccttttgatctactggcaaatgatcacacaaatgaggcccatcagaactaaaaaaggaattttgaattttgtgtcgtactgtgctttcggttttggtgtggtcaaaggactataaaactggacatttaacaacaaatttaacaacggaatttgggacagaaaatgcattttctgggttctaaattcttgcattttatacaattaaattgtcacatttgcaaaatgggcttaactcatctctaactgttttcaaaaccttttgtctcgcatttattttcaaattaattaacacggaattagtgaaacaggcgcgcctttccccagaaacggattttgatatgtagtccaaaagtcactaattaattctcaatcttgattaatgcgggtaacggtcggttaacccttacatcgtctttttctacgggtccaggaaatcaaatcgcggaaaaacttccgcccgccggggataattagagaggcgggcagtgaacgggaatccaaatgcagaagctctttaccagcttaattgttccggtccatccgctgatgatgatgactcataattattcttgtcaaattgttttttccaataaaataatgtcgctttgctggcattgaaacttttggcaatttcttttgtcggcacttttgggtcttccttttttattctgtagtattcttttacaagggcaattctttgactttctttcgtaacttttcatttaaaattttaaataatatgatttaaattccttttcccattttaccttttaagcccatttcgcttttccatttgtcaatggttctcaaattaatgcccaccctttcagcaatttccaatttgtcctttcgtcccaccgattgttgctcctttttgccaattattttgtcaaattggtgaataaatttttgcttttcttccattgaaaaagcacgcgcttcttaaaaaagggaaagaaaatggaaaataaattaggatgagtcatcagtcatcacttaaaaacaattaatttattccgccgttacttttataattaggctgaaattcctttctcagctccaataattttccagggaaanattttcagttttttggaaatttcgctgtccttcattttgccattttcgtttttcatttgttcatattttttaactatttccactttctgtttttcatccaatggtcttggttttttctgatttttttattatttattatttttatttaattttaatttacatattttttcacaaatgcctttcttactcatttgtccatctgccaaattgttttttccattcaaataaact

SEQ ID NO: 30424 - DNA, 852 bp, Heterodera glycines
  misc_feature (673)..(673): n is a, c, g, or t
  misc_feature (675)..(675): n is a, c, g, or t
  misc_feature (685)..(685): n is a, c, g, or t
  misc_feature (696)..(696): n is a, c, g, or t
  misc_feature (698)..(698): n is a, c, g, or t
  misc_feature (727)..(727): n is a, c, g, or t
  misc_feature (730)..(732): n is a, c, g, or t
  misc_feature (734)..(734): n is a, c, g, or t
  misc_feature (738)..(739): n is a, c, g, or t
  misc_feature (751)..(751): n is a, c, g, or t
  misc_feature (769)..(769): n is a, c, g, or t
tttgttgagagcattcggccgcttcgcggcctcaggacgggcgcttcgcgcccgttttttaatttttttggggacattcggccgcttcgcggcctcaggacgggcgtttcgcgcccgtttattaattttgtagggaacattcggccgctgcgcggcctcaggacggacgcttcgcgccatttttaatttttttggggaaattcggccgcttcgcggcctcaggacgggcgcttcgcgcccgttttttaaatttttgggggacattcggccgcttcgcggcctcaggacgggcgcttcgcgcccgtcttttaattttttaggggacattcggccgcttcgcggcctcaggacgggcgcttcgcgcccgttttttaataaattaaaaaataataaacacggcctgggtccgaacatgccgccccacccctcagaatccccaatcacacagggattctgaggtcttgactatgtcaaaagtaaaatctgatcacgtattcgtgatcagcggcccaaataacccctaaagacatgtttttggaagatttttggtgaaaaaattttcctctcaaaaatcatggtcacacccctgtggtcccaaattccaaaatcacttttatttctataacttttttcaaaaaagtgataaaaagctaaaataaaatttataaaatanancaaaaaattncaaattttttnantatattttttttataaaatactttttcanaannnanttannaatttttttctnaaaactctaaaggtccanaaattctggaataacttatttattttggcttgtgaaggattgcaaataaatctcataaaattatcgctaattttttgactcta

SEQ ID NO: 30425 - DNA, 1310 bp, Heterodera glycines
ctaaattttttggtggctttgcttgcgtgaaacaaattgtatagggatggtcccaggattttggcttaaatttgtttgccatttgtttaatatttcgccaagatttgattgttttgtgcatttttggaaattttgcgtttttttttcggaaatttggctataagtttttcccagcggcgccttatctgcaccatcggaccccattttaccctattatttgaaatttagaccgaaaagtttcaaaaatttgctgaaaaatttttagttttgtattcggctgaggggggggggggggttagcccactcagccctcccccctggctacgcccttacattccacccaccgtatggtaattggacgctgtcagaatggtcaaaatttggtcggtgtccgatttgggtgcctttttgaacattttgatcagtccaccgccgtgcccgccgcggttgatcgacttgtaaatgatttcagccgcctggtccaaatccaaaacttttggcatgccgttgccgtttttcgatggcaccgcatcagcagcagaagtcctttcctcttctttgagctgctgttggtgaagaacctggatttattaataaccatttaaaataattatgtttattgaattatattgctcttaaataaaaaaataagcctaaaattaaaaaaagtaattttggaaaatttatttaattttgttagaattaacccgcatttgttttttaatttaaaatatgttaaacttaattttattttatgtatttattgccaataattaaataattaatttttattacattttctccattcattgtgtgtcggccgttttccacagtttgctcttgcggcggtagcggagcctcttcaaactaaaaaataaaatacattatataaacaaaaaccattaaatttttttatctaatgagaataagcactttaatttggaatgaattaaatttaagccaaattattccgaattaaataggcttaaaaattaatttcttcgtttactttttgtttttccaatttctgagttgattgatcagcatcagctggtggcgattcttcaaactaaaattaaaatacattatataaaacaaaaacactttaattattttttgtaaagagaataagcagctttaatttggaataaattaaatttaagccaaattattccgaattaaataggcttaaaaattaatttcttcgtttacattttgtttgtcaatttctgagttaattgatcagcatctggtagtggtgattcatcaaactaaatttttgaattctgttaaatttattttaaatttgc

SEQ ID NO: 30426 - DNA, 1525 bp, Heterodera glycines
aacatttaccattgacatgcacataaaaaaattatttgtaaattaaaaataataattataatcaatttcactcaattttatgaaaaaatatgtaaatatttaacattttttatcaaaattaaatgggaatttctaaattgcatgaaaaaaaaaattatgaattaaatttaaattatcacaatagttaagcataattgaataaagataatgaattattgttagaccgaagaaatgaaaatgaaaatcacatttagtaaaaatcatttcggccaattccccactaattttttttacactttacacaaattgacataataaaatttttaaaaaatcgaaatcaattactgccaagattatccgacaccaaaaaatgaccggatacttataaaaataggttattatttagagaaacttgtggattttggattaaattaacaaatcataaaaatttatttaaattttgtgaccaaataacatgttagatagatatatgttttgaaattaaaaacaatattaaagtgaacatccttcgtttgaaaagcgaaattttcctttctttggcgaaatataccaaaaaattccgagcgccaactcttgttcaattaatttacgttttgcaataaaacagtttagcccattaattggtttgattctgcatcggtgtggtcctttaaaaaatatttaattttaaaaatataatttttttcaaattttgtcgaaattcttacccggacaatccgtcacttgtttatcatgcaaataaaaaatgttgtcataacattttgccatcatttcagcatacattctcttcgttggcaatttacgaaatgtgccgaaattgcgcttgaaaatgtcggatttaaatcgtctgttaatttgtcgtgccgttttcgtgctaagaaatgattcattcagtgccactgagcgccatatagctgaattttcctaaaaattttctatagaataataaattgaattgaataattaaataacaatgttgtaaattcccatccatttttttcttaaatgatttttaaacatttaagaaaataaaatttgccgacgaattgatcactgacggattgtccattactgactcagaatgtctttcaatgacagattgtctattgatggattattcagtgaccgattgtccgtccatagatggattgtccggaccactttcattctccagttttgggcacagagtttactttcataataattctttagtaaaatagtttgctgttaccacatttctgtgcatataattctccattgtcaaaatgccattttcgtcttccaaaaagtgccaatttcggaaatgcaacattcgcccatccgttgatggcacactgcgtgaggaagtgttcggctttatgttcaatggccaatgaatccacaatgattcagcgcgggaagtgttcaccacatatttaggatcatcgggctgataaagcgcaactttagcagatgtcaaagcatcgaataaagaaaattttcgcggatttcgggctaaattttt

SEQ ID NO: 30427 - DNA, 1167 bp, Heterodera glycines
  misc_feature (12)..(12): n is a, c, g, or t
cacgttttgttngggccaatgtttcgctttttccaattttttttgcggccttttttaattttaccgccgtttcataccaataaaattcatgcgtggttagaaatgacattaaaagttcgaattcattcaatttttgaaagactttgatcattctttgcttttctgacggaaatgccaaaaatgaatggacaatgtttcgcaggtcatcacaaaattgtaaaacagctgaaagattattattattattattattatttgctaaaagctgctcgagcatcacggcatggatttccaattgagcaaataatttttatgcctcacttttgcattcatttgtgtcaattctgatcacttgtgcataattccacaatggctcttgtcggaacaattccagctcaaacttagcagaacttaaaacttggcattgggtgaccaaaatttttatttttctatttatttttcattttgaaaacccatttttttatataatatgtatttttttgttggatttttttttcgagtatttcgggaccatcggagacttagttttcacaaaaataaacctgcttgaaacagtttgcagggagggggggctgagtgggctaaagctcaccccgccccgaaacccaaaaaaagtaaaagattttagtaaaatttttgaaatttaagcaattttcttaacaaaattgcattaaaatactcaaaaaattttcccggcggcgcctatcggcatcgctggacccccattttaccatattcttgaaaaatggaaacctaaatggcaaaaaatagtaattttttggcgaaaattttgtaaaatacatcccgtaattcggaatttcaaaaaatacaccccctaaaaatcgactgaaaaaagaaaaacacaccctaaaaatcgaatttttgacttcagtaccccccgaagccaagggtctggtttttaattgataccatatcgtataatgaaatgtacagtagccacccctctgtcacggtgttatcctcgagaatggaagagtaatgatgggatttatgtacatctttgccttcgcataaacgacgatgtttttgaacatagtctgcatactttttgtattctaaccgcaaatgtgcatacaaccagagcgcaaaattgacgaatgcgcatcgaattttgctaagattatg

SEQ ID NO: 30428 - DNA, 1430 bp, Heterodera glycines
attttccccacttgaagcatttcgaataattagagtctttttcatgtttggtcacttcaaattttccaatgcgattaagtgccattcaaaatgagaaatgaaaaaaattctttaaatatatattttttaaatccttcgcttcttaatttaaaaatgccaaaaaattttcaaagtcagaatgctttataatgatcaacggacaattaaccgcttttataaaacttttaattataataatgataatacacgcgcgaccaccgtttttttgcggttccgtcgccgcaatgaatcagattagtggcacaacggtaattcacagcaacccccaacacatccaaaacaacggatttaacccatttcgaagacgtaagaaaaaaaaacataccgaacataaaattataaaaaattgaatttccttcctttatacatttgttaatgaaaagcgaaaaataattttcaaggtaacaatgaaacattgatgattactgaccacttatgaagtgcttacaaattaggactgatgttttaattatgattttggggctttatccggtgccgttttgacatttcacaacgcaataaccaaatggcttctcctctcggcccattaaagcttattagagacatcgattttttattattttttccttctttttgtgtaataacctcatatccgccttttttaaattgctaaaaaatcatttggaaaaaaatgaaaaattttgaaaactcaaaaaattttttgtcggttcaatggaattttttatatgcataaaaatttccatgccaacatggccggcagaaattgtaaggaggagcaagaagaaacggatgagaggtcgacggaattggcaggaattccggcttttaattaattgggcaatttgcaggcgcattacacggtcgcgaaacctctcattaccaacaagccgcattttttgagctcggcgccatgattctacaaaatatgtttggtgaatataaaaaaaaataataaaataaataaataatgttgttttattgccatttccccaggcgctctctcctttttgcgcttccaaaaggacgacgacctcgtcgatcggctgtcctacttctacacttcctccttcctcattatgatggccgtattggtcagcttcaagcaggtgcttggcccttccgttggcattctgttccaccccaaatcgttcagtttggcggtcgtcctttggagtgttgggtacccgcgcagttcacttcgtcctgggaggcgtacacggaaatgttttgttggtccgaaaacacttattttgtgcccgttgaggaggtcggaataattggattatggtaattagttaaaaaatgccaaaatcaatacaggacattccggaggaaattgcggagaggaaattccgcaaaatatcatattaccatatgggtgcctttct

SEQ ID NO: 30429 - DNA, 1213 bp, Heterodera glycines
  misc_feature (188)..(188): n is a, c, g, or t
ggggttgaaaagtttattggggaaaaaagactttcaaaattatacccctgggagaaggagtgggaaacatgatttaaaattttcaatttttctagtctatctactcaaaacggttcagaattcaataaaaataacattcacggtgcgaaaaatggggtatgaaaagtttattggggaaaaaaagactntacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttaaaaattttcaattttttctagtctaatctactcaaaacggttcagaattcgataaaaataacattcacggtgcgaaaaatggggtttgaaaagtttattggggaaaaaaagactacaaaataatacccctgggagaagggagtgggaaacatgatttcaaaattttcaattttttctagtctaatctactcaaaccggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatgggggttgacaagtttattggggaaaaaagactttacaaattatacccctgggagaagggagtgggaaacatgattcaaaattttcattttttctagtctatcta

SEQ ID NO: 30430 - DNA, 1468 bp, Heterodera glycines
  misc_feature (91)..(92): n is a, c, g, or t
  misc_feature (156)..(156): n is a, c, g, or t
  misc_feature (164)..(164): n is a, c, g, or t
  misc_feature (167)..(167): n is a, c, g, or t
  misc_feature (180)..(181): n is a, c, g, or t
  misc_feature (190)..(190): n is a, c, g, or t
  misc_feature (192)..(192): n is a, c, g, or t
  misc_feature (200)..(200): n is a, c, g, or t
  misc_feature (210)..(210): n is a, c, g, or t
  misc_feature (221)..(221): n is a, c, g, or t
  misc_feature (243)..(243): n is a, c, g, or t
  misc_feature (252)..(253): n is a, c, g, or t
  misc_feature (268)..(268): n is a, c, g, or t
  misc_feature (271)..(271): n is a, c, g, or t
  misc_feature (278)..(278): n is a, c, g, or t
  misc_feature (280)..(280): n is a, c, g, or t
  misc_feature (285)..(285): n is a, c, g, or t
  misc_feature (315)..(315): n is a, c, g, or t
  misc_feature (319)..(319): n is a, c, g, or t
  misc_feature (327)..(327): n is a, c, g, or t
  misc_feature (329)..(329): n is a, c, g, or t
  misc_feature (340)..(340): n is a, c, g, or t
  misc_feature (343)..(343): n is a, c, g, or t
  misc_feature (351)..(351): n is a, c, g, or t
  misc_feature (367)..(367): n is a, c, g, or t
  misc_feature (390)..(390): n is a, c, g, or t
  misc_feature (403)..(403): n is a, c, g, or t
  misc_feature (406)..(406): n is a, c, g, or t
  misc_feature (418)..(418): n is a, c, g, or t
  misc_feature (423)..(423): n is a, c, g, or t
  misc_feature (425)..(425): n is a, c, g, or t
  misc_feature (428)..(428): n is a, c, g, or t
  misc_feature (452)..(452): n is a, c, g, or t
  misc_feature (458)..(458): n is a, c, g, or t
  misc_feature (485)..(485): n is a, c, g, or t
  misc_feature (487)..(487): n is a, c, g, or t
  misc_feature (493)..(493): n is a, c, g, or t
  misc_feature (507)..(510): n is a, c, g, or t
  misc_feature (515)..(515): n is a, c, g, or t
  misc_feature (526)..(526): n is a, c, g, or t
  misc_feature (542)..(542): n is a, c, g, or t
  misc_feature (549)..(549): n is a, c, g, or t
  misc_feature (556)..(556): n is a, c, g, or t
  misc_feature (1409)..(1409): n is a, c, g, or t
actcattattcagtatatattacaatttgaagattatctttacaagttaacaaataaaaaataataataatataatttaacctaagacaannatttataaataaaaattaataacttaggaataaatgtaaaatataaattttaatctatactatnaatgtaanaanttgaaaagagtannggtttgatntnaaaaaaantaaaaaatanttgaattatantaaaataaattagtttatttanttaaaaagnnttaaaaaataaaaanggnaaaatananaaatnagtatttttaatattgaatttaattaaatntaanggtaaaananttattaaaaanagnttaaaaanaataaataaaaaaaantggattttttaattaagttatgnaaatattaatttnttnaggtttatttanttatngnaanttatattgtaaaaaagaataaatnaggtantttgttttaataattttttatttgaananatgganaaggattttaaaannnnaaagngaaagataaanaaaataataaattaanttatatntaaaatngataaataatataatagttttaataaataaataaataaatttctgtatacaggaaaataccattttatgggttttgatggatgaaaaatacctatataaattttagatgactcaaaattcataaacacttaatcaaaaaaccggttaagcaaaaatatattagattaatgaaacatatttacgagtaaaataccataccattaaatatataccaagccatactcaatttaaatcacataatgtcattgatttacaaatattcgagcatcattataacgagtgaattaatataaaattttcaattatgaataatttttataaaaattactttaaaatttttcttatcacaaatttgaaaatttgataaatgtttaaatataaatatttattttaaaagtgtattgaaagaaattaagtaattccaccgattcggctaccatattacaatgtcaggtcatcgataacattttaaataattaattttaataaatgctttaaattaattgcaaataaaatacaaataataatttaaaaaattaatttgttatactttttttcagtttgattttgcttgacattaaaaataactttttattgttttttctactctttttttttgttaaatttatttcttttttgatttgtgttataatttgtttgttttagatatgaaaagaattagtattggttaggtaattgtaaatggaaaattgtatttggtaattatacatatattaaaaatactatttaattgcctttttataataaacaaatcaaaaaacatattaagattttttatcggatccgtttaaagtaaaattttaatcggtttcttattctggacttaaagaanagttcttacgcaattgcgtgaacacaaataaagtttaatttttatttcgtttcaaatag

SEQ ID NO: 30431 - DNA, 1579 bp, Heterodera glycines
gtccaaaagattttttcagcatcaaaagttagcttacaattagaggaatttttttctttcataaatagattttggttaatttaagaaaatttgaaaattttcttaataaatagtaaaaataaaattttccttggagtttttccaaaagctctaatttcctcaaaaaatgccaaaatcgtaacttagtcatttttggaaaagtcgccgcaaaaaaagcggtttatatgttttggtttctttaaaacattttttgtgaatttttcccgcgattaaattccgttttttaaataaatttaaataaaaaatcattagaaaatttttttttataatcacggatcacggaaatcacggggattttggggtgccgtgatcacggttcacggattttttttaaagccccgtgatcacggctcacggatttccgtgattggaaattcaatcacggccagccctggtccggacagacatttttcaaaaaaaaaaacttgaaataaatttgtataagaaaattttaaaacaaaattttttttttcaaaacgggagtcacgggatcggttctcggtccattttccaagtcccggtcccggttatttcaaattccgggcctatttaattttttataactattaattcaattcaattaggtgactggccaatactgtgaccaatgtttgcctgaacactatgggtttggcaaattttttaaattaatatttttattttatttatgtaaatatcatttaagtctgtccaatggcacaaatggttgcaaacattgtgactgtgatcttggcggctctgaagtcagtgcctttaattgaaaattaaaaaaaattattattaattaatcattaaaaatgaaaaagtttattattattattattataaaaataaattccgaattttttttttattaataacttaaaaattcaccgcattttttattttatttattaaatattttgtcaatccctttttgaagagtacccattgcactgctgaagaaggcaaatgcaagtgcaaaccgaactttgaaggacgccgctgcaatataaccaccagtggttattattgcccaaccatcgacgaattcactttcgaggcaaaaaaaagcaaaacacaaaaacaaatttccaattttatttaattaaattgatatttaaatatattttagggttgcttcccgaccgaccctccgggagagaaaaaaagtcgggaaacggggagggaaattctcacaaaaatctgtcggggatggctgtaagaacttaaaaaaagatatcggagaacgacagcaacggtgttggggaatatttttcataaaaagttgaaaaaaagagaaccagaaataatttatttaataaatttctaatattatgtatgattaaagctttggtaacaacctaccgtgatcttgagtcgagagtttcggtcttgactcgaaaaaagtctcgaattttcagtctcgattcccgagacttttccaaaccacaatatgggctgttttcagccaattaaataatttaaaaaactctggaggtttttccaattttttatttgttttcatcttcttcaaaaa

SEQ ID NO: 30432 - DNA, 1025 bp, Heterodera glycines
cctacaaaagtatagtgaatttaaataaatgcatttagcattaaccccttagttaaggaacaagcaaaagtcttgaacaaaaaagatcgaattaattacccggatcgtaatcacaaaccggtaccattaaaaatattgataaattaaatgacaaaaaaaaaaacaattttccaggaactagcttatggattgacaagatttgagcttctttgtggttttcggccatccgacgaaattgcattcaatatgaaaggtaaaaagttagatagaaaatgatatgcgcctactgatttggataaagcttacccggctttataatatatttacatgagaaaatttaataataaaatttatttataaaattaaacgaattattttaaataatattttattaagcatttcctgaactttgtcttgcaatgggcaatgaaaattgtgcgcttttcatcgcagcaaatgaatcggagaacacaggctttccagatctttcacagttgctaaaaagatggtgggttaattaaaaaataataaatattaatttgttttatttaattttagtttttcctgcatgatgaaacaagataaaatgttcgttcgggatattatagactccttgataaaccgaattaaaaatggaggtattacctacacatattttaccgaaaaagttgcttttatattgttacaccaaatttgtcaaaaatgaaagtatccttaattatataaaatttaaaaaatatggctttttaagttcatggctgtctgacgcaggaaactgtcaacgttttgctgaacctttataaggtttaccattcttaaccctgtgaacactctttcaagtgaccataacaggattagccgaaataaaaattgaagtcacaataaatattttcaaaataaggacatcacattggaaaaaaagaccaactggtgcagccggagaagaattttgaaatttttgctcgctttttgacatggatttttcagcttaaaattacatttatcgaagaaaagtggaaacaata

SEQ ID NO: 30433 - DNA, 1015 bp, Heterodera glycines
cgctgaacacatcttcctcagccacgctccctctcgcgctgcctcggcttccgcttccgtcgcccgtgccgccctcttccacccactcctccgtcctgcacatgcgacttgcactgactgtcacccatttgctgctcgtttcgcttggtcagtcagtcggcttttccctttgatccccccaatgtccaggaagtgttaatctccttgtcatctttgtcatcttaattcggccttacatgcggtccatcaccaatgtttacatggtatgaaaagaaaggcaacgaatgccaaatccctcacagatttcactttgtttggccgacttcatttacctgaccaatctgacgctggtcgccgtcactcagctcaacgacaagtcgtggcctttctcttcctttctctgcactttgtacgccaacattaacttcttttagttttccctcgtttaggtatcacgggactgaaacgacaggtaccaaccgactcggctaatgatggcacagaaattgctttaacttaacatatgccatcatttttagtactttacgccacttttgcagcttttccttaggcaaatacgccagcgtaatgttcgtcgttctgttggccgtcgaccgttactgcgccatgtgcaagtccaattggtgcgctcgctaccgcacgtaccgcggcgcggtgctcgtgtcgcttgccgcgtggctgttcgccgcgctggccgcttctccgttgtatttctttgccgaagtcgcgcttttgacgcttcgttcccccgtttcgcctgcgaatcgccgcgaattgcacaaattgtgcatcgcaaaatggcccaattctgatgtcgctcgatggtatgcccacttttctttcgttttacgagaatgggacggagtggcccctcgggagtactctcgacaagcctttgtttttcgttccctttaaggtacattaccatttcctctgtgctgatcttcgcccttccgttggctgtcatcttcttctgctactatcacattctgag

SEQ ID NO: 30434 - DNA, 1717 bp, Heterodera glycines
ccacatattggtcgatgcttcaatcgaatcgtccccatacccaaaaaattcattttgcattgatcagacctgacataaatattattacaaagggactgacagtcattaatagcggctcgcctgcgcgtgccagaaacaaataaaagcggcagagggcaacccaaccatggaaccaaaatggatttggaaaggaacacatttggcctttgccaatgaattgttgtgtgaccgaaatggacttttaagggaaaacagcacaaaagaaattcttaccctaaattctgaacgaaagaaaatggaaattgacccaacatttgtaggcgatttttctagggccatggtcaaagacaaagatttggaaaagctgaaggcattaatcgaagaattttcagatgtttttagcaaattcaggtacgatcttggacttttcacagccgctgagcatcacatcacaaccacaactgaggaaccaatcgcatctgcgccaagacgaatgccgtacaaatacaaagaggaattgaagaagcacattaatcagcttttagaagcaggagtcatggttgagtctgacaccccatgggtaactccaattgtcattgtacagaagaaggacggtggaattcgtccttgtttagactttcgcaaactcaacgaagttacggtgcccgacaggtaccctctcccacgccttgatagcatcatggaaagggtcggaaattgtcaattttacagctctctcgacttggccagtagctattttcaaattaaattgagtgaagaaacgtcaagaaaatgtggaattataactgaagacaaagtgtaccaaatgattacgatgccatttgggctgaaaaatgcaactgcagcattttcgagggccatggctatcgttttgtctggattggaggatacttcattggcctacgttgatgatgtgctcattttcacaaaaagtccgaacttttcagagcacctaacggcggtaaggaaggttttggagcgttttcggctttacaatctgaagcttagcccgaaaaagtgcatttttgcctcaaatgagatgaattttctcggatttgttttaacagcggaaggttttaagccaagcttaagtcgaatcgaaattctcaaagaaatgccagtacctttaaatgttaaagaggtaaaaagggtgctaggacaggcaggcttttacagacggcacattgagaactttgcaatggtcgtagagccattgctgaagcttacgaggcaatgcaataaattcgaatggggcagggaacaacaaaagtctttcgacaagataaaagaactacttactcaagccccgagtctaatttttccagattacgacaaagcatttcacattttcactgacgcatcatcgactggacaaggaggagttttaatgcaaaaagatgacgtgacgggcacattttctgccatttcctattgcaacagaaccttctctgctgctgagaggaaatggccggcagttcaaattgaaatgagtgccattatttatgctttaagggaattcagaccattcatcttcatgtcggacattgaacttcacacagatcacaaacctctcgcgtttttgctgaaaaaatccgaaccaatcagcaattggcacgatggctcattgaatttacaaatatcaggtcaaaattgtccacgtggcagaaaagcaaacactttggctgatgcactttct

SEQ ID NO: 30435 - DNA, 638 bp, Heterodera glycines
  misc_feature (616)..(616): n is a, c, g, or t
  misc_feature (629)..(629): n is a, c, g, or t
gtgccctaacagcgggcattttttgattcgggttttagaaaaaaagttaggggccctaaactgcaagaaaaagtgagaaatcggtcccggggactcagtcgtccgcgctaaatttttttctatagttttcccagatgctcctcaaaaagttgtaagacccttccaccactttcagggcgctcccggccttcggccgggagaaaatggttttagcaacgaaactccttgtcaatataacgtatatattaactagcgggtgcgtgaaccgtcggctatttagctgggaaaaagcgcttcgcgctttcggagcttcgctacctaggctgttacgggggaagaggtacaaccacgggtgggaaggtacaattgtgatcagaagaggtacaactacggttttttcagggatttttaggccgcttcgcggcctcgaaccggcgctttgcgcccgtttttaaaattttgtcgtcctctgacgggcgcttcgcgcccgtttttaaattttgttttgctttgacgggcgctttgcgcccgtttttaaattttgttgggccttttcgcccgcttcgcggcatagtacgggcgcttcgcgccatttttaaattttgttaggcttatncgtgcgcttcgcncctgttttt

SEQ ID NO: 30436 - DNA, 1234 bp, Heterodera glycines
tagtgttttttgcactagcggaccgcgggccgatagcgccttaaaatgttaactgcttgggttattaacattcctgacataaacggaccgctaaaacgcatcggccgatagctaaaaacacaccaaaacacttttataatatttaataggcactgaaaatgtttaaaaaacctcaaaaaaaatgttggcaaagcttatttatcaaaaatcaattataaataaaaattatccttttttgccaatctttccgtattttgaaccagttcaaaaacaagttttaaataactcctgtacaaaatatgcaaataataactaaaaaataaaatttcattagcttggttaattgaccttaattccatagatattaattaattttaatgtccaatattatttcgtcccaaattccatgggaaaaaatcaaacttatttttgttgcttcactttttttaatattattttatactatcagcaaaggcaatgatgatagttcatctatgttcagcaggtgtgtttaatttttaggatttactaacaattcgtccgggaccaaccgggaattttcccaagagtcgggatttctatttttcaaaaaccgggatcgggacctgaaaaacccgggaattcccgacccggtcccgatcccgctaaactctacattataattaaattgattagcaattttacatttttttttgcaaaatttgtgcttggaacaatagtgatgttattataattttttaaaagtaaattacactttaaattatttttttagtttttcgcactcggatagcaaagtttgtaaagaaaatctaacggatgaagaacatgaaaggtatgctgaatagaagtttttcaatttatacaaattaaaaaaatcattatttaaaatgaatttatatttagggactttttaaaaaatccgggttgaaaattcaaggagaaattgggtggcgcagttgatggagaaaaagaaaaatgtttaatattttttaaatgaagataaaaaagaagaaaaaaaaactaaaaatagtggcaatttcaaaaaaaaggcaaaaccatcgctgagtagtaatctccgacccctcggggaaggaaatggcggagattttcgagaaagatggccatcctaattaaataaatttgccacaggcttttcccgaagcattccaaatatttgttcttggcatatgaaggaaattgtggcggactgaccaatcaattggtaaatattttt

SEQ ID NO: 30437 - DNA, 989 bp, Heterodera glycines
  misc_feature (31)..(31): n is a, c, g, or t
  misc_feature (64)..(64): n is a, c, g, or t
  misc_feature (82)..(82): n is a, c, g, or t
  misc_feature (927)..(927): n is a, c, g, or t
aatatccaattgttgatttgtttttaaaaanaattcaaatgagggctcataataaatttttttnttgttttcaactttttcnccataagaattttttcgctttcacctttttcagcagctatttaacaatttttgacggcttttttaattataaataattatttatatttaataaattattttccattccaaatgattcccttttacaggcaagaccctttgggattggatcaaaaagccccgggcgcgtttctccgactcaatcgaccggctcaattgccacttcgtgcctttagtcctgctcttcttcgttgccatgatctcagcaaacatgtgagaaacctgcaaaatataaattgaaattaatttaatttataaataaaaaaatacatattttttaaattttgattgctcgattgagaacgggttttatccaaaaaaatgactaatttattttcagcgatttggaaaattttttgaaaaacttaattattggtcataaaattttgaaaaaatcattaaaaaatatttcaaaaattgtttaacggatgcaatttaaaattcatttttcttttatccaaataaacaattcaatttaaatattttattttacccatatttatttctttggtttcttttcagtttcggctttggcggcatggagcccatgcgttgccttgtaaggctatcgatcattaaaaatgattattaaatatttaaaaataatttttaatttaaaattgcccctttcccccacatttcagcgatctcccgaactgaatgaggaggagcgcgagtatgcgctggattattgtacatcaaaaaaccagtactacgtcgcgccggaggagggcatcccgtgggcaaatccggagcggcgggcacggcaactgggatattaccacgtgagaaaaattttttaattanatattattttttgcattttaatgaaatttttttttgatttgatcattgactaattcaaactg

SEQ ID NO: 30438 - DNA, 945 bp, Heterodera glycines
ccccaaacggccccttgaaaaaattgttttttttttttttggggcagtccccccaaaaggatgcccccagatttatggggagacggatccttcgggaaatagcttccctataccgtgtacttaaattctgcgtgggatttttgctccccatatttttgagagtcccccaaccggacactgaaaaaaatggttttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttttgttttcggggcagtccccccgaaccgatgcgcccaccctcaagggaaaccgaatccttcgggagtagcttcccgtatagatgtgacct

SEQ ID NO: 30439 - DNA, 1511 bp, Heterodera glycines
caattagattgaaaacatagttttcgtcaagccctttctacccagagccatcaagcccaatttgtacggtgattttcttattgacaagtaatgactgttgtcattatacattggacactctgctgattgatatttatttgggtgatgcgactggaattcgaccaatgtaaacggattgttggaggtaaatgcaaaaaaaataaaaaataatatgtatgggtttgccgtcttttgcgttcatcatgactcaagggcacataggatccccatttataaatgcaattttttttttgcctaattacctcattaattgggatggtggttgattgatgatgattgactttaacttttaatgagtccgcgcaccgattcgccactttgttttcgtggtttgttttgccaaaatttgctcaaaatatgggcaaatttctttccgtacataagtgtaaacaaaaaataattatggatgaatttttctcgtttaattgcaatgaaaaattaatccgttaacaactttattcatttcatttttttaatcgtaaaattaattttaaaaagtttaattatatttttgccgtttttaataaaaagtttaaaaaatttaaaaaaattgcttcaccaatttattaaatttaatgaatttaaaacggcaatattacagaatgagaatatgcatgctatcaatgacataattacacagaatactgtacaaatctggggtactgtatatttaaatttataggcaaagattaaacgtggcttccgcgcaggcgacgccgacgcgttgcttcaattggggctgcagctcgtcaccgatctgaatcagtactgatcagaaaacaaaagtatctcggtgaataagaacatattttaatcgatgaaaaataggcaaaactatgagaaaaactgaaattattggcacgattgttgaatttcatgcaaaaaaaacaggcactgaagtaaaataaaaaaatagtaaaaattattatttttttttaatttcaatatgtagcagaaaaactgtacatcatttttcaagtggttcttttttggcaattttctcatctaagctatgttcaaaaattctatttctctatctctggccgaattaacgattgagaaaacaaaaaaatttgtcgggtgccaggatcagtaagtaatagctcttctgtaaaatattatgagaccccttttttccccggatattgcccggtatcattttcgacacgcatattttttccattttccgctgatttgacgaatttctaaaatgcgcaatgaacgacgggatttataaaagcgtcagctacgaagcaagctttacctggatggtcacctcgccaatgccgtccagctttgtgtacgcctcctcaaccaccgtcaaattgcccgcttcatccctgcttatcgtcgtcagcttccaacgcttagtggcacagtcttgggcctttatctgtgcatatttttgagagcggatcagtttaatgaatgttaattatataaattaataa

SEQ ID NO: 30440 - DNA, 1394 bp, Heterodera glycines
aatggtacagtaatcaagaatccattagacggtgatcagttgatttctccattgaattttgttcagtccgtgccccccgtgcgactcggaggacgaagttgtgctgaaggtgggccccgagcagttcactgtctccaagcactttctgatgtccgtgtcgcccgtcttccacaaaatgttctccgtcgacatgttggagaaggcacagggcgaagtgagcctggaggaaaccaacggggaggagttcggcgcgtttctggacgcaatctcgcccaaaatggcatcgccaaatcgtaaaaagaaaatgcacacaaatgccaaaaatgttccgctgttcacacagctgccaatgtgatgggaatgctcaaattggccgaccgtttccaagtcgatgcgttgcgcaaccgatgcgaggcgcatctgatcaattgcgtggagatcagtctgatcgaacggcttttgtgtgcggaaatgtaccgattggaaaagctaaaggtcctttcaatggtgccgagtcgttactcaaaaaccatcaaatggaaaatttttgatagaaattataacttcgcccaaaatgaatataaatttaaaatcttgatatctttcgatagccctaagtgttttctattgtcctgcataatttcaaaaaaattcattaagtttcaaaaaaagttatgacctgagaaactcaaaaaccaagtttttttttgttgcttttttggtcataactttcttgaaacttaacaaaacgattttaaattttgtaggctattagaaaacacttagagctatcaaataatatcaaaaattaaaaattggttgcttttgagcaaagttatatcaaaaattattctcatttgatggttttgtgtaacgtcatagcaccctttcaatttgattacaatttcaattcaaaatgtattttgcttcgttagaatttcattctgaaaagtctgaacggcgtcggaatgcgcgagttttacgaggagaatcaggcggcactgaatttgctgagcaaagatttgctcatccaactgacagttcgcatctgttccaggtcattcccattagtcagtttttctctccaattacattgaatcaaataataataattatagctaataaattcaatttttgtttccatttgatcaaacggtttctgtgaattaatttcttttttcagttcgaaaatcgatcggtcggcactgtgccataattgcacgaaaaatttgaatgaatgaaacgtaaaaccgaagggatttgaagaaaataaaagctaatgtttatatttaaaaggaattttttgttttgtttttctttacaaatttaaatattttgatttgattataaaatattctttatgtgtaaaataaatttcgaaatttgagtttttt

SEQ ID NO: 30441 - DNA, 1899 bp, Heterodera glycines
gagcggtctatgacaaattgtccggctcacaatcagcatcttctgctccgccctcttcttctgttgctggcgccgggggtggtgccgattccaatgtttctgctggcgctgaagttggtgccggtgccaatgccactgacccattgtcctccgcttgttgtggtgccaactccgccgactgtccaatgtcctcagtttggtgtgccaattccgtcgtctccccctcttcctcttccccctcctcttcgtcctcatcctcgtcaattatcacagagattatttttcgttcctcgtcatctccatttctgttgttgttattgttaccgcttttgtcctcatttaatgatgatggtccacatgaagttccaaaaccaaaatcatgttccatttttatttgtttatatctagttttctaattttaaaatttgcaaaatttttaatttgttaaattcaacgattttgtttttatttattagcacaactatgttaatgcttaaatcgccggcatggcgtccggcacagctgcttagagaaaagaacaatgatgtttgtgtggaaaatgtccgtgagccaattaacgagagaacgaagaaaaagagagaaataaagaagagatgaaaagaaaattataatttggcgaaatgtttgaaatactgtattttcaaaatcattacaacattttcttccttaacagtagagttgagcgggaccgggacgagaattcccggtcctccgaggtcccggattttgaaaaaatatcttttagactttggattttgaattttatcaaaaactaaaggggggacgacccttttgttttgtaaaaaaaattttttgataaaaaaaatctagaatatatttattcgccataattgtgtttgttatgcttaatattcatcattatgtgtttaaataaacaaaaaaaaattgaccaaaaaaggtgcaaaattttcaaaacagtcctcttttagacactagcgccggatttttcatttcaggtattttagtgacaaatgaagattttttatggctgaaataaggattttcaaaattttgagatcgaaactctgccttaactttttggtggcgcacctgtttggaattaaaacgactttgacagaatttttaactctaactatgaatttcgaattaactcttaatacatatgccctcgtttaattattatgcaaagcatggtcattaattagttgggatgtttctcttaccattaccaatttctaaaagttgttcagcaaaatttttcgcttcgggatcagtccgcatgttttggtgtaaattaaaaattttaaaatgagtccacaattcgcttttttgtaaagttaaatctaatatttcacttttcgttgctttatttttaataggcaaacattgccgaaagtcaccacttaaaattaaaaattttcctccaaaaaccaatgtactattatgcaattctcgtaactttttgtctattatttcaagaacatatttaggtgccataggtgcttcgtcgaaaataaaaacatccgtatttctgatttcgtttgcttcattacacagcggcccaattttgggctccaagtacaattatgctggatttttatttagtaatcagaacgccaaaactttgcaaaacttaaaattttccggggattttcccttgtaaaaatggaagagccgatctcgagttagaaaatatactttcaaaaaacaaaatagaattcgatagagggggtcgaaatatgggcctatacaaaatttgaagaaattttaaaagctagaaaatttttttgaaagcgacgaacatttcaataattttaattcttttttagccaagtccacaatttaaggccaaaccaaataaaatttacaatattctccagaattttcccttcaaaa

SEQ ID NO: 30442 - DNA, 1413 bp, Heterodera glycines
  misc_feature (20)..(20): n is a, c, g, or t
  misc_feature (1382)..(1382): n is a, c, g, or t
gggagagagagctcatttcnagcacaggattcatatacacacgcggataaaggggtttggttgggtgatcgagggggaaaaaaggcacaaattgagggaagtgcctataactgaaaagacatacgaagaaaattctcaaaaaaattccataaaatttagcttattaattgtttaacaattgaaaaagtataaaaaaataaaaagaacaaagttttaagcaatttcagcaaaattcctttcccacatggtgctcaattggaaaaactcgggatttctggcattcgttgcctgacgctattttttagataaaagacattttttaaaaccaaaattatttcccgatttggaagtaataattttaaacaaaagatttttccattattaattataggactcggcagaacgattttttactccaaaaccaagtccgagtgtttccgattggactttttcgagtgaaatggtacggtgataatcaattcaatcatttttcacttttttaaaattattcataaaataattctttaggcaaaaaagaataataaagccggaattaaaggtaaaataaatttgaaaagaaatttaaatcagcgaaacttttgagaggacactgcgcaacagcaaaggtcgatttggggtgatttgaagaaatggatgaaaggtatagtcgtaaactgtaaacatttaccgttaattacatatttaacagtttcagaaaaaaatctaatccaaattaagtgattaaataaaaagaaatgcttttccttttaattttgaaatgaaatttgattgtttttttttaatttagcggacaccgagcaagagcctgtcaatgagcagcaaagctattttgatcaattgagacagctgatttttgatacccccgaattcgctccccatggattggaaacagtgaaagacgaagaacaaacataaagcgcaatgaatacgacgatcatttttaaacattccattttaccgtaagaagtggttacgatagtttcaagagtttatttatttatttgttgagaaaattttaccctaatttggctcttttaaaataataagaaaaacaaagtaatttaattctctctaaatcagtaggacaaagacttttaagcacaaaaatgataagtaaggacttaattagcatcaatattactaaattaagcacaaaaaaacaattaaggaaaaaacgaaaaaacattcttagaaggtatatttttttgaaaatgaaaggttgatccttaagggtgaattttttgttcatttatgttaagaaacactaccaagtctgaaattgtttggacttcggaaattgttaaaaaataataataaaagtgctaaaaataatattagaatttttatcgcacctagcttanaattttcattattttgctaataataattcat

SEQ ID NO: 30443 - DNA, 1776 bp, Heterodera glycines
aaaactgggctggcgccgaaacggtcggcgccgaaacgtttgggtcccaagatataaacgtatccaaaattacaagtaattattttgttgtattcaattaggggccggaagtgccaaatgtctctttttgctaatttttgaattgttgatttttgaaaatattatcttgcaaaagaataaaaaaatttaatttatacaaaaggcaaattttttattctttaggatgaataaaataaataaaaagaattttatcattaaggtcattttttttatattttccaatttacggaatttttgcatgtaaaacattcagaaattattatattacatacaaatttcaattcattttcaaattcatagaaatggcggaccattaaaattaataaattaagaaaaaaaatatttaaaatggacaaaatgtgacaattattttgttacttaaaatttccacaaaaggatcatttttgaataaaattattttaacaaatcagaaggaaaaagatcattatgtcattagatagacaaataagttttctatattaactcttacaatttcaaaaaaaaaaaattttttttggtttttgctttgtaaaatcacccaaatgttctaaccattttttacagctaattgggtcattccgttcgcaattttgaattttgcgcaacccaaatataacatccgatggctttaacaaagcacaaattaatccgacccatttattttattttgtgtgtcaatgtcaagtcgttttggtcataattactcatccaataagaagaaattgaagtatatttaagcgaatggataagtaagcaaaaccaaaattacaataaaactttatcattattttaaaaatgaaattttattgacaatgaaaacttttttaaataataaattatttttcgatatttatattttaatctataaaataataaatataaatttttcataagtttttttttggcaattttaaaatatttccattcttctattatttttcaaatttagcacagtaaaacaatgtctctcatgcgtcaactgctgacctttttgtccatcattttgctgctgctttccctcgtcactttgtccgatgctcaattatttggcggatggggtaatttttacataaatattaagatcaaattaaaattttaaccaaaatttattgtcaggatggaactccggcatttacatgcctggcttttactgtgcacatgccaaagtgtgcggataaacaaaaataaaccgaccaatgatgacggaatgtagagaaataatttattttttaaatttattttattgtacaaatttcttttgttatatctattttaaatagcacaaattaagatattcaatttgttttggtaataaagtcaattcatatcattaaataaatcaatcacttttcctattaggaaaatactaattagtaaaagtccgtagcactttcatcacaacggacactttgacacattaattaggtctttgttttggtaaggaccatcctaaaacagtaaataaattggagaaaataaccaccacaaaaaggttgctgaataacaaacaaattaggaaaattttgcgtctctcaagaccaatcatggcccaatttgagtgaaaacacattctattgagggctcccatttgcgctatttctacgatttgtgtatttgaaaaaaaaataaattttaccggcagttttcagcacagcggaaacctcaaaaaggaggaaagcaagaagctaaaattcaaatacacaaacccgaattaaa

SEQ ID NO: 30444 - DNA, 1828 bp, Heterodera glycines
  misc_feature (29)..(29): n is a, c, g, or t
tgagtttaatgtgcttttttgaagtcaanttaggataccctacccatgccaatcactgtttaggacccgctcaccggcgacttggtttctgttgcggtcgctcgtcaaacgcgggcatttcttccgcccgccaagttcgacccgttagcaccgcaatgcgccgagaatcccgatgccgaaatcccgtccctctacgatgtctctgtctttgagaacaaatcgcccgcatttgggccattgctggagataccgacaacggcaccgccccagggcttgtccgaacttggcacaattggactcggccgagagtttacatcggtaggcgccgcgagccgaaattgcgaacccattagaaccaattgagaacggggaattttaattaggttgacaaatggcaaaaatttataatttttaaataaatcaaaattattcaaaggttgggcgatgtgaagttgtttgttttacgcccgagaagaccggcagttttgacacgttaagcccttctcgggcacggacagtaattgaagtaataattaaaactaaatagaattcaattagcctgcctattggatttaattagcctttgccatctttgcaatttgtccttttgcaaaggcttgggccgatcgcaccgccgcactttccgccatgccaaacattcagcaggtgttcccgttcgaaaatcggggcgaggtgatcggcgtcacgcttcaccatccgcacggtcaaatctacgcttacccgtacattacgccaagaacgcaggcactcattgcttcgctagaccgatacggtaacgaaaaaacagctacagtaatttttgcttaacagaaaaaggacagaaaaggaacagctgaactgagagagagagagagagaagtgagacagatagagagagaagaagtgagagagagaaagtgagagagagtgagggacagaagaggggggagggagaaaaaattactgtcaaaatctttaagatattaaaaaactctaccaaaaggatagaacttttgaactttttgaaaataaaaaaaattatatgtagaatagtcggctacccgacttttgggaatttgcaacttggggacccgacttttgagcacccgtcttttgggaattccgacatttggggcccgatcgacatttggggattttaataaaacaaaaaaaaaacattaaaaaatttaattttatgtccaaaattagacaaatttacgtctgctttagccagagttaatttcattgaaaaaaaaattttttttgattaattatgttctccggactgagatttcctttgctttttacgcccatggaaaattcagttattaagaaatgattgtattgtctgaatctaagccaattgaacaaaaataatattaaaagagtcatgcgagataatttactctagacattgggatccaatgtcgaacagaatcaaattgaaaatcattgcgtcgaccaccactctttcacgaatattagatgcgatcggatgctcacaccattggtgttatttgctaaaactctcctgtgttgacctattcccactgaacgggcatccaactgctgatcacttaccatcgaacggcactgatcaaacggcatcctcaccatacggacgaaatgcttctatgatctgacgattcatattttgtgacaacgatttcaatcatcggccccaccgggaacgaatctcgcaaatcacaccgcgaaatcatccaacggcggaagatcacacaaatcctaacggagggcaaaatgtaacaacatgttcgactttatattgattcaccatgcacaatatcagatgaaaaatattttagaa

SEQ ID NO: 30445 - DNA, 1153 bp, Heterodera glycines
  misc_feature (66)..(66): n is a, c, g, or t
ataatgggatgtataaaggcgatgtagatggaatggaagcgctaaattgttgagagagcttttgangcgtaattacgatttttacttacaccattttttgctaggcttagatcacatgcgattttcggcactctgataattttagcgttcataatgggatgtataaaggcgattgtagaaggaattggatgcgctaaaattgtttgagaagctttttgagcgtaattacgatttttacttacaccatttttttctaggcttagatcacatgcgattttcggcactctgataattttagcgttcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgttaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgttaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttgaccattttttgctaggcttagatcacatgcgattttcggcactctgataattttagcgctcataatgggatgtataaaggcgattgtagaaggatttggaagcgctaaaaatgtttgagaagctttttgagcgtattacgattttac

SEQ ID NO: 30446 - DNA, 1599 bp, Heterodera glycines
attcattacccaaaagttttttacaacccatattgccctctcatttcttgcagattgaaagccatccattgcctgccggttctcggcacagcaaagcactaatacggtgtttgacacacttcaaaaaataattcattacccaaaagttgtttacaaccacttattgccaatctaatttcttgcagattgaaagccatccattgcctgccggttctcggcacagcaaagcactaatagggtgtttgattcacttcaaaaaataattccttacacaagttttttacaaccacttattgccaatttaatttcttgcagatttaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatacggtgtttgactcacttcaaaaaataattcattacccaaaagttttttacaaccacatattgccaatctaatttcttgcagattgaaagccatccattgcctgcggttctcggcacagcaaagcactaatacggtgtttgactcacttcaaaaaataattcattacccaaaagttttttacaaccagttattgccaatctaatttcttgcagattgaaagccatccattgcctgccggttctcggcactgcaaagcactaatagggtgtttgattcacttcaaaaaataattccttacacaagttttttacaaccacttgcttttttgtccatttattccaatcgactatgctttaaggttttgtctttgactttgcttttttgtccatttattccaatcgcctagtgctttaaggttttgtctttgactttgcttttttgtccatttattccaatcgaccacgttaattcattctctatacatttagtgtcttatttcatgaaattatatataatttaattttaaataaagaggcaaatttttacagaaaataaatagacgctgactaattagctaacatttataaagaaagtagaaatttgattaaatgcatatacaaaatattacttttttaaaatttgtataaagttcctagtcgtatgtgctttgcgttggttggttggcgtgggtgagtgtggtggttgggccgtttttgcgatattgtggctggaaaaaagatgcgatttcgctatggggagcgcggccgtctgggttcaagtgcttgcttgcgcttgtgctcggcattgaacggtgatggctgctgctggggtgccacctttgtcgtggcctcagtttctccagcgattggcagctgtcgaaatgaataaaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctaagagttcgtggatcggaactccttgcctggggacccagtgt

SEQ ID NO: 30447 - DNA, 1633 bp, Heterodera glycines
  misc_feature (6)..(6): n is a, c, g, or t
gcaagnacataagagtaatatttttactttccctaaatccaaaatctaaaaaataatgatggataacagaaaaaaacaatttatggggaagaggtgaagggagcaaaaaaaattatcaagaaaaattattttttaaattgctacgaatgactttaaacaacatacattcagaattttcaattttattattttttttaaatgggatttgaattatctttgagtcattgagctggctgatgataattaattatttgcttaaattttcaaaattttgggcagcctatattttgaactcgttttttatgtgggacaaaattttttcaaaaattgaaaaagtatagaaaattggaaaatccaaaaatattttaaagaaaccctatgggatggaaaattaattataaataagttttgttctcagctttatcctgcagagtttgatgagcttctgatcatttttcggataattatttggatttaatttatctttaaattagtaattaaaaattcagaattacgggagccagagcatcatagaaatagtgcaacaacagttattaaatggaataaacaatttggaatgattaaatttataaccaagaccaataggcatgggtttttgcattaacttaatagtcgggtgtctctttacattttaatcgttttcctttgttttggtgattactctttttctctaattctcttctctctcctatggtgaatgcgcatctctctgcccagggggggcccagatttctgtccctatactactgcagtcctttccttttccgcccgctcacctgatggtccacgcccgaggcggtcgcaagcagtcccccgctgtttgccagctgaacggagggtccgtcgtaacgaatctgtcggccggacatatccgataaagtgccacctaaaagtggcaaaaaactgtttgttgtaaaaaaaacaacaatttctaaaaagtgtaccggcagccattagcaatgcctcgggcgcggcaatgtcccattttttggtgccccccgcggcgtaaacaaaagcagtggccccctccaaacagcgcaacactttaaagcccgcgcctcctgcgcgttccacttcgctgatcagctttttctcctccaacgcgtccaatgccttttgcacctaaggcggaagaaggaaaaaataccaattatattcaattaaaataaaattgaaagaacaaaaagctgttcgaccaattcggagcggctacggaaggtaatgacagcgacccgcggcggcatttgttcattagctaaaaaaaggggggggggggggtgagaatattcggcagctcccggaaaatgcgtcaattccgaattcctgacacaaataaaaagtcgaaatacaaatttaaattttacccatttttggttctaaaatgcgtaaataatctcttattgcaggattggtgcctttcagttttgtttccgtgtttttcaaccgattttgaacaaaaaacgggtaaaattgaaacttggactttcgacttttagttcgaattcggttccgggattcggaatttcaacgaagttcttacagaattttactttgtttacactacttaatgctacagaactgttttaaaaatgtactgatagattttccggtc

SEQ ID NO: 30448 - DNA, 1411 bp, Heterodera glycines
  misc_feature (12)..(12): n is a, c, g, or t
  misc_feature (61)..(62): n is a, c, g, or t
  misc_feature (66)..(66): n is a, c, g, or t
  misc_feature (142)..(142): n is a, c, g, or t
  misc_feature (1404)..(1405): n is a, c, g, or t
gctactcgctcncgcaaaaagttttgaaaattttgatggttttgggtttggagaaggcacnncctnggttcgagtgcacaggtcgagttcattattctgttcaattatgtagaattttgaaaaactcttccgttcttgttgngagtattaagttcgacaattttacggaccctagttaggttagtcactgggctttttcttattttcctatgccaactttgtcggtacaaaaaataccaattccgacaatcgcggaaatagcaacagaatacgaccaacaaacatcacatgcattttaagaataaaagacaaatttatttaaaatttaaagctagaaattatattaattgtttgtgtaagttggtcttaatgaaataatttcgtaattattattttttatctttaatgatgtcatgaataaaaaattttgaatgcaaatagaaattatatgttggcaaataaatgaagaaatggccggaaatggaaaaataaaaataaatgataaaaaacattaaaaaaaatcggattctgtcgatgtcttttccactctctctctttggccaactatttactctaatatttcaaaataaatttggcatcggagcatataaaaagcaattgaaaatgccgaaaaaatatatctatcatattttcatttaaattatcctcccaaaatgcgcaccattctcttcatagccatggtttgcttgctgatggctgtcctaatggaaatgggtgggcaaaaatattttattaaaattataaaaaaatttataaatttattttttttagcaaattcaaaggctgtcaaaaaagacaacaaaaaaggtcaaaatgaatttcaatgtattttatataattaaatattcccttaaaggagcagtggcggcatcaccagcaaaaggaaaagcatcgccaaaaggaggcaaaagcccagcaaaaggaaaagcggcaaaaaaattgaaacctaaaaaggatgctaaaggcattaaaggtggggagtgaatttaattttaataattttaaattttgttgacattttgaaacagctaaaaaagcaaagccagcaaagaaaagcaaagcggcaaaagcagtaaagggagcgcctaagacaggcaattaaataattaattaattatgcaattaaatagaaaatgtagtcaaaaaactcgcatttgccaaaacagcagcgcaagtgaaagaaataaagtcaccaggtaaaaaccaattttaaatttcgaataattataattagagacacttttgcagaattttaatgtttttaaaatgtttatttagccaagccaatggttctaaaagcagtgccgccccaccaaatgcatttaatgaatgagaaaggtatgcttcaagagccaattaattcatattttaattttccaaaannatgact

SEQ ID NO: 30449 - DNA, 1366 bp, Heterodera glycines
  misc_feature (48)..(48): n is a, c, g, or t
  misc_feature (57)..(57): n is a, c, g, or t
  misc_feature (60)..(60): n is a, c, g, or t
  misc_feature (64)..(64): n is a, c, g, or t
atcaattctcctttttatattgtttttttcaccgccctcaaaggatgngatgggagnggnggangagaagatggcctttaaatgcttcatcgtgaacatgctcagccgcttgtaccgccgacttccatccccactcatatccctcaacaatttgctggcaaaccccctcaattgcctccccaattcaacatacctccgccctccgtcccctctcatcagtttcaaatgcaacctcctccattggtgccaggccaatttcaccacggatttccatccatgggcatggctccgccttcgctactgcaacagcagcagcaacagacgccttttacacaacaaaagccgacacccatcgctcctttggcagtgcctccggcagcgaccgctccgcaacagcagcaggtggtggacaggccgactgaatgccttcctcccgccagaattggtctttacgtatcatttaggctgttagtccgcctccgcttagccaacaagcacagcaaagcaacagcgacaatttggacgaggagcagcaggcgcaaatgcttgtgagtgttcaaatgaaagatgtccttttatatagtagtgacaaattacccctcaaacaaaaaacgatcaaaaaactcagtaatttcggttatgtgtaaacggattttattaaaaaaagcaacaaaggccaaaggaattcacacaaataggggcacaacatttggcggttgcctcttttaaatttcgcgctgttttcacatataaccgaaaagtaccaaaaactcaatcgaatctcaaaaattcaagatccgcgtgctgcaactcaccgatgagcaaattcgtatgttaccacccactgaacgtgcccaagttatcgaattgcgtaaccaacttagaagtgcggatgcaaatgcgtgaccatatcaaatcgcactgacagaggtcgaaaagccaactgatctcttctttctccatcaacctatttttatataatgtttgatttttttgttgttgaaaatcaagatttaatgaaaaaatttttactaggtttccaaagttttttttatgcttgacccttttgctagactattcggtaaggaaacatttgcaaaacgtggataagaaaaatattcatttaaaacaaatggtaaaaacagcatcggtgaggttaaatatcattccgactgtatcttttctggcgcaagctccataaaattaaacaatttataggtttttggggtcgctgatcatgaatccagcatccatttcgaacttgtaatttgttgcaaattcctcgtagtaagttttggagctcatccattgattttgcaattctttagataccagcaattttggtgaaaaatgaattccgactttt

SEQ ID NO: 30450 - DNA, 1626 bp, Heterodera glycines
  misc_feature (1588)..(1588): n is a, c, g, or t
ttttttaatttattccactttttttactatttccgtccatctctgggaaagcgattactttttcagattaccgttttagtggacaaattatccacaaatgggcaaaacgtaggtgaatcatcgccactcattgggcaaagcagaaaattccgatgctaatttgtgcttatgtgggcgaaacggacagaaattgtggggccatcagcagcagttggggatgggcaaaatggtgattcgccacttttggcattggaattcaaaaagccaatttctgtgttaaaaaaaggcggacagattgctgctaaattgggctggggcccccgcaggcggacagatcggtcaaactccgcccaaatgagctgcataaatagccgctgatggccaaaaaattaataatatgattttcagtccaatgcgccaaaatttgatatcatttaagatgtaaaccttgcctcaattgaacaaaacccaaaaaattctttagaacttcctaaatggtcttaagacaaagggaccctaaaccgagtccgaccgacccgataactatggatggaaccacggatttggcgacgaacggacaaagtgcatccaaaaccaactcattggcaaaacaaaactgagaagaatcttttttgatccggaaaaagcgacaggcagcagacacacgcagttaataatatgcgatagatttttcagtccctaattgcgcccaaaatttatgtcatttaggacataaacctggccaaattggaccaaaaacgaaaaacttctgtagaaatttggatttaaaatttgtcttaggaatttctggatcagttcttgagaacgggtttttcaaaagttggccgggatcgatccgggaaagacaccagaccgggaccggatgaccggtactcaaatccagtttttaattgtattttttccaaaaatataattgtcaattctgctttaattttgtataaccaaagtcagataacgccgacattttctgtctgaatggatgccgaaccggcggctgttcttctcgtgcttcatgaatttgagcccgcttgtcacaaagcaggtcaaaatttgtcttgccaggaatgccaaggcgatgattgttgcaatgcggataatcttaagctcataggatgctcctccagtgaaagtcacggtaaataaaattctattgattaagaaatatttaaatttttcaatttcttaaacaaaaaaattaaattattttattttttgaaaagtgttgccgtcgcccattcccggacatttgcaaggtggtaaatgattaatcaaattctttctatggatgtaaactaattggtctaacaattttgaaaattttcaatttttttcgaatttttgcacaaataccatttaaaatccttttaaaagctttaataaaaattagaatttataaaaaaatttctttataattttcaagaaaaaaggtaagaaaaattattgaaaaattttaagttgcgcgaatggaggagcttcttaaaaattatgaatgcaatctgaatgataatcctcgtccctatgactgcttcgattggttttgggtaaattgtttttccaattaacaganattagtatttacatagtccaatgtttagtttgctcgaa

SEQ ID NO: 30451 - DNA, 1302 bp, Heterodera glycines
  misc_feature (1257)..(1257): n is a, c, g, or t
  misc_feature (1277)..(1277): n is a, c, g, or t
attttggggtcagcattttgcttaatcataattaaccgttgagaaagcagaaaaaagataatctaatttaaattatgtaggttatccccctccttttggagagcatgagaaagaggagaaggatgatgagaaagaaggaggcgaaaaagaagtcgaagaagctggagatgaagaaggaaaaggggagagggatggagacgaccagcagggcggtgaagagaggcggaagaagaagggcacgatgatgacgaagacgagagggttgattaagaggaagagcaacaagaagaaggagaaaaagtaacaaaaaaattttaacaattccgttgcccaaatgcgtggttttcatacaacgaatcataattcggtcaaatgattttgtaaaaattataataacataaaatcagtgccaacgtccaaacccaggaaatgttgaaaatgaggaaattggcactgggtactgcctgctggggctcaccttttggtatgtttattgctttgtttggggctagttaaagaccacaaacaacttgggttaacacttattttttgtcccgatttattttatttaactctgatttacataaatttttgaagtttgtttgcataattaggtttttggatttggcggcaccacccaatgctaatgacaccgcgacaaatgccgaacagagcaacattgcggtcaaaattaaccttgacgggttcgtcttttaactaattgtctgatctaagctataaatataatttctattttcaatttaaacagaaaagcgcttaagcaattaactgtgccggagttgaaatgtgaaaaagaattgaacgtcgtccataagtagtgaagaaattaattgatttatgagaccctttaaatgccatcctcatattgacttgttcatttttttgttataatttgaattttaaaatacaattcaaatatgcagatttttactttttaatgtaatttaatttctctcaataattgaaacaataacttttattcataattttctgaaatggggattgattcttaaatttagcgattttttgtttcaaaagtataacaaatataattgagatcaataattaaactcattttgaaaaattatttataatcaatcattaacacagaaaaatgattaaattaaagagctttttgttcttgcgcatttgactgaataataaaaattaagcgaaaaactagattttttcaacctattttttatttttaattatttttttaaatagaattgaacncatttttcaatgtccgtcangatttttggttttttcatttttact

SEQ ID NO: 30452 - DNA, 965 bp, Heterodera glycines
tgggtaattaatccgaagaaagaagtgcagtgtggaagaatgacgcccataatgaaggaaatatttgattctgtgcgaactctttgtggcccctctctgactctccaatgcagcagtagaccatttttaccactatttttctctcattcatcgtcttctcgtctctcctttattataagctgttttccaaatccaacaacacccttttctccctcttttctattattcatttctcatttttattaaccatccaacattcattctacaaatttattaaacctctcaacattttaaatcaaaatcctaataaaaatttcatttaatttcttcacctcttattactccaaaattttctaaaaattaatttactatttaaaattaaaaaattcataaccaaattcaagaatttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccaatgcagcagtttacaattttaacaactatttttctctcactcatcgtctgctcgtctctcctttattataggctatttttccaaagccaacaacgcccttttctccctcttttctattagtcatttctcattggtgttgacgatccaacattcagtgtacaaatttgataaacctctcaacattttaaatcaaaatcctaatacaaaaaggttgaatttcttcgcctcttatttgtgcaaaatt

SEQ ID NO: 30453 - DNA, 1354 bp, Heterodera glycines
  misc_feature (1312)..(1312): n is a, c, g, or t
  misc_feature (1325)..(1325): n is a, c, g, or t
tgccttctcacggttttcagcaatctgcaaataacaaaattatttgaaaaagaaacatttaaacgaccttgggcattttgttcgtgtctttggccaattcaggtgaaatgaaacagcctaaggccttttctccagtgcatttcataatggcacccaatgcagcaaaggatgagtccctcacttcggaatcggcatcaaagccatgctaaaaggccgaaaattaggctaaaaagtttgaaaaatgtgactttgctcagaattgccaccaaatccttgagcaaacccttgggaatttcgttggccggaagggtacggaaaacgcggtaaatgaacaaatccgtctgtgatttctgactcggattctgtttggaggacagagcctcgagcacggccttgcataggtggtcgaaactctataaaaaacaaattattttttaaacattcatttcgattggattatccatttttacggtatatgttgcgatgccatcgatgcactcgacgagcgcatctctgagcaactgtttcttctccttgaacttggtgaagatcaccgggacaaccaacgacacgtaaggagtgaatttggaacgcaatcccttggcgaaaaacatcacgcatttggtggcacttgcggcgacaatgatatttgcatcatttgccatagccttaaatatttaaataaatataattagattattagaatccattcattttttgatggttgaccttcgtcagatgttcgatgacctcccgataatttggcgaatcagcaagtcgcggcgattgcaacaacaattgttgcagtgcgtccaatgcctcttttctttcctgccacttttgactttcgaaattgatgttcaactttgatgagatgtctacaggctctattaggtcataaggatccatttgggatttaggcgaaaaaaatgtatatgaaaatggtagccaactatctaaatgggtcaagcccagtgtcagcggtaggggtcaactccgtctggccaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagtttaaaaccgcaaaaaaggcagaattttcaaagttttttatttctatctttttttatagttcgaaattttctgtaatttttagtaggctaatagagcctgtgaagagctttcgaatgatatcaagattgttttgattcggtcaataactccaagangtatattgactcnaaagtggctcagaccgagttggcccgttc

SEQ ID NO: 30454 - DNA, 893 bp, Heterodera glycines
  misc_feature (861)..(861): n is a, c, g, or t
gcagttgctactaaatttgaaatttggatttgcccttcgtttctcgagttttgttttcttgtgtattggtttgctgatactttttgaatgggtcttggacaaattaacttgttgtgatttccttcacaattataacacatttttccctacaatttctaatttcgtgcccttttttcaaacagcgatggcatctcccttgctcatccataatttttattcgagagtctctgtttaatatttgcctgcaaagagatgcccaatgtggtccttcacataagaaatatttaggatttggcaaatttgttctattgctctgtttatttcttatttcttgtgttaaaaaaccctttgattattttgaggatttctttcttctcttttaatatattctctgttattatttctgtaccgattattttgccaattgcttcttggcctattgaattgtctttgtccactatcccagttttcatgttgtccaccaattgctcttgttattttggtacatctcattgcttcttccctcatggttattatctcttctaatcccttaattaattgttcaacattccattcaattccactatctttctctgcttttaacccttctagaataattgttctcggaaatttatttttgattgtcatcattacaaagtctttatcaccggcaaatcctaaattgtttaactgccttacgactctttctatgtcttctaaacagatacgaagtgataccacagactcatttgcttgtgcaaatttaaaagttcattttgaagtgcttcttttatcactttctcatttccgaaaagtctttttaatgcatttacgactaaagcataaatttcctgctgtcgntgatagcctctcattgctcgggaggctttccc

SEQ ID NO: 30455 - DNA, 1565 bp, Heterodera glycines
ttttttttttgtcctttaaagagtaatataatacatgcataacacattccccgaatctcacattcattcgtccattttcattctttcatcagcagaagcagaaacaggcaaattgatgggtgggagaggaagcgccggggtaaaaagcgtaaaaaagtaaaacaaaaaaaattcgtcattcattttcaacattttcacattcatttgacgaaagagagagtgataaagggggaagagagaagaaaagggggagagagagagagagaaagggggaagagagaggggtggagaagagagagagagatgagagaaagggggaagagagaagaaaagggagagagagaggggggaaaagagagagagagagagagaggggtggagaagagagagagaggggggggggggaagttaaaaggagagggatggagaggagagagatggggaagagatgagagagagcaagagagagagagagagagcgcaagagagagagagacaacatgagagagagagagagagatagagagacatagggagaaagagagcaaaagcgagcgcacacaaagcgatgtgcttctcttctttcgttcattttggccgcttttcctattcactttttttttgtccaaaaaaaacctgtgtcctcttcccattcattcattccttcgttcaaccaaaggccataagccctccgtcctcccgggggatgggctcctatatgctaaagctaaaatgcacatatacgacaaagaagcaacaaacacgacacgacgggagagaaacaacatgtgttctccttttaccacctcctcttccgtcgtcccctctgagcgcggtccttttgggtacaacagtgccgttttgaaatttgggtcccacaaagctaaggaaggccatttgagtcctacgccatagggtcatttgtgtacatcaaacgccgtttgggctccaggacaccgccatctgggtacaaggcaatttttttggcaccgaggtctgggccaaagccaaggaggtattttttgggcatgtccatctgagtcccaagccagtcttttcgtaagcgccgatttttcatcgcaaagcgaaaaaatatagcaacaaaatatttagaggcattttgtgttgcctttattgcattcgccggtccatgtcacatgtgttctgctgttggttgctgctgcggttgggccctaagtgacgggactcaaatgtccggctggccttggccaaccgccggcggggagaaaaaggaaatgggcgggggagggaaacgacggatgactgacacttttagcgagaagagcgcatcacacaaaactgctgatgcgaacgaaaaccccgaacttttgtgatcaaaaatagaagtgtgattagaggcgcacgggggggggaggggcagagtacggggccagagccaacaactgttgcgaccgacacacacacaaaattgtgattgacgggcgtaccgctgggggacgaatgatggatgggagagagggagagagagggaaagaagcgaaaattagagtgatcggtgttgaactttgatcttggagagagtg

SEQ ID NO: 30456 - DNA, 1190 bp, Heterodera glycines
  misc_feature (20)..(20): n is a, c, g, or t
attaaaatggcatttttttnattgagcattaattaaataattgaatcatgtgccagttattattattataaatttttaaaagagaaaattataatttctaaatatttattcaatttcactttcatgattttctgccaaccttttttcagttcagaatgccaaaaaagtaaaataatcgccagtttagtaaaatttagaaaaacgaaaacaatgcttgaagtttaaaaatcagacaaaaaatttttgaaacaatttaacccaaaaattatgcattattttaaatccatttcggagcattaattttgtttaattaatttttgagttttttaaacatttactgactatcaaattatcagtcagacccagtcactttctatcacttatataatgctgtttaggctatcagggattgataaaactaagtttgcacccgattttgggtatagccagcaaatctgttgtgcgccaatatcggataaccaaaattgcatctcccaattttttaaattttaatgccaaaattctgcaaaaaaaaaaaaatactaggcccaaagcaagttcaagtcgggctccacgtgctgcaccatcaccgactttcccccatgggtggtgaaaatggcacagaatcagccgcgcaaattttcgccggaaatcattcgccaaggcgaggcggtcatcccgctacagtacggcaccaacaaatgcgcatcacagaagggcatgacaccgtatgggttgaccaggcaaattcgaatggactgattgagaaagaagcgatcagaaagtgatcgaagagtgatcgatcagaatcgattgacacaatgataaagctggacagatggttgaaattgataaatgctaatgaatgaatgatattttgtctattaatccagcgttgggatcgtccaaatcctcttcccaagtacagctatgccaattgacaagtacatcacgggagaaatttgtgaaatccaagtacataatacaaaattttattaacacgttattataaaagggagaagtttattcagacgtccgaaatatatagcaaatatgtataaaaactcccaaatatgtaaacatatgtaaataaaatttccacctattttgttcacaaacacgtttttcctactaattaggctatggagaatccaggaaaaaatatgtatttacataaaaaaggaagccct

SEQ ID NO: 30457 - DNA, 1836 bp, Heterodera glycines
agctaaaggcaaaaaagataaaatattagatgaaattgtacttaccgtgtataaatagtggcaaaaaatatcatttcattaaattgtttgttcaccccaaagtctgacgccgtattccgtgccaaaaaacaacaccaaaaacacttcctgtgccaaatgaacgaaatatttgcaaaaaagtgatccatcggcggattggacagaccataaaataaagcatttcagcggcatattttgcgtaactttcaacggtggagagaacactgagaattaaacagaagaaaaccaaacagaagacactgaaagtcggcggttattatttgatggtaattaataggggtaattaattgaagagaataattagtggaattaattgaggagggaaatcagcgtaaaagggaatgaatggatttaagggattacctggaatgatagagaaagcaagcccatccggaaggcctttctgataacaaaagaggagaaaagcattagcaatgatttaatagcaattaataaatgaaaaccgacccaaaaagttgtacacctaaaaagggatttgcgtttgaattggcattgaatggaattgcccttggccttcccctccccccctttttttttgctcttttcaccttactctggcagagtcggcttcgccgctttccgttctcgaattgttcgaaatcggtcgtcgaaaatctttaacattggcataaattggattaatgcctccagcatagttgagcagaaaatgccatggcattcgcctggcggcggaaatttgtgccaaaagcgaaaattgcgccattttatccgctttttgttttgcccatttaaacacgcaaaataattttatgagcattaattttcattcttacgaatattaacaataaaaccggggctaccagatgaaaattttcaaaagccccatttgggggatatcaataaaaatgatcattgaaatcatatattttcattcttcataatgcatcgttttagctttttgtcagaaattaacatcatagctttccaaaaactataaaataaccttcaaatcatcattaaaaaagcatcaatcacatctcactaaattgagcaaaaatctttattgaaagccctgaataaaaacccatacaaagtaaaatagaggatgaattttgtttttagtattttaaattgttttttggttttgacctggtgatatgtccacatttgtcaatttttaaaaagaatttgttgatttttttaattattatttaataatattccaaaaataatttcaaatttgtaatgtctcccaaaatgccttttcattttcctctccaaaattggcccacctgctcaaataaattcccgtggatcactggcagcgggggacagctggcgaccgcggcagaagcactctctgcgctcggctgacgtttcattttaagccgatgagaaacggagagaggggaaacttctgaggaaatgccaaaaaagacaaaatgcaaaacgatcgacaaaatattttttaacggcatgaaaaaactcttttgctgcgtgagaattaaaatttaagggtagaaaatgccatgaaaaataaaattgtttgtgccgctcgaagacggggggggggggtcgaatttggagagataaaccatcaaacctttgagaaatgagtcgtaatttaatgaattcgatgtgatgtgacctccatgatttggggccgaaaaaggttcaattaaatacagtaagacacccgtttaccgggggacttccgttgtgacggccggtgcgctgctggaacgaaatttggtggccggaaggttgaaaaggttggaagcccttgaggaaatg

SEQ ID NO: 30458 - DNA, 1160 bp, Heterodera glycines
gctcatcagaaataaaattttacaaatttttaaatgatttttaaatacctcatattctcggtggtgcccattcagtgattttcccttccaatttccaattctgggtttactctttctaaatattaaatgatattattttgcatttagtaaatatgtcaaaatgaaagcatatttcgctcagaagtatagttaaccttaattgtccttgattaaactacaaaatttaaaaaaatcccagatttcaaaaatgtttataacaaacaataaaaaaattgaacttttgtttgaatttatttttttgttacaattgttaaaaaagataataaccttttatgggctggtcaataaaaaagccataatttcgtacactgagtttttttcgccaatttttcatcgtcccatttggtatgtttaaaatggtggaaatttcgcaatttggcattttcggaaacactttcttaatggcaatttgtttgcagacaaaatccaatttttgtttagcgctcattttttctaaataaagaaaattataattaaacaaaatttgctaaacaaaaactcgtaattagagaccgattttgaggcatatgccttttttctgcgcattagttccgatatattaagcataaaaaacactttttccacttgctttgaagattttattttgatttttattatgccttttttgcccctttcgggattttcatgcctttaattacttttttggcattttgccgttttgatgatgcaataaaattgggaaaatacacctctaagaaatgacccgaaaaaattacagaaaatacacccctaagaagggaaaaattttcttaaaaattgctcgcaaaaattaaatttttgttttcttgataaaaaattttaggattaaaaattttccttattcgaaaaaattataaaatatttaaatgatgaaaattaagttttttgacgaagttttacttattttgctacctaaaaatcctttaaaaaatttaaatgtcttttttcatgccttattctggcttttcgtgcctattcatgccttttttcaattttttggtgcctattatagagccttttcgcgatttttggtgccattttagtagagacctgacaagagggtcggtcggtttttttcggataaaaaccgaaaatcgaaa

SEQ ID NO: 30459 - DNA, 1515 bp, Heterodera glycines
cacagctgctttaacttaagctgtgtgcattttagcctgttctacccgccaacttcaattgccaaaaatactgacgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagattatgtctatcctaacttccaacaactccttggcgatgacaaagagctgctcaatcgtttgattctcgctccgcacattgacacgtgtgatgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaagtattttcccacggtcaattgtatacggccttctctcgggcaacagacggaaacaatgtccgtgttcatgctcccaac

SEQ ID NO: 30460 - DNA, 639 bp, Heterodera glycines
ggtccgatggccacactggtaacggagaattccatcgccgcataagcagcatgcaggctgggacaacccagatccctggctttggccagctatacattttggacccagtcgaggctatggaaatgcgtcgaaacaaccccatatttactggggaaaatgttaaaaacgaagatgcgtttgtgcagggtcatgagcttaatgaagcgaccctagagcttttggtagaaatgatcaaaaagtatcaccctgctgcgcaagcatataagcaggcgcgtgagcagctccaggagctcctcaaaaaacacaacccggaagaacttcgcttcttccgtatgactttgttgaatgagcgcagaacccctgcagctctaaaagacccaaagctccacccgcatcaaataatcaccccttcaacgggtgagggaatgttcgcaattcacgcggacccgactggagtacccccgcaaaaggggatttgggtcgaaaacaggcaaggccgattgactgaaattgctcctttcaatccttggactgacagcttgacatacccattgataaagccattgggtgatgatggttatattactggcattaaatatgctaggccgccatcgcgaaagcgaaaagcgatcaagatgt

SEQ ID NO: 30461 - DNA, 1410 bp, Heterodera glycines
tttattcatgtgaattatgataatatggaaaatgtcttcatctcccttgtaggcagtcacctttcaccatacttcagtgtccctttcacgaacccttcttatttttattgtcctcgactcttctaaagcagatcaaccgttgagaccatgtccgatcatccgcgtgaagcggagcgaaatttaaaaagaatgtgtgtgtgaataaatcaatttcttaactgggtcacccgaggtcccgttcccgatcatttttaaatgctagatccagatccaggtccagtagggcaaccgggaaccgaaaaaaacaagcactggtaagaatgagggtcatggagaaaattaatgacccgggaattgtgaggaagggaaaatcttggagaaaaaaaaattttttttttgtattttcaccttagggtcatctgaaatgaaaaagcaaagaaaataataaaattttacaaaattttcatttgaaaataaaaattggcttctttttttaatctatttttgggaaaaatttctggttgctcccggtttcgtgcgagaattaaaatcccggtcctgtggcattcaacttttatatatttattaatttcaaaaattttcaaatcccagccatctttgtgacgacgtctgacgcgacgttttcgactgtttgtggcgtgctcaactcggcctgaaacttgcgactgtcaacggccgtttcgccgctttggtggcccggcatttgaggaccaaacgatggatactttgccacattggatttaggagaaataatgagcaaaagtgtgctgaactgagaaatattttgacaaggaatgtaacaagattggcagaaagaaatatacaaatcggcgaagatgtacaagtgatacggtcccctattttggatatatcaataccttataattttattggaatcagcagcatttttttgaggtattgtatatgctaaaaaattcataaaattttccatatgaaagaaaattgaaataattatccctgatctagatatccttcatttcctgtcagttacatagatcggagtgtcatagaattatctcacagtattcgccatatattagaagaaaatattactttgaaattgcggttctctggagggttatgctcggcaacctttaaagcatatatggcctttagatgttaagggaattgcatgtaacgactcgtcggaagttaaatgaattattagaatcgatgcaaaggaattgtaagtgcattattcgggagggtggcaatgttagaatcgttggaggtttcaatatcttttcgcgagagtccggtcataaagatggtcacggggcatcacaaatgccaggcatcgttcaagtggcttctcgccccgcgcgacgatgagcatcaccaaagtgcatagatactattcacatcaca

SEQ ID NO: 30462 - DNA, 1134 bp, Heterodera glycines
tttttcctggcttctccatgctctaaatagtagaaaaaacactttcttttttgtgtttcgaacaaatgttgggacttttatttacatagttttacatattcgggctttttatacatattttacctatctcgggattttttacatatttggtatattggactttttttctgacatattttcattttttttttacatattttgaggattttttatggaaatttatggaaaatcttcaaaaaaaatccaaaatttcgccaaatttttcgtacataatttcatttttttttgaatattttgagaatttaataaaactaattatttaataaaaaataaaaaatactttttagttaaagtgttcaaaaaatttattttttgactctaatcttaaaaaagtataaaaaaataaaaacaaaattctatatttctttaatatatatatattagtaagaatttttaaaaattaagcaaaaaataatttaaaaaaaaaataaaaaattcaaaaaaattattgaaaatttaagaaatttcttctgaaaaaataacaaatatttttttgaaaatgtactgctaaaaatattaaattaatttttaaaatgcaaaaagatgattataagcctaattaggttacttacattttgtgcctatcttaccctctactttacatatttgatatatattttgggttttttgtacatatttcgggattttttttacatatttatgtacatattttggccactttttgtacatatttttgacatccctaatgatcacatatttgtttgaaatttgttaaaaacgcattaaaactcaaaaaaatttctccagcaacgtttctcggtttaccgcccactgggcctcaaaatttccaaaaaaaaaacccacgaaagatggtcatttttgtctgaaaatttttttaattaaaaaatcttaattttcaaaaattccaagcggtgccaaacgataatgttcttttttgggatatatatattttttttttttgtaaaatttatctcacaattattttttttaatataaaataaataaaaaagaaattttttgagcgttttttttcgacaaaacatatgggtataacttttcttaaagcaatcaaattttatattcttggacccc

SEQ ID NO: 30463 - DNA, 1760 bp, Heterodera glycines
  misc_feature (27)..(27): n is a, c, g, or t
  misc_feature (70)..(70): n is a, c, g, or t
  misc_feature (189)..(189): n is a, c, g, or t
cagtttttcttctaaaatgtttttcancagctccatcagtacctgtccacgggtttgttcagcatcagcnaaatggtggtggatgacatcgcccatttgctgttggttagtcggcaccgttgatcgcacagttttccacagcatttctccatgcttcggcgctcgcccatcatcatcattatatctggngggtgggtccccccattcttttttctgctcctcgctctgtttaagtcgggcaattagcgtttgaccatgcgcgattttctcatcagtaccgctaccatcatcttgttttgcattggcagaatttgacttatcgtcaactaggtgcttctgctcttgcgatattttttcttttaacgtctcaccatgtgtttttgttgctgttgggattgtttgctgaccgacagctgctttatcatcatcgtccgtgcgcttttgttgctccaatattttctcacgtaatgcctccccatgcgttgtggtagctgcttgtggaccggcatctgctgtatcatcgttgtccgtgtgtttttgctgctccagtattttctcttttaatacctccccatgtgttgttgtggtagctgtttgtggaccgacatctgctttatcacctacttcaccatccgtactggcagagatgcctgtacgtttttttaacgcctcccttccgatcaatgccgacgcagtcggtgcagtaattgtatttgctgctgctgcaacaaactgttgttgctcatcacgcttttttgcctcaaattccagcgcagcgaatctctttcgtctgtactcaatcagctgttttgctcgatctatttggttttcgaaagaggcattatcctttaaccctactgcctttgcttgcatctgaaaatgttctgtaagacccctataattgttgtgaataatttgccaataatttttgggatgtttttgaaaaaattcctcaacaaatgcactattctgctggtggctgagctcctcatattccgacaaagattgttggtggtcacgctgaagcgcagcattttcaaagatggtcaaattgtgctgcatgtgttttatttttgtgcgtattttgccaacctcggtgttaagctgacgaatttcatttatatctttttcaccaatgtacttgctcatcacctcttgcagccccgagagatgttgggtgaatataagtcttgactcgttcaattttttgttataatcttcgggatgatgttggaaaaaatcgctaatctttctttgctcattctccggactttcctgatcacgacgttcagcagcacgttccaactcttccagctcatactttttcctctgcatacgaatccgtttgagtggaagctcgctttgtagtagttttttcctctccacatccgtaatgtctgccgaaagttcactctcctcctgttttacctccttttcaaactgctcttgtttggtgcgtaattcgccaatcttttcccaataatccactggattttcatgaaaaaataggtctgtgacctgccgtttcgtccggctagctccatcatggccagaagaaaattgctgctgctgctgctgatacacctcacgtatgaggctgttcagggtgagccgtaaatgttctacactcgaaaattgcgtgcttggaacctttagttctatatgcacgaaattttttgtcgtctaggaatctatagttcgggttaacggagtttaatgctgatgatatcgatcctcgatcaattccgactgaatggaaa

SEQ ID NO: 30464 - DNA, 1358 bp, Heterodera glycines
cttctaaaaaattatttttaaaaattgctaggtatactttccttggagttcctaacccgcagcgggagtcatacttaactatgtcatcagattcgtgatcagcgaccccgaaaaccccctagaaatgtttatatataataaaaacttttattcattttttagaatacatatcaattctttcacttttttaatggatcaattatcatcatcaattcaggagaatttgccggttagtttctataaaattaatgtttttggtaatagtgtacatggtagcattgtctatggggattttcaggcacgttaaataccaatctgacacccttttcgatcaatttagaaccacggaccctaattcgaacaaaaagtcgaaaattaaaattttcgagctttgcattttcgtctaaagacggcttaaacacatggaaacaaactgaaagccagcatttcctgcaataaaaattattttaagccgtttttagacgaaaaatgcgagattcgagaatttgaactttcgacttttgttcgaattcatctgaacttttttacccatttcccgagtgtttttggatcggctcccatctttgaactgtattttctctaaaaaaaaaagttttaagtgtgtaaatttacaggttcaaaacgccagtgatacgccagcagttgccgatccgtcagtgcagcttggtcccgatggttctgcggatgccggtaaaacatgcttgggtggggtggagtcacccaaaattgtgccgggtgtttagggccatataagtcgtgcctttttttactttcaatgatttgcggtacgatttttccgaaatttttttgacagaaatgtaacgggaaaatttttgaatttttatttaatttgcttaaaaattcattatagcggggggggggggggacgtcgcctccgaaatgtcgtcgggatttaatatcgccgcaaaaaaaaaacttgaaaattcgtgaaaaaatcaaaaaaaattttttttttgaaaattcattgaaaaattgctatttttttgtctctgtaaatctaacaatttttttcagtatcaccgagtgagggggacgaattcatattgacaaactcaattttttcaaaaaatttcaattcgcaggtactgttgacccatctgacgccggtgctgtgcatgtgccagcagttgccgatccgtcagtgcagcttggtcccgatggttctgcggatgccggtaaaacatgcttgggtggggaggtttcacccaacattgttgcggatgtttagggccgtattagttcgcgccttttattacttccaatgattcgcgctacgatttctccgaaattttattcacagaaatgcaacgggaaaa

SEQ ID NO: 30465 - DNA, 1224 bp, Heterodera glycines
caatagtgtctcacactccagtaggttctttaacgtctagaaaaattttctagcctttaaagtatatattttttaaattccaatcaaaaaaatttcgactgaaaatttaaaaaaagaaagaaaccaataaaaagattaaaataaaaaaaatggttttcaaaaccacaaaataaccaaaaaaactaaaaaaatctttgcagacgaaatacaatataataaaaaataattttttagaaaagaacgaaaagaaccaataaaatttaaacctaaaaaaaataaaaaaagtaaaaaaaaaataaaactaaaaatataaaagtaaaagaaaaaagaaaaaaaagatagtgtctcacactaaagtcacagaacaaaccactaatgttttatcaaaagcatgacacacaatagtgtctcacactaaagtcacagaacaaaccaaagatatgcatttctatttcattaaaagttcaaataacattaagcataaacataattatttcacgtaaagaacacaaaaacaaaataaacaaacaaacaaacaacaaccactaaatcaaactcaaacaatatactgataaattttttcgtttacaaaaaacaaatttatataacaaataacttaataaactatgaacatacataaaaaagcaaataaataggtacaattttaagaatgtttattgcaaaacaaattgaaaaatcaaaaccaaacattttcatttttcaaatgcttttttaacgcaaaacaaaacaaaaacatttatatttttcaaatgcatttttaacgcaaaataaatacaaaacgccacacaaattcaaaaatccgtacatacaaacactcaactttattatataggatagcgagatgtgaaattgagcagtcagaaaaatttcaaatttacgcgaaagaaacaccataattctctttctctgcttcctcatatttaaaatcagagcacaatttattttatttggtattattttttggataatgacgatggttgctcccattttttaagaaatttttctttgtatttaaaagtcgtgaaaacatacttccagcagggcttaccagggtcactaatcacgaatcctgcatccattttgacctatatcgaacccggactggaactcgaacaaaaggtcgaaaatttaaaaaatttcaaaatttgcttttatgttcgaatctgtgcagaatgattattttctagtgttgcaatggtttct

SEQ ID NO: 30466 - DNA, 1214 bp, Heterodera glycines
  misc_feature (56)..(56): n is a, c, g, or t
tccgtttgacaggtcaaattaagcccgttgagaagtcttctagaggcttaattggncatccaattacggtaattagccccaataaaattcaaattttgcaattgccacactttgccaattggccctcctcttttggactctcttcgcttttgggctcacagcgcaccacgcattcctttatgatacggtcggcgataggctcaaagtttgggcccaaaaactggatgccggtcaatccaatggcatcggaacagccccaattggccaacagttccacgtggaacacctgcaaatgagttggttttcccccaattgtagctttttcactgcttctccccccctcacttttccgacgatggcattttccgcctcttcctccctctcgtcttctccaattccaatatgggcttgacgtggaaagttttcgccaatgatttgtgaaggaacgcaaggcgacggagaagggcacggactggccgaagcggaactggccgaattgccggtggtcggacgcattgagggcgagagacggggaaggacaacggtacctaagatcctttgtcatcaatggcaagcggcttaagccagagcatctgccaattcggttggaatgatccccaaatccgtgccgggagataatgttttcttcggcagatatacggcgctttcctttgcaaatttgtgcctgatcccttccatcatggcattttctcccgttccgttcccctcccgtcccatatatcgcagtttttttctatgccatttcgtctatgttcctcccatccggcattttctccaatgccgtccccccccccccgcgtgtctcacttttgcccgtgcttttcctctcctcttcccctccatcgtacgccatcacttcgtcattctccgcaattcgcgccagaatctcctcgttggtggtgaacagaattgtctggtcaaacggaaatgcttttcacattttaaatggcttaaaacatcgccaattgacgacgaatcgacggcactttcgcctccaacggcacaacaaatttcgccacagaaaatgcactgatcgtccagccaaattcgaacatttcgaacgccacaaagtgcgaaatgaacatcggaaggacaaaaataattctgaaaattaacaaaatgggagacatacctaaattactgttacaaatagaaaagaaaatcggcaccgaaatgcgaatcattgccaatgt

SEQ ID NO: 30467 - DNA, 1155 bp, Heterodera glycines
  misc_feature (1126)..(1126): n is a, c, g, or t
gtggaagagggtttggacttttgcatattggttcttcttttgcaatttctattcgttgcttttttcgtccgattcttcggtcatttttccgtccttttcgctcccccccctttttttcaattttttccgaatttctcagaagagtgaccctcgccccccccccctctgttctttttctatttttggtcaaaatgtcgtcgtttgtccttatttccgtccactctttcgtcgtccattagcctttctctctctctctttttctctctctctttctctctcttcgcatattttgcccaatattttacgatttacggacaaaaagcgaccgaccgaccgctgagaagagagtgactgacagttctttatttaaaaagcgattgaatgtccaaaaaaagacagacggacggcggacagtgtttagctaaagacacttggattagagggtcattgggcagcagcagaggccattgggggaaaatgtggagggaatatggaaatttgggggggggggaagggattaatggacacagaaataaaaaagagaattagttaataatttgaatatttgaatttttgaagaattcctaaaaatttattagtgaaagggcgcagcggagagaatccggacggattcgagccgattaaattgtttgttgtgttgtcgttgggtgcttaattcgcaatggatgagagtggtgagagggggggggggagaaatgccgccggaggggaaacggcgacggacgctccggggacatatcaaaggtcaattgtccgatcatttcaccgtttgtccgcccatcgttcttccgtcgctgattaaatgtccaaatgtcctcccattgatccgccttctctccgccctttgcttctccgattctttgagaaagcataaaatcggagaaatggcggaaaattcgggcaaaaaaagtgggcgaaagtgcggcggagagaaaggcgggggggggggggggagaaacaggccatttggtcaattagcgcacttttctcaatttttgaataataaaacaatgattaaatgtcctcaatgttggaagactatatagccaaaaggcattttcaatgatattttggcggaatttgaggtcttagaaggtttgaccanaaaggttgaaggaaatgggtcggagagag

SEQ ID NO: 30468 - DNA, 1015 bp, Heterodera glycines
agattgccaaaaaaagagatagccatttttttggaccgccccaccctcacatatactcaaacggcccgaaaatcatttttatagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccttccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaagagatttctattaccagattgccaaaaaagagatagccatttttttgggaccgtccatacctcacatatact

SEQ ID NO: 30469 - DNA, 1111 bp, Heterodera glycines
caagttgtgtatttgatgagtgccattgaaggcgcccccaaatcttgcaggtgttttaatttaaataccgagagggcggaggggggggggggttaagtatattcataatcttttttttctatccaataaacttggcatcattcaaaagctcttgacatgctcaatcggctcaagaagcacaaagatatgccgacaaataaaaaaagttataaaaaaaatttgctcaaattcttacctttttgcggttttcgtgttgcagctttttataaaaaaatttaatcgcttaaattaatttctagacatgttcagctttcgcataaggtcagaccaataaaacttggtctatcaagaaaaagagtatgatgtttttgtcttaaaaattgagggccgaaaaatttcgacaaatcaaattccaatacgtttaaatcttaatactacaaaaaaataatatttttttttccaaaatttcccccaccccctttttaggcatacagttcaaaagaacatatccaattggagccttgggcatcaattgaaattgatggagaaattgataatgaaataaatcgggagattgattggaggaatcaagcagcttcacacactgattgcctcttaaaatatggagtaattaaaaaataataattaaattgatttaaatagcagcagacaaaaattccaagataattataattgaattaattaactaataattaattaaatagcaccacatactaattgccttttaaatatggagcaattaaaaaaattaattagatttatttaaattgcagcagacaaaaacgccaaataactaacatggtttcggaactttactttaatttattattttttttaattttaaaaaaattagtttatattccagttctttttttcctttttttaaataaatggaattcaacaaacaatgcgaaatactgaaaaatgcctggggtgtaaaaaaaaaactcggacccaaagcctgaggccgaatgaaaccgtaacactttgggtcaaagcaccattaaaattgatttttagtcatcaaaaaacatataaaaaattcttaataattttttagctattttcatttacgcttattaatctggca

SEQ ID NO: 30470 - DNA, 1521 bp, Heterodera glycines
  misc_feature (1403)..(1403): n is a, c, g, or t
tcgcctaaaatttctcctcttgtcattcctttttcccccacccggtttctggtttattttttagtgcttcaccatgctcctaccatctgcactactgtcttgttcatcaattttggcttttaatttatctcctaaaatttctcctcgtgtcttaccctcagttttggccttgctatcatctctttctttctgtacctgttctattaactcaaccaaagattttccatgagtttttgtctcttccccgtctgctgtggtggtagttccctcaatttttcctattcgttccttcagtgcttcaccatgagtcaaggctaaagccattggttgttgttggagtgcgtccctctttttagcttcatactctagcgctgcaaatctttttttcctataatcgacaagacgacgaagttgatcaatttcatcctgaattgactgttttttctgttcatcagtcaaaaattgttgttgttctcttaattcgcgaatttttttgtaatcgtcttgaaggccttcatattttttatgaatatgttcccagtaatctgttggatgactatcaaaaaatggctcaacgtaatccttattttgttcatagctcgtcctctcatattcttcagctgatatttgtaaatcctttttcaatacagccttgttaaaagcattcaaattttttcttctgtgtttcattgctgttctcatctttagtggtgtttcatttagttcttgaattgttctaccatctgttactccttggtattttttcatatggtcttgaatgttgaataaatctcttattaattctaatcgaacttcatttaatttctccctatagttaacaggatacatttcgaggaattcttgaccagttctctcctccttttcctccttcccgtcatctctttgccttgctgcttcttcaagcgcctctattcttgctttcttagtcaatgattgattttggagagggtcaatttcctcatcctctatttttctcttcctatgcgtgtccgtttcatcatcacgttctcttgactttgtcactatcaattttaacaattctttatatctttgcctttcttcctcaattttttcccagtaatcatctggattataatgaaaaaacaaatccactccatcttccaattgtcttttaactcttgtagccggttgttttataccattttttatcgactcatttatagcattttccaattcttgctcattttggtatgaccctgcgggaatatcaatttttattttatcaccattttttaaatgcaccttaatccattggttctctgtggtaccaatggcgggccaagaatttgtataaattatactgtgcaacccacacaaccattgacctccaaaagttagagttctaggcaaatgaaccctanatttattaggcttattgtcataaccaggagagtcactaggtaaaagaacgtaaaacaaatttgacatttattttttattaaagcataaataataaatactttaatacattcatctctc

SEQ ID NO: 30471 - DNA, 1903 bp, Heterodera glycines
  misc_feature (52)..(53): n is a, c, g, or t
  misc_feature (283)..(283): n is a, c, g, or t
atgactcatccttttttgtgcagctcacttttggcttcaacgttcgaattgnnccatctgcttcaattcattgcccctgtcagtttggcaatttccatctgaaatattaataatttttatcattttaatttttttaatttttttaccattttcaaccatttcgcatttttcgccgccgtaacccaccgggcaaaggcattgattgcaattctttgggtttgggtatcctcccttttggcatttgttttcggtgtttttgcaattttctacaattaattatacncaatatcgtatgaattaattcgatctaccgttgcaataaattttgttgataatggcggcgtctttaaacgaaagttcatatgttgagtgaaacattgtgcgttggtaaaaacggttcagcgtaatcaagttgtaatagctgattcattgccaaattattttcttttcatttatacctttaaaataactgacccgcttgttttcacagcagcataatgcaaaattgaatgaaaatcatagggaaagccgtaattttctgttttcgccggctctttttgctaaaatattaaattatgccagatttttaatgtaaaattgccagtgttttttatgtataaaattcatgctaacatttcgtggtgttggattccgtttgatgtatttgttggcatcgtctcggtcttgctcatgccagagggctagcgcatgcaaaaactcgtgggcaacagtatcggactgcaaattgagaaatgaacttaattaaattgataacgataataaaaacaaacatcggtacagttaattgaaacacgttgccattccttaatatgtccaaccccggatcggccgcagtttccatccttcgcgtcgaaaatttcaatgccttcgtccggcccatggctcagatccgtggtgaatgttacgcaagttttgtccctagtatagtttttgtttaaatgatcaaaactataaaatgcgggcagacccgaggaaaatggtctctaaataatcctatcaattctcaatttttaaacattaataattttgagaaaagtgttttatttttcgtgtttttaacagaaagcaaggaatattggacaaaagtttatctaaagtatctatttatctcactattcatcagcttaatcattcaaaataatcacatgattaattttatcccttgttcaacagcgacaacatatcgttgcggagtcgggtcgcccactgaattccattaagaaatagttataaaacttaatgcatacattcgtcactgaaatggatcgcaattggaaatttggtccatttttttaattttgactctgcctgtcttttccttctccgtttccccttcttttttggtgggaaacacggtgcgcacacttaaattagaaccaacataattaattaattagctaattaagcaatgtttttttctcatacagtaatcaccttccataaaatagtcgtatctttgttgcgcctgctctttcgtatataaaatatcgtcccaccaatccaatgggtcgtccgattggctgttactgctgaagcgtgacttttgttgctgagacggatttgtacccggaggcaccgcaaattcactctaacagaaaatgacagtacaattagcttaaattattaatttaccaggtcgggctttggaagtttacaaatgcatgggccagcagcattagagggggagcagcactccaaaactttccgagttttccgcagaatttcgcgtgtcgcctcacaatctttgcccagcaaatcgcatctcgtcggaatcgtctagtaatatttaacctttttctattttcattcccaactcttactttgttcggatcgttttcatatgacatcaaattcgtttcgttactgattcgccttgaaaacg

SEQ ID NO: 30472 - DNA, 445 bp, Heterodera glycines
gaggttgtgatgcaaaaacaacaaaatctctgcattttccggagtcaatctttttctcaaatcattaattattaatcctgtagcgctaataggcgctcactttctgctgacgtcgccggcacggaaagaaaacgatgcgcaagacatgtcagaagggggacccactcgtttgggcgctcacgtttggatgccagcctcagtttttggactataacttttttcattgttaaccaaatccaacattcttggtatcattcgaaagctactaacatgctctattagccttacaaaaaaaaatttcagcctgtaaaataagaaaaaaactcaaaaatttcgacttttttgcaatttcatgttatgacttttttggtaattgtctaatcgcgaaacctacctagcttagaaatagcttctaaacacgttaagctttcgaatgataccaaga

SEQ ID NO: 30473 - DNA, 981 bp, Heterodera glycines
  misc_feature (21)..(21): n is a, c, g, or t
accccccaggaactgtgggcncacaacaaatgcccatcgccaaaagttgcacattctgcattaactgttgcaacaaatccttttccaacaagcgatgaatctcagcgcaagttaaaaccaccacagaatggcaatgtgcacagctcgcaaaacaaagcaatacccgagataaaattgactggatttgtcggatttgattcgctgccttaccaattggtcagaaagtgccaagaaagcgggtacatttaactagcatttttcgctattttatttgtttttgtggccccttgcctctccagattccaattcaaccttttgtgtgtcggtgagacaggaatgggcaagactacacttctcgaatccctcttcaacatgaaaatggagtttgagcaatgcaaccgcgaactaaagacagtcgaactccgcgaaaagactttcggtattcagctttaaagactaacaaacacaacattttttaaagatgtacaggaaggggctgtaaaggtaaaacttcgggtggtggagactgctggctttggcgatcagttggacaaggaaaagaggtaattcataaagtttcgctaattgatatttgatgataaccccctttcccgcctcagtttgtcgaaggacatatctgagctcgtattcattacctgaacattttatctccaggaaaatacaaatataaaaaatttttcgtgggcacttcttcaaatgatacattaataaattttgtggacaaataaactgtttgagcatttttaagtgctcaaatcattgtgaattacatcaacgaccagttcgaggcctaccttaaggaggagctaaaagtaaagcgaaatttgtccagttatgaagacagaagaattcacgcctgcatttactttatttctccgactggtcatgggtatgggaaaataagttgtttgtacgttcttttttagcattaaggcattggacttgattactttgcgcgag

SEQ ID NO: 30474 - DNA, 1150 bp, Heterodera glycines
  misc_feature (40)..(40): n is a, c, g, or t
  misc_feature (116)..(116): n is a, c, g, or t
cgccgatgctgtttttaatgattaatttaaaaaatctcanatatataaatattcatgaaagattacaatttactcctttaattgaagctgtatagttaataattgcaataatatgnaaagaatatattgattaagttttaatttatataagatacaatttttgcatttactagaaaattcataattcatatttttgtcagctaccaattctgtcggagaggttgtaaagaagacctttggacgaatgattgttgtatgcaataataattattgatctgaattatttttgcttaaaaaacttctaattaatgaacaaaaataataataaaaaaaattattagtatcgcaaaatgatgtattttttaaaattggtgcgtaataggttcgggaggccatgtaaatattttaatataaaaattcactgaatacaaatattaagatataaattttatgttcaaaataaagcattaaatgaatttaataatgaaaatttttttagaaaaaatgaaaattgctatttactaaaaccaagtataagatttaaataagtagcaaaaggaaagaaaaaatttcttattactaataatatattttattaatattcttaaatattgcatttctatcaacaacataaaaatttttaagcttgaagtggcacttaaggaagcaaaagtacaagatgttggacgattagtaatagaataataaatctaaacaatataaaagaaaagcgatacgctcaatcggcttgcttcactttgcagccattgaacatatatcattttaaatttaaccgcgaattatcgccagtttaaatttaatcaaaattataaaatatatcaataatttagaccaaatctgttacctatatttagttaaaagacatagaaaacatttaaattacgttaaaccaattaaatctaaaatcgtttttggtgccgctatccttgtctcagcgtttttgtgggtccgaaagcgtgagtaaattaataattcttgttaataaaataatattgaaaaaatagtagcttttctgttctttttttttctaaggtgttataaaatcaacattgtgtccatttatatttttaatgtcgttagttttgaattatgcattaactttttattttgttttacttaatttattttt

SEQ ID NO: 30475 - DNA, 1114 bp, Heterodera glycines
ttttactcgtgaagctcaataaaacgccagacaacagactgcactttgttttccaaatccaaaattttggtgtggatactacgggattctaagttcaacttttttgcttcactcaatttcttaattaccttatcctctagttttgtggcttgatcgaggtctttacacagatcgacctcacgccatattgtctcaaccctttcagattcagcattaattttatcaagaatggtgtaaatttcccagatacaatctgacatctttacgaaccattctcgaacccccggggcatagggggccttctctcgggatttaattgcccgattaagcgctccatgggcggatttagcatactcatccgcttcatctgccaataccgaaacttctttccacgccctttcagcctcttttttgacagcttctatcagaattgctgtccctttttctgttctttgaatcatttttaaaaatttattatttatttttttggttctcttttatacattaatcagatataaattggtctttaaatgttggcctcggggagggtacggggagggataaatattccttcattgtttccttaactttatcggctaattctccaatcccgaggtcagattgagtataggcgttacggtacgcagtaccgacgtcctgtctatactgcttaacaatttcaaatgctcccttcgcttcgtctgccaattcacgacacattaacacatcttttctatccaaacacttatccatttcttttttgataaatcccattttctgtttttcttcgttaattttttcagaaattccttgtacttttctcaccccttccaatagcctaccgaaccatgttttcatgcccggtgcctcaggatgacgaattttaattttctctgcctcagaaattgccatatgagaagcagccgcgaaatctcgggcttcagtatttaatctgagcgtatcccgaaatgctttttcaatagtttttctagcagaatttaattgttgtttctcttcattagataggcaacaacaatcactatttatttggccgatgccaaaccaaaaagtacgaaggaaaactattttattcattttattttatttatttttt

SEQ ID NO: 30476 - DNA, 1213 bp, Heterodera glycines
aattcggccatttgaatcggatccaacaaggggcctaactcgaaacaagaaagaaaaaatatcgtggaaaatcgacagagcgatcaaaaatttgattttgcgatatgaatgatgaaaataggaacgatgaaacattattaaggcacctcagagctctacagtatcgactggtccatacaggaattcaagattggtagaattagttagaatttatagctctgtttgagtcttgagcaagcccaaattgtgaaatgaattatataggctggataaagttcggcgttaatttggagaaattaaatttgattatttttaagcatggaatttatgtaaaatttactaaatttatgcctaaataagtctaattttggttgagccgcaaatgtcgggccgcaaatgtcggaaaatggaccttaagaaatgggccgcaaatgtcggaccgcaaatgtcgtggctccaattgataacaattttagctgagaaattggaaaaattattcataataaatttaaaaatcagtataaatcagagaattcaggatacgagaaaaccttgtttatgaaaaaaaaaatttatttgtcataagatttgacctaatccacataaaattaatgcaaaataatactgatgtgaatcgcgagttggagcaatttcatacgcattcattagcattggccttattgccgaatatttgacattttggttcgataaatttttttcattttcataggattggtataatccacgtcaattaatgccaaacaatggacagatggaccactgcataaataggaggcatggcacaagcagaagccatcattttaaattattttaatatgccaactctttgagatttctaattaaaaaaaagtcaaatacattttaagcatagggctgcattttatgtaagaaaaatgacaaaatgcttcttcatttttatgtgcttcttatttttttattttttagtaatgatttccgaaaaaattttcagctctattagacctaagaaaatgaaaattgcagaaattaaatatttcagctaaatttcgaagttttatttcgttttaaattatgcaaagagcaaaaagtacgaattggaaaatgtgctgggaaatgatgataagcttacttgaaaaaaacatcggtcacttgaaataatcattgcgcccaattgacttttctcccggattttaagcccgaatgacctgccagg

SEQ ID NO: 30477 - DNA, 1655 bp, Heterodera glycines
acttgagctgcgtgaatagcgacagggaattgcctccccctgtagccgagagcgatgaaatgcgtgcgtttcttgcttttgaaatgcgtcggaaaaacgtggacgagcagaaggcgcgcgaaaaagaattcgcagtgcttttggaagactgcaacaagtgacagtttttttgggggatccatttctgaactatttcatatgggcgagaatcacttaatagttatagtatttctaacagttggtaaccgatcagcctttttcagatggcttcagacgggtctttaccttgacaaaccgcacccgcggactggggcaacagcgcttcatgttgcagcttcaaaaggctataacaaacttattggttggttggcattgtcatagggactaaatggaatttaatgatatattctagagtagagcgggaccgggaccaaaacacggacaactgagtaccgaagtcccggttttgaccgggaccgggatcagtcccggttttcccagccaaaaattcccgggttttcaacccgaaaaggtccaggtcccggtttgcccaaaattcccccggttccgcttctctaatatattccattattatttttaggcatgctaatcagggcgggggcggacgtgaacgcgcaggacttcgaggggtggacgccgctgcatgcggcggctcattggggcgagcgggacgcatgccgaattctgatggagaatggtgccaacctggacgctttgacacatacagtgcgaaagtggcaaatattaaatggatggggaggggtgggaatagaagacagcactttccatgacccactacaatttattttcagggccatacagttttttcgctagcggacaaatctatttcggattatttggtaaacttgcaggaggttggttgcccctcggattgatgcagttttgcacaattttcgcagaatttcaaccaacttcgctccgaagcgctccaacaccaacaacagcagcaacagaatggtgccactcataatcagccttcaaatggaagtgcggtgctgcaggatatggcaaatttgacacttggaaaggacaaggaatcgtcagtggacagcgaaagagcaagcaaagtaagccgttggtggcggcacacacgtacaaggggtgtcttcgcatatttctacatgaaattgagttttttgtgtattgtcagtgtaacatccttccgatgagatcgactctttgttttccttgttacaatggctcattttccacttccgtttctttccttttcgcgtcaattttcatctttccctttagcgatcgtccagcgtctacagcagcagtgagcaggacccttcgtgtgatggacaagggggtaaatgccttgccaaccaggaaaagaaagggtttattaacgaaaaacgaatgtaaaagcaatgaaaaataagtgttttttgggttttgtaaagcagaggaaaaagtcattgaagcaaggagacgaattccccagcgcccaaaaattcaccaattaacaaagggggaaatgttgggccgtaggccctgattacagattagtggtttatttgaatctcaacaaattggcccattggcaaaagttactaatccctggcccaataagttattaatgcgaaaagttattattttttgttttg

SEQ ID NO: 30478 - DNA, 1502 bp, Heterodera glycines
tttttttattattaatttgccttcgagatggcccaaaatgagtaaaaacagatgaaaattgcaatggatgagtcatccgtccctttggcgccaagtgcaccttttgaactcgccgaacctccggtgaaattgacccgtcgctggacatttccaccgtttcgtcgttcggtttttccgcttgaatgcgttgaaagcgttggcgttgttttgtgctgtggttcatctgctgctgcttttgttgtttttgctgttccatcgtaaaattcctcagaatgtttgtgaattttgacggtcctttttggcttttaactgttcgattatcgtactttctttcgactttatgggggaattattctatttggagagattattaagtgctcatcagagggaatgtgtgacattccatcgctttggggagggctttcactggcaaattgtggcggcgaatcggccaattttgtggctcaacactcgtcacaaattgccgataagaaacacacataaaacgaaatttggtgggtgagagggaatgtttgtgaatggccactttggagagatgacaaagtttatgggggagaaggggggaagacaagcaaaacaggagacggacatggtccgatgcacaaactcatcgacggacgaacggaggacggaacagacaataaaatgggagaagtgaggggaaggggggggggggggtgaactgctcgaagttgacggaacgaaatgcaaagaaagatagctggaaagacggaaaggagaagctactgacagactgacctctttctgctcaaagctcgtctccttctcctcatcttcgccctcctcccttacgggcgaaagtgacaattcgcccgaaagggacactttggcatcggaacgatggattggcacgaacaatggcatgtcaaatgctttctgccattgatgagcttttaatttctaatttacttttttatatgttcactcaccttttgctcatgctgttgttgcgttatttcttcagtttcgagcagttcgtgctcttcctcctcttcaattggtgtcgtccttctcatctcctctcgcctcctccgttctacgtcctctctcattctctgctcttccgtccttcgtttctcttcctctctgattctctgctctttccctctcccttcatcccttcccctccccttttcttcctctgtcgtccgctcttcctcttccactccttccggaatttcccttccgtctgctccaactcttcgtcttctcttgctgatctccgtgtccacctcctcctgatactgtaactccctggacagtgtctccagtaaatgtctgcccaggcctctgctcgtgtccaattcgaactccgtcggtatgtcttcatccctcttttcctcttcttctcctttccctttgtctctcactttctctcctatctcttccgccctctcttctttgccttttctctgcaccggaagagatctctcaataatcacctgacgtggtgaagacaa

SEQ ID NO: 30479 - DNA, 782 bp, Heterodera glycines
tgatcaaaataaacaatcaaaaatggcagtgatcactcgccacttgtaaattttgaattagcgcgcaaaaatttatgccacttacgctatttggtgttatgagcaattttgtctaacactgggcttgacccatagtgtatccgtatagcgacctcgaaaactcccaaaaatatgttttgcttgtaatttatcaggatgtgatctgtcctgatttgaagggctcaaatctgataaaatgaaaatgtaatgatttgcgatcaaaatttgttctgatttcttaaataaagtcataattttgaaattactggcagaatgccactattttatcaagaaaatataagatttgaggcaaaatttgggacgcctgtccatccctcaacatttttttaaaacgtggcgcaaaaaaagcgtttttaaaggcaaaaaaagtcgtcgcttggcttttaattgcaaaaattggcctttctgaaaatctgtttaaacaaatcacaacgaatcattcaaaatattataatatttttttataaatgttgaaatttatcttttctgctgtgcttacttaactaacttatttcgcagaagttactgcgaagtaaaatttttaagaagttaatatgcaataaataataactcttttaaataaaaatttcgatagcgctttcgaggaaaaagtatgaatttccaaattccttcagaatttcagcttattggttgagccttttgatgaacctaacattatctcagcttaattagtcttcgtgctgagaccttctacaaataaa

SEQ ID NO: 30480 - DNA, 1018 bp, Heterodera glycines
aactccgctcaactggtgcctgaggcgaaattctcttctccgttcagcttaggtggtggtgctttgacggcctgtgctatttgaagtaaatcgggcaaggggtgcgcgagttttgctgcgcgagtctcgggggtgcgcgagtgggcggggcgtcgagaaaacttcgctcaaaatagtgccagaggcgaaattcttttgccgttcaacttaggggcgttggaatgatggcctgtaaaatttgaagtcaattggacaagaggtgcgcgagttttagctcacagaacgtgtgctccgaacatttgtgccccccccccagttttgtactttgctaaacactttttaaaaatttttatcataataaaaatacaaaaaaaaacacagacaatgattttgatctctcccttctcattgttggttattggcgcatgatcttggcctcatgtgcgtgcactgaagaagtgctgcttcgatggcaggtgctcgacggtgtccaaaaaaaacgaatctgaaaatgtgatgaaatttaaaaaaatgctaaattgaaaaaaaacttacaattgttgggtcttcaagccaccaattcaagagcaaatcctcctccgcgtcttcaatttgtgcacgcaactcggcttcttcatcttgttcttcatgtggctgttgaacagcttgaacattgtcgggttgttgaaagggatggtcagagttttcacttggagacattttttgtgttgtaaaaatgaatgacgatgaagaatgagtcgctttgagaatgctccgtcagcatgagtcattattgattttgtcatactgaagagcagtttctctaacctctgcgtcattttgccgcaaaaaatattggtggttgtcgggggatatttttcatttcttccattactgtctcggcctcgctgcgcgagaggtgaccgtgacttttaagccatcgtattaaaacgaaccaaacaagcaaaaacacaggaaatgcaagaagataatgagaaaaaagtagtacatgaaaaag

SEQ ID NO: 30481 - DNA, 1782 bp, Heterodera glycines
tgtgtatatcgttttagatcttaaaataatttaattttattttgcctagttgataattcaaattcgatagcacttgtcaaaaaccgtaacaataatcaattatcacaatttatttacgaatggactaaaatataagaaaaggcgaacgtgcatttaattatctactacattagagcacgagaaaagtttttaaatgcccagaataacaacccaatcttcacaattggtaaaaacagtgccatcctcatggtagtgtaaagcttgtagaaaagcattgtccaagtcttcattgcatttcatggcaaacgaattcagacaacccgataaataaacatcctggcgaagtacaacataggatgaatggttggtaaagttgttgaaatttaatccgtattttttcgccaatactttaatagcagtttcaataaaggtgtagctatatagttcactgaaaacgatattttgcaagacaaatatcatttaatatatgtgggaatttttttgattttttaattcccgaaaataaaaattttgcaattttttaagtatttttttatctggggatcaattatagggcttagttattttcaccaaacaaaacaaaatagactaaaagtaataaaaatttctactctcattgaaagaaaaaagctagaagtatttacaagcaaaaaaaacaaaattctttaatatatcaagaaattactttgtttttctaaaactaacctgtccatagcggaaaaaaaaatcggccaacttgagactttgaaatttatgagcttctgaagcgactcaaagacatcatttgtgtctgttttcgttcgaattgaaatgaatcgcgcgttcaatgttgttgtgtttgtacatgaatttggtcgacatgcaaaccaaaaatcccagctgagcaaatcgaatcgtcggtctcttgttaccacatatttccggcgatagcttaaaataaataaaatgtaaattctacataattccaaaaatgctgttatgatttcctttttaaattagaaatattaacgaaaaggattagaatattttacggttttatgaaaactaaaaaattttcttataagaagcaattgaaaccagagaaaaaggtaacgagagtatgcatataatctcctaccctggatggccaataaatctcattgtttcgtaaacgacatcgacaatttgttgatatgttgcatttgtttccggaatgatcatgcctttcgagatgtcttgcatggtgtttcgaattaaaaggttctcgtaggtcggccatgtgctatccaataaagaatcaaaccattggttcacgaatttgtagacaggatcaagaatccgttcgatctccgaagtataaatatcagcattttccggatttccataaaaagtaatgttcgcgcaaagcaaggtaacgtaatctattaattaattcgattatattgcagtattattctatttaccaaggcttgctaaatgctccattaataagtcggcaaaatgctcaattgagtcacgcttgtagccatgagaaagaaaagcggctttaggtaggcataaactaaaatgtaatgttaaggttagtttatcaattcaaatttccaaaaaattgattactgactgggatcccacaatatcctgagatggtcccgtctcattttgggctctaataaaaattttttactactgatgatattttcgattaaatttatcatttttccgaagatttttggtgaaaaatgcgaagaatttactatttttatttgaatttctatttctaaa

SEQ ID NO: 30482 - DNA, 1476 bp, Heterodera glycines
ttttcaccatgtgccatgatccaaagaaattggccaagaatgatcagaaatcggctcagcggcacatagttcatatacacataaatgagtgcagcacatccatttacaatgctgatcagaatcacttggatgaaaatctgaaaaaaatatatatatacaatgtaaaaaatgtattattaaaataatatagaatatataaattagggttcctcccacatctgattcgggaaaattgtgaatttcctcgattgcactccaaagggttagagttggtgaaaatttttgctttaaaaaactttctgttattttttttctcgagtttttatgaaattttcctccccgaggaagatgttgttgctccccgacatttctttttatttgttcaatcatcctcgacaaattttgtgggaaattttcttccaattctcgtctttggttttttaagaaaagtttccgttttcggtgtttttatgaaaatgttctccccgatgaaggtgttgttgctctccgacatttttaatttgtccaatcctagacaaaaaaaatttttttttgtcaaacttgctccccaattcccgacttttctcctcccattctcggccaagaacctttattaataattatgacctttttctgtgaaacacgtgtagtgtcggttcgaattgttttgaattggcgcccttgaaagaacagaatcgcggcaaatgtcaaataagtactcgagagtacgataaccacaatgtaattgtgtactgtgtgcaaatcgttgcgatactgtaaatttttcgggtaaatttaaatctgaggcttgtaaattttttaaaatgccaatttattcgaaaaatgtaaaaaattgtaaaaggtatgaaaagtaaaaaaaaaaaaaaatttatttataattaaaaaattgtctttaccttttcctcaaaatcattgatgtactcaaagtgcgggttaaagaaccaagtgatgtacatgccgctgaaaatgatcggcttggtgaagatgaaaaagtacaagccgtacaaggtgggaaacagctgaaaaagcgaaaactttttttaaatttaaataaaatagaaatgggcaaaatttaacccatgataaaattttttaaaccatgaatttcaattaaattttgaaaaaggcataaaattttaatctatgagttcggttcacgctaagaatataaaatttcgcaactacgatatttagagttgctaatgatgccaaaattgtaaatttgcttccggggctagggtgacctattaaatttttttttaaatattgactaaccatccatagcaaaatgcgtttgccatcgaatagaaaacgtgtcagcctgggactagcgagttccaagcaacggttaatcgccaaacacatctcagccattgattcacaaccccacatagctaattaaaagtttgaaatttaattgttttaaattaattaactttttttcacaattattac

SEQ ID NO: 30483 - DNA, 1073 bp, Heterodera glycines
agtgtttaattctgaagcgaagtcgaacgaattactttcccttgcgaatcggaaattggagccaattgaattgcgtaatttgtaacctaaaaaagtgaaatggacatttgaaatgggaaaagacgcacttttatcagccaaaggcgtgtgaccaaaacgcgagaacaatctgaaaatagggagacaatgacaaaacatttaatggaagaaatggtgggacgcacctttgtacaaaatagtgaagagcaaaggagcacggacctaaaaatggttttgttttggcaatttgtaagtcgccccgtgccgtcgtcccttacttcgtcgtcaatttccctggccaatgtttgccaatttcgggcatcacttaaatttctcaatgtgtgaaccaacggatggcgttcgtaattattacttcgacaaaatgacaaaattgcgattgaagctaaattaacaaaaataaaataaaaattatttttttaaatatttacctgccacgataagcaaagaaaacagtgaaagccattggatgaaattattcggactatgggagaagacgggctgatcaatgcttaaaccaaggccaacaaaacaaactgaaaatggggggggggggggagaaaaggaatgaatgcaaaatgacgtttatttacggaaaggaattgcggaatgaatgaaagcggtgagcaaagtgcggcgcaaatggtactcgacgaactgaagtctaaagaagtcgcaaaggtatggaaaattaattaaggtaatgggagaataaaccggcgctactgtaaaagttaccgattttgaaacaaaagggggacccttttgttttgcaaaatttttttaagataaacaaccatgataatttgttatccggggttttaaaggtcgctaatcacgaatctgacatgtattttgactaatttgtaatccctaacccgaactcgaataaaaatcgaaattttgaatttttcaaattatgattttttgttcaaaattagattattaatcggaattgatcaaaataatgacccgtgaggatcggggaccccaaaaccccagagaataaattttta

SEQ ID NO: 30484 - DNA, 1466 bp, Heterodera glycines
  misc_feature (1321)..(1321): n is a, c, g, or t
  misc_feature (1325)..(1325): n is a, c, g, or t
  misc_feature (1370)..(1370): n is a, c, g, or t
  misc_feature (1379)..(1380): n is a, c, g, or t
  misc_feature (1414)..(1414): n is a, c, g, or t
  misc_feature (1442)..(1442): n is a, c, g, or t
aaatttatatctgatagacatacttaaagctattgaatgataccaagaattattaatttgattgaatttaagccaagttatgagtttatatgtcttacattttttgttttcctaccccttggcggatttaagaataatgtaaattaaaatttttctacaaaatggaaatgatataatttaattaaaaatattatttattaaaaaatccttgttttatgcttttttaaaaacagaaaaatgactttttagagaatgaatttttatgtcttaatttttgttttgttattattcatcttcaattcaatgaacaaagctttctctgttcaatccaaaattcggccaaattttgctgaaatatttggccaagagtgggaaaatgaaaatatggaaaatcaaaatgagcaaaatgcaaattcaaaccaaaacgaataaaatgatttaaattcaattgccaattatcagaacgccaatcaattcgatgacgaacaaaagctcgaaattgaaggaattatgaaaagggggaaatattcgaaaaaaaaaccgaaacaaaattgaacaaaaaattagtaaaaaattgggaattaaccgaacaataatttacaaatggaaaaaagaatttggattaaatataaaaaaagataaaattattatgaaaagaaaaagcaggaatttattgaacgaattgcagaaattaaaagactgtcaaaacatcgaaaacagaaacaatttgcggaagagttgggcattggcaaaaaaacattcattaaatggaaaaaggaatttggcattgaaatgatcaaacgtaatttaatttaatttaattttatcattttattgtttttttagctggaattcgctatgcgaacgaagaaaaagcacaaaaattggaagcttattatcaaatgaaaaatgagaagtcttcatcagggctgggcgaagctcggcttagcactcgaagccgaaggcgaagcccaattttttttcgaagccgaagtccgaagctcgaagcccaaaaaacccgaagttttcgaagccgaagttttttcaaaattttttttttaattcaaaaatttttttcatcacataatttcggttaaatatcaaatttaatcaattgacgcagtttctagaagtagttagtccaccagatttccgttgttaagttcaaaccctcttggctgcaaatgatttattggtaattaatttcgtggggggagttttaataaatcctttgttttttagtatttcctaaggatgttggaatagtttccatttaaaataaggtgtaaaaacaatttttaaaatacgtttgaaaatctgngaanagttttttgagggtgtgagtcaattttttcaaggattgtgtattntttcatatnntctaaaaagaatcaaatagtttgaccctccctanaatgtatatcatttttatttttctgttngaaatctcaaaatttaaggtcccc

SEQ ID NO: 30485 - DNA, 1441 bp, Heterodera glycines
tccaattattttatgggagaacattcccgcaaattgccaattttatgtgttcggaaatttgcaaaatgacaactgcgatgctggagggcattcccggattggtaacttcgacttgcgggaaaattcgggaaaatttcccgacccttgaccaacaggtagaagcagtggcaaatagttggagatcattttactaattctttttcgatttaaaaccaaaattttggaatttttgttttgaaagattaacctaagtggaaaatgttaacaaaagggtcaaattccattttttcagcactttgttcgctacttcattttctatggcctttttttcttcatttccattttcaatttggtacagttttttcaaaaaaaaaaagaaattataaatttttatcttccacaggctttcgtcgtaaaattcattttgtttttgggcattcatttcatcatcgatgtctttttgtctgacgccgaacgacaaattgtaaatgtttaagaatttgtttaattatttatttttctgataataattttttttagtctcagtgaattatgaattatttaaattactaaagaccggaattttgaaagtaccaggcccgggacagggtttaaatttacgggctcaattgttttaatgaaatgaaatgaacaaatatatttaataattaagttttgaatttgttttgatatttttaatgtaatttttttaaatccggtgtttagacatcgtacttctatggtaatggttggttcgggctcacttgtgatgtcatcattttcaaacttccagcagtaaaaataattaacaattatcattttaaatttcaagactcaaaacaattaatttgaggtattaaacgctcaaaattctgctcgacttcccactgatcttctacaggtgcttacgtcttgtgattattcataaacaataataattatgcacagtttgtttttgtggcctctttcatgttcaccgcttgttcgctgttcatctttgatctgatcgtttgtcctttttgccaattttctcgctacagtatcccctcctacttgcaccgtatttcagacatttgtcttcacctatcttttgctgatttgtgctcttcaattcgccaaatatgttgtcatcgacatttacaaatgtgtccaaaatcgcacttcgcttccaaaagattgtggacaaatggtccatgtcaaaatggaagaaatttttgccgattttatcaaagaaataaaagcgacgcacgcggaaattggatcgattgaggagattcgtcagggatccaaagccattttttggcacattcacaacaaaattcaaacggacaaggtcatttggaaggtggcaaaagacggggcatttgaaaccgaaattcaccactttaacagccaggaatgggagcacagtgtttcccaattctcattttcaaaaaataaa

SEQ ID NO: 30486 - DNA, 1295 bp, Heterodera glycines
  misc_feature (97)..(97): n is a, c, g, or t
  misc_feature (108)..(108): n is a, c, g, or t
  misc_feature (115)..(115): n is a, c, g, or t
  misc_feature (120)..(120): n is a, c, g, or t
atggattcctttaaaaaaatcaaaaaatattattgattctacctgggatttttagttatcccatattaggtcttttttaaataaatttcaaaaattnagggtacaggnttgggtncaagnctggacaaaacttgtatatttccttgacctgtttttttctcaaaatccaggtccggataaagtaccaaacccagatcgtgcgagatccattgctattcaaatattggctttacaaattttattgtttttagccaccgatgtctttattttgtacagttttggtgaacattttttatcaaaaaaatttttgtgttattttttttgatgttttattttgatgaaaaatacatagttatttttaagaaacttactgtcgcatttacacttcacaattaattcttttttattttccgaatagacaaaatatggcaaatgccaattcggaatatttatatgaaccatttcattttgtatatttattttatatttaaacaaataatcatagaatggatagtaacaaaaattaatatattatacaatatttgcacaagtattattcgattataaataaatttttaatgtttttaattttgataataattaaataccattcttctctgctcaatttaatagcgaataaataaattggcagatattgatcaattaattcattttgttcagtttgaatgagtaaacggagtgccaatgagaaaagcaaattgatcaacctcaaatttacatattccgaaattgtgactttccgtttttctgcaattaattcattttccatcgatgcaaccgtttgaattgtttttataaaatcaatgtcattagcgatttttttatgttcattaaaatttctttaaaataaaatttaaaaaaatgaatgagaattaattaataattacatttcaattaatttgccgagtcgtttaatgatgcgttcacccatttgtaatgggaatgttagcaattgcttcttttcgtcatatttcacattttcagaatgcttttccagagtttcatataatatttggccaaattttagaacttcttttccttcatcttccagatttattcggctgctcagttcgcatttgtcggcacggctgaaatccgatcggatttgatctaacattggtaaaaattccttctcaacaaaatcccttttttcaacaactgatttatataggaattcttccccaaaaaaacataatccgtattctccgtaataatacgtttgatataattcagcatttcttttcaaaattttaaattcgttcaatttgtcaaat

SEQ ID NO: 30487 - DNA, 980 bp, Heterodera glycines
  misc_feature (23)..(23): n is a, c, g, or t
  misc_feature (48)..(48): n is a, c, g, or t
cattattacctacttagtgccgngatcaaatgatcgcttatatgcagnacctttcatttatttaggcatattatatgtacaataaaaaaaaatttttttttgaaaatacgttcgaatccgggttaggggttcagaatttgtcaaaaataatgccggattcgtgctcagcaccataaaatagcgctagaaaaatttttccaggcttttcaaataaaaaaaacgggaccagtaaactagacctttgccccatttgcacataaacagaaaaatgaatttcgtaactgacggaagaaatggcattggcacggagaaattgctaaacaatttggaaaacaaaaatcagtgatttgtagagattatggccacacctccttgaaattgttgacccaatcgaagttcgcttgttcgttgtgatcttcgcaacgcaatcgcttgggttggccatcttttctcggagagtgcaaccatttggacaatgcttggccagcagaaattgttgaatttggcccatcaaaaccatcaccaatcgcagcgggcaaccgaccatataaattgattgaattcaactgattcagatcagtgagaattgtcggcgaagtgcgaagacgcaaattgtccaaattatcaccatcgtaaaagcgcaagtggcgaatgtttgccgaaaaaattggccaaatttcacgaacaaaaacatcccaaatccgctggccatccgtgttgtgtggtgatgaaagccacaaatataaattggtgcctcttttgtcgaaaatttggtgattggaacgaagaaaagcgatgacgaagtgatcgatgtacctaaaaatggaatgaatgcttttattgccataaatctctgattccgaattactcaatctgaagattcttaaaacggattttgctgggcaacggacggtcgggcaatggaaatggcacaaatttgtcatccatctgtacagacagcttcggttctggtcctttgt

SEQ ID NO: 30488 - DNA, 1444 bp, Heterodera glycines
acagttcgatgaccgatatattagctttaataatatattgtgctgaattcacatgttatgctttgatttggccgatcaattatttctgtcacggacaaacattagggtgattgttaaatttaattaatcaattaaattttaattgctttcttcatttagaatcgaaaggaacagacgtttattgatttcactgactgttattatgtcaatcggtctcatctgcttcattggagtaataatattattattttaattatgattatgtttaaaaccctaatttaataataaacttattcacaattactgtacattacagttcccgtttaagacttctgtgttctttcatggcataatgccattgctcagcttgaaccttttatcaattgaatacattgtatggcccatttgcaatggtctctttgtgatggcatattcaagctgtactccggtgctttttctgtgcaggtagataactaattaatggattaattaattttaatttaaaaaattattaatttttcattttagcactgaatatcgaaaagcattttgcaaatacgtttgcagaaaacaacatggattaactgttgttgtgccattgcagaatatgcctgcttgaaaactttgtttttacattttgcatagtaattcggactcgatgataaggcctcccacaaatcttagcattaagagcctccaatctgcaccaaaaatgttttggtgacgtacgaatttttgaaaaattggcattttttaaaatttgaataaatctcgtcaaaaaatttggcgtgaattttcataaaaaatgttgatttttctaactcgtttttaaactttcaggttgaatttctgtagaaaaatgctcgtgattcatgctaatgacttgagaaaattaaaaaatttatatttaaactgtttaaagagttttataaaaatcagctttatctgttgaaactttattgccttggtgtatgattagcgtgaaaccctaaaatgttgatttttttattaaaaaaatttaaatgagttacaaaacccacttattttaagctcttcgtaaaaaaaatagtgatcaccagatcagaatggtgcaagtgcgtttcataaaaactgccacacccccccccccccgcccacctcattcaaaagaaattcttgaaaaattttgaaaggttgaaaattttttttaaagaatactataaaaccaggaaaattaaatattgctagtaattttacaaaaaaatttctacgaaattttcaaaaaatatcgcttgcataatattcaatagtttttttgaagtgtaatttacaatttattttatgaaaatcatttattttatatggaattagcacacgtaaaaaacgataaatactacatatattaaagaaatatgataaaagtcaagcacatttaaaaaaaacttatgtatgcaatggcgaaaat

SEQ ID NO: 30489 - DNA, 1171 bp, Heterodera glycines
tatgtgttttccagcaccaataaatcctccgacactctccccgcgacggttattttgggtcccaacttggtcacttcggttcccaacttttcaaactaaattcatttaaaaaaattaaaacaagtgagcaatccgtacttggatttaaatacatatttgattgttcttgtaaaatagatggacttatttccaagaatgtatactaaagtttaaattaagttaaattgtttgtcataatctgttaatttatttaattttcaaaatttttccttgccggcatcgcctgtgcccttatataaaatttaataaaaatctttcttttggcaaggtctttaaagaaaaccaaatgaatatgaacaaagattaataatttattcatttcaataaataataaaattttacttttgaaacattaagcatcatcccataaccagctccggtggccacatctcctacaaaacttgtttgttcaggagtatatggcaatttgacatattccctcagcattgcggcttcatatgcagagaaaattaaaagaaataaaaggatgaggaaagtgatgcttttttctggcattttcccttaaaaatggataattttttcataaatataaaagtaattattattttattcaaatattttattatgtacgaatatcacgaaaactgatttatttatttatttactaaaaaattacatcactaaaaaatattgtccaattcacattccattcaaaaaggaaagagtgaatcagctaggaatgctcgttttttgaatatattaaataaatttgccaaataattttagaatttataaaaagaattataatattattaaatgtaattttcttacggaatctaagaaaagaatttttttaacccaatggaaagaaattcgataaatttcaaaaaaaattatgactaataatgttcagaaaaacttggttttttgagtttctcaggtcagaactttttaacttcatgaatttttttgaaaatttgcaggataataggaaaaagttagtgctatcgaattttaacaagattttaaaattttgttcatttgaggcgaagttatgaagaattttataaaaaaagtttaaataacatggcaaataatttgacatgtattaacatatatgataagcatttctcatttttactgatttttt

SEQ ID NO: 30490 - DNA, 876 bp, Heterodera glycines
tgcctatttaaatgactttaattgctgtcctttcgcttacgaccataccacgttgaatgcacgccatcccgtccgatccggcatgttaagcaacgtcgggccttcttagtactcggaacggagacgtcctcgggaatcgaaggtgtcgtaagcttttttacttatttcacttttaaatttatttaaattttcaattttttttggcttttttcaaaaaattttgtctattttttcggcaggcactgcctctgtcaatgttttttatttatttagaaaaataaatttattttttttctttttgattattttaattgtatttcatcctgaaattttttaataaacattttcaaactttcaccttattaatttaaggcgaattttgccttttttaataaattctcttgtgaaaaggcaaaaaaaggctcttttaaatatgcctatttaaatgactttaattgctgtcctttcgcttacgaccataccacgttgaaagcacgccatcccgtccgatctggcaagttaagcaacgttgggccttcttagtacttggaacggagacgtcctgggaatcgaaggtgttgtaagcttttttacttttttcacttttaaatttatttaaattttcaattttttttggcttttttcaaaaaattttgtctattttttcggcaggcactgcctctgacaatgttttttatttatttataaaaataaatttattttttttctttttattattttaattgtatttcatcctgaaattttttaataaacattttcaaactttcaccttattaatttaaggcgaattttgccttttttaataaattctcttgtgaaaaggcaaaaaaaggctcttttaaatatgctatttaa

SEQ ID NO: 30491 - DNA, 1510 bp, Heterodera glycines
ttttttttttttttgggggtataaatttcaaaaaaatttaataaaattctcccgattttttgctattttttatgctttaaatgagctgaattggaccattttgaggcgagttatgaattttcaaagaatcacttaaattcccaaatccaaaaaattgacgatttttcaaaatttttttacctccctccaaaaaatccaaaacgcaatataaagtgcatattcgtgttcagcacctcaaattagcccagaaaagtattttttggcaattttaggagcaaaaaaatttttcacgaaatgcaaatccatggggtcccccctttggttttgcatttaaaaattcatttttattttatatctttttttatattaaagataaaaataccggacaaagcacattagatagagctcgaaattctctacaaaaatgctctaagacaatttttcgctaaaatcaacccctgacgagttataagcccgggactgaaatgtcccggtcaggccaaaaaatttttctatttccggaaaattttgaaattttttcaaaaatgccaccaatcgatagagctcgaaaaacggttgcttgaaagtggtctccgttttcctgggaaaaatcggcaaaaaataataaaattcaaaaacaaaaaattttcgagggggcctagctcgaaaaattttgaaaattttcaaaatctgaaaacgccatcggatgcagctttaaaaactgcacaaatgctcaagcggcgccaacccgctccgcttaacccccagcgagttattcccgaaaaacggaaaatgccgaaattgggtgccaaattttgccattttctgcagcattggcatttacagatagaacccccaaaccaacggcattcagtgccaaacagtccaacttgatttcctacctccaagcattttccgctcccgcttcttcccgcaaagttacaggacaacaaagacggacaaaaaaaatttcacgccgtttcagcgccgccggcgctgaaccgtccaccggagcggaaaacccatatttatcccagatgctcctcaaaaagttgtaacacccttccaccactttcagacccctcccgacatgcgggcgactcaaatcaggagttatgactatgtgcaacttttctctatatatatataaactatcgtgaggcagcagtacattgctcggtgcagacaattggattagcacaggaaatactcggtggaaactggatgctatacacagagattgcacgaagtagacaggatatctcttctatatatcactcggttgcttacataatcgctgcgcactaatgacttcccatgcatactgcatgcacgtgtctcataatctacgctctgtaccacaacacgcccttactcctctttccatcacagaaagcgtaagacacatgcacagatgcgcaaaaaagaagagagacaatacaaatttatgagtgaagaccaagaaatgtgagatgaaaagagagaatattggacaaagaaaaagagtaaa

SEQ ID NO: 30492 - DNA, 1194 bp, Heterodera glycines
tttttcaagtgtccgtttggggtactcaacaaattatggggagcaaaaatccaacgcagaattaaagtacaggctatagggaagctattccggaaggattcggtctccccataattctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagcagtttctgtaaaaatatttaagaattaattttgtaaaaaaataaataaataatgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacaatttgatgcgtttcagagcactttctgaaaaaatatttatgaattaattttgcaaaaaataaat

SEQ ID NO: 30493 - DNA, 1674 bp, Heterodera glycines
aaaattttgggcaaaaacgccaaaaataggcaaataggtttttttcaaaatttttttagggcttttaggctctaaaaatacaagcctagaaaataggcactaataactaacaactatcatgtttttcgtgtgttttaggccactgggagctcaggaaaaaaataggctaaacctaaaaattgcatctctatttataacttatattttggcaggtaaaaacccaactcgtttttggccaactcgttctttacgtgttatatgtatatgaactgtctaacttcacgctgtctgcactcctacataaatatatagacaaaaaacgagttgggccaaaaaggagttgggtgtgtcgccctttttgcatagtccgtatttatgccatttttggtgttttttagtccatatattttataaccctgattattaggtattattttttgtatattatgcatgcatataacgtattcacagtaaagcaactttatcttagcacaacaaacgaaacgattgcaatcacgataacatcatagagaagcttatgcgaatagtaatgaccaccataacgatcataaacgtccacgttgccctccttcaagtatttaatgaaataggaaaccaaagggcgggccagtgcatataatggaaagaattgttgtaattacacagccacccattgccggatcatcatcatcacgctttgttcttcggttcaaccagcgattgtttttctggtatcaaaatgggtgattttttgctgaaaaagtaaattaaaattttgtcccatgagtaaactttaaaaaagttttccgcattaattccaacaagaaaaggttatggctgcatattctgatttgtaaattttgagatgccaacccttgaattaatggcctattcccttttgtcattttgccacaatttattttcctttaatttaataatttaaatccaaattgagctttaattatggcagccgttttttcaattccaatgtttaatttgtcaaaaaattccacaaaatttgtcatgttttgattgctgagaattgaatttttcaccactttttcacgaattgcctttttgttaattgcttgctcattaatttggacttttgtgattaatttgcgtatattttcatcacatttgttaatgttccatttggcaaattgtcacagaaatatttgcgtaaattttgcaaattttcatcaatattttctcttcaagtttcccgccacaacacacggcaaaagaatgtttgttaagcgattcaattgccaacttcgcgtcaaagtttcctgactttatttcattcattaaatttggtgccgaaatcaccaattctttcgccatttcaaattgagctaaaaaaacctttaaatttcacaaaaataatattagtgtatcatttagaaggctggaaattttgcaaaaatatagggttcatccctaataattttcaatataacaaaactttgtaaaaagaacgccacaaagtttgattatgaataggactcgaaattatatggattaaaaaccccaaatatggacattaaatatggactaaaaatgcccgaaatatggactaaaaagctcaaaaatggccaatctatcttcacaatttataaccaaatacataaaaaaatttttgtaataaccgccattctgtgtcagcgaaaa

SEQ ID NO: 30494 - DNA, 1680 bp, Heterodera glycines
gagtaccccaaacggacacttgaaaaaatcgatttcccccgccttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagctgggagaagggagtgggaaacatgatttcaaaatttttgttgaaatatttgtcgtgctctgaagggcgtgggaggggggggtgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaacttaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaattaaaataacattcacggtgcgaaaaatggg

SEQ ID NO: 30495 - DNA, 951 bp, Heterodera glycines
tctactggcattgtcggacccctgttccaaaaagttttttggaaaaagcgcgccgcagaaaaatatttgttattttttgatctggaataaaattttttcaaaatgattttttgactctaaatgttgatttttcgctggtaaaatgattttaaaatgtttatctggcagccctgattttttccataaataaattcaaaatttgtttatattttttgctttttctcccacaaaaatgccattcttagggggtctatatttaacccctactccgagtcggggttaagggtcggggttcgtcgggtttgaagcgtcggggtcagggttaaccccgaaaagtggccaaaaatgtcggggtcggggcgggatcggggtcgcaaccctaaaatcaagtgtagactgaactacaaaattttgaagatgcgagtcgagtccaagaactctttgttttgcaagaaataaattattcgcttttttctataactttcttaatcccattggcgcttggtaactaaacaagcaccaaactggtgttggttacttatatatatatatttctttaaagttaaaaagcttctttttttgttctaatccgtatcagttggattttctagggtttgcaggatcggagatcacaaatttgactcagttttgatagattttcttcagaagcagtttgtaatgactatggttggtaattatatgcacatgcatatttttttcctgaactgcgggaggcctgaaacgcatgaaaaacatgttcttagcttgattagaagcttctaggagtatttccatatgcatatttgggcattttttcaacatcctctattaaaacggccccctctattaaagcagccatttgggctctaatgatcgaaaatttttcaaaaatatcagatttttgggtataaattctgataaaaaattaactttttaaaaattgttacaagg

SEQ ID NO: 30496 - DNA, 1144 bp, Heterodera glycines
tctcccggccgaaggccgggagcgccctgaaagtggtggaagggtcttacaactttttgaggcgcatctgggaaaactatagaaaaaaattcagcgcggacgactgagtcccagggacggatttctcattttttcgtgcatttgggggcccgtaactttttttctaaaacccaaatcaaaaaatgtctgctgtgagggggctaagttgaagtgttttctaaaaaacaaaaaaaattccaagcctctatctgcaataggaaaggctgtaggttcgtggactttttcagtaccaactttgtccaattcagtcccggttgaataactcattagggtttgatctgggcggggagttaccagcagacttattgtagagttcaatgagctggatttttccagtttttaaaatttcgaaaattttcaaaatttttcgagctaggcctaaaaaacggttttcgggtttttgaattttaggaatttttaacgaattttcccagagaaacggagaccacttccaaaacatagtttttcgagctctatcgactggtaatttttttggaaaaatttcgatttttttccggaaatagaaaaaaattttggcctaagcgggacatttgagtcccgggcccataactcgtcaggggtcggttttagccaaaaaatgccttagggcaaaattgtagaactttttaagctctatctaatggtatactatatgaagggaaattttcaaaaattttcgagctaggccccctagaaattttcaaaaattttttttgggttgaaaaagagggtgaaaaatatttttctggggtaaattatggtgctaagcacgaatctgatgtttgttttagtttcagattttttggaatattttaaaaattctttattttttggcaattttttggccctcgggattttggcctaatatttgaaaattcatatctggcctaaggtttgaccaattttgattaaataaagcattaaaaatggagaaaaatcaggagaattttatgggttttatttggggtttttatcttctaaagaaaaaaagttattccagaatttctggaaattttcgatttttcagaaaaaaatttatatctcgattgagaaaagtcattagggaagagtaaaatactacaaa

SEQ ID NO: 30497 - DNA, 1133 bp, Heterodera glycines
gaagggttttcgggctgagaaaatggtcaaggacgggtcattgttgagctttaaatttgggaacgggctaatgaaacaattaattaatgatgaaaaattgtgaaaaggctaattaattatttaattatggcatttgctggggtaaattttttgttaatcaccttaatggcgataattccgttattgaccagatatgaggaacaagtgacattcagtgacgcacatttgtaattcgttattttgtaaccgaactcgggattcaatttggcgccgttgcagtcaattccttgttcacccggctttaccgaaccggcaatgcatttgtcacaacaattgggcgcttaaaatttaaacttaaaatttaaaccaaaaaagttcatttgaattcgaacggtttttggttggcgtagttggagttgtgggagttgttggagttgtcggcgtggttggagtcgtgggagttgttggcgttgtgggagttgttggcgttgttggagtcgttggcgtggttgaagttgtgggagttgttggcgtggttggagttgttggtgtgcttggagttgttggagttgtgatagttgttggcgtggttggagtcgtgggagttgttggcgtggttggagttgtaggggtcgtgggagttgttggcgttgtgatagttgttggcgaggttggagttgttggcgtggttggcacgtagcattttcttccacagctcacctgaaatttaatcggaattaagcttttcaaatgccgttcctaccttttccacttcgaccacttggttcgggttaccgtccacaccgatttgaacgtacacctttttaccgttttcgccataaatgcatttcagagatacagtaactttggtgtacggtggcagaattgcggttacgattgtgcttttgttgttgttgaacttaacggtgacatttttgaaatgtcgtcaaataatccaattacctctatgtacaccggttgcccattgttcggtgcgtcgcatgttatgtcgacgtaatagcaatccgtacttcgggtactggtagccaatctaggggtagttaaaccacgagtaggggtcgcaaaccctgtatttgttggctacgaccaccgcactacatccataagcacga

SEQ ID NO: 30498 - DNA, 1066 bp, Heterodera glycines
  misc_feature (15)..(15): n is a, c, g, or t
ttgtttttagatttnagcgcaaaaaataaattctctttcttcttttgaccaatttgtctaacactgaaaggaattcaaaacttttcttaggcatagtttttccaatcattttattttttgaatattatttagaaaaagtaatcctttataaaaaatgcacattccaaaaatagaattccccaaagaaattgttccaagtttggccaatttgtcgctaaatcgtcaaccaattgatgtggttttttcttcttttgactttctttttaatatattttttgagtcctcggaaagggtaaaatgatttgattttattgttagtctgattttgtgcccttagccctgggttcaaattaagtaatactttgaaataaaaaagaatttgattttaggaccgtcttttgaagttactcgaacggacgcaaaaggatgtccagcgcctgacgaccgccaaccaacagctcaccaccgccaaccaacaacttactacaacaaaccaacaacagcagaacacaatcaaccaccagcagcaaaacatccaacaactccaaaacttattgggtttgtgcaaaatttattggagatttaaatttcttttctcgagcaattgattgtaatgcctaatttttcaagccggtcagcaaccgcttgttccagcgtttgcccccggggtttttggtgaacaacagcagcatcatcatgcgccagcggactttctcggcgaccagcatgcgctcggcggccagaatccacacgcggcaccttttggccccgactttttcggtggtcagcccgaaaattttggtcagtgccttggttaagtcaggcactttctccattttctttcgtttaggtgttcagcagcagcacatgcaggagcagcagggtccccctcctccgccgccaccgcagtaagacgttgcaagtggaagtcgaatgatgagttgacgtttgaccttttaacctcttatgttttaacgttattttgtctgatgaagataaatctaatgcctccgttcagtgtaattgtttttttttgttcagaattgccaggttaaaaaagcaaaaa

SEQ ID NO: 30499 - DNA, 1608 bp, Heterodera glycines
  misc_feature (26)..(27): n is a, c, g, or t
  misc_feature (44)..(44): n is a, c, g, or t
tcattaaatatctataatatgctgannaatgtttaatgattatnttctttctaatgtatatttgtatcagaaaattttacaaatggggttttcatatacttataaagtaatatgttgaaaaatttttttgttgttgttctgattttacctccccataggctccatagtcaaatttatttatcaaatcgtttgatttcgcacatgttagaatattatacaaaaggttttatgaaattatggtaaagtttatgattttttatttacttttcttttttacttaaatattccatttatatagagggaattaaaaaataatttgtttgatttaaaaataaaataaaatttttactttcattaagcagtatttgatcatttaaattcttaaatcactcataatcagggatggtccaagattttttgattagataaatattaaatttttacttgtccttctgctgcagtgtcacgcataaaaatatgttggctaaatatttgtggatggtttgtcctcgttttatcgaaaattttgtaaaaaatgtgatgacttattgcaaaaatataatttgaattttattcattaactgtgaattttgtttttcatgttttaattttgtcgtatttaaatatatttagctttatatattatccacttattgttctatattttttttactatttgttctactatttattcatatataatccattcgagatatctgatcttatattctcttaattgcataggtagtcatgctgatttttcaaaatcagcaatttaatggcatttcttttaggccaaatttacatccattaatatttgactattttttgttttatttgataaaaagtatttcaaatttgttttatccattttttatgttattttttagtaaaaaaacaaagagtgcctttatttgaaaaacaaaaatattttatataactcatatattaatttattttggttaaatattgcatatttattcatttcagttttttaatttatatttgcatttttccaattaatttaatttaatgtctcgcgccaatttcctatcgtgcaccgctattcaaaccaagcatttttaattttaattttaattttagaaatatctttttatttgcacttaagtaaaaaattttaatttttgtcttagttgttttttatctttcaatttgtttaggactgggagtttcagtttccttatttttatgtaatttcttttgaaacgccgtttgtcactgataattcgtttgatttttgtacattttatattatttttcctttagatttttttgtaataaattgagtacacttacttttttattagaataatcttaataaatttactttttataataatagattttttaatgatatttattttttaatttattgttttcggcaacatccatattcagatttttttttcttacttttacagtatcttaatcggagattatgtaattaggcttgatttgtttatgtaatgttcgtttattatgtatattaaagtgccacgggaccgggaattttgggcaaacccgggaccgggacctttttgggttgaaaacccgggaatttttggctgggaaaccgggaaaaaaccg

SEQ ID NO: 30500 - DNA, 1492 bp, Heterodera glycines
caaaaataattgggcacatttttttgtttggcatttagcgacaattgcaacgaagcattgaaatgccagcgcaaacgattggtggacttgaagatgctcaaccacgacatgaagttcaaattggagagtgcgcagaagaactgattgtgagacgggtcgaattcgatagcgcataatatttattgtccattgtttattgttgtaatattttgccaattactatattatatgtaattcaaagaaacatttgcctaagtccccaaacgcaccacccttttacgcgcacattatattaatttgaaaatttttcgattaaataacttagaaaatatattcaaataaaggaaccggtaatagtaccgatggtagcccccctttttcgaaaaataaaatttttggaatttttttcaagaagaacgtataagaggttctaagggtcggtgaatccgaatctgacataaattcgacccatgtcgaaccccggacccgaattcgaacaaaaagtcgaaaattcaaattttacgtatttccaggggtgccattttgccctggaaaccggcatttgcctggttttgggggtccgtgccgggtttttgggttttttgccgggtttcctgtttccactcatttatttgaattttattaaacatttcgccaaaattaagaagcaaatatagtttttgttaattgttcaggtttattttattcatttttgatcttcattttctagtccgcagaatgtcccaaaaatctttttctgatttcatttccaaagttatatttcaacatcttcaactcaaatttccagcgctgaggaagcaatttcaggttctagttttgttttttcagcaattttacgcggacgcacatgaatatttgggcaattggtcacagcaattctctgagacggatgaaattattggagattgggtcattttcgagtcagagccaacaattcgaaaggcgtataggcatttctgtggggcatcaactgacgaaatggatgctttgtttggtgagatcgctgagttgaaacaaacattgaaggagctcgagggcgaccggttcaacaggaaaaacgtggacgaaaaatgggcggctattttcaaaaatcctaattttgtcctgctcaaatcactagtctctgcaattctgtcgatattcccttctaatgcattttgtgaatcagtcttttctgttctgatgaacatcaaaacggacgagagaaacagtattggcatgcctttgttaaactcgctaatttcaatcaaattcaatgcaaatatttcatgtcccaatgctcacaattactttctttcattgccaaatttgctcaaacaggtgaaaagcggtgataaatatgttgtttaattgtttttgacgtttttttacaatgaaaaattggcttaaaaaactgccgggtttttgaaaatttttgccgggtttttcaactggtttgccgggttttcgagttttcgcgatggcacccctg

SEQ ID NO: 30501 - DNA, 1319 bp, Heterodera glycines
atgttttatgatatatttattttccgaatatttttccccaaccgccggcaataattttcgtcaaatattttgtaaaattccctcaattcattttttaatactttaaaacgcaaatggaatttggaaaattttgcaaaatgcataaaaaataatgcggattttccggtgacgcagatttggatatgagtcatttcgatttcaatattaaaaacctttttttaatttttttggaaattcagagcaaaaagaaaatggcgaggcaaccgcagaaacgacgacaaaaacagcaataaccccaacaatttctgaacaacaaacaactggttcttcttcaattgctgctgttcaatcaattttggtggtaaaaaatggttaattaattgcaaaattttctgaaaaacacacaacaaaggcaaagaaaaagagaaaaaaatgctggaggcctagagattaggctagaaaattttttggaattgttcgaaatttcatgataaattatatatatacattgaaaatttttggcttaattttcagaccgatgccccaacaattgtgccaacaagttcaagcagttcagcatcaccaccaccaccaccacaaacaacacaatcgcccgtaatttcatttatgacattgatgaacaaagaagaaaacgccaacattaaacatggggaggagaaagtgagaaaattaatttgattaaaaaggagattaaataaattttctttttaaagaatgtattaatttaaattttatttgaaatattaaattaaaataaaagaattttttgtaaatatattttttcaatatatttttcattgacgaaaacttattaaatggaaatgtttttaaatcaaatttatactatttttcaaaatttataattttttacatttcattaattttgcattttttcaataaaattattttaaaactttcaaattctttgttgtatttaataaaatcacttttcatttacactttattattaattctgctctttttttcattatttaataaaataatcgtcaaaattttagggattaaaattagaagaaaatagcggacaaattgcagctgagctaaaggcatttgaagaagcacaaagtcaacttggcaatataagtaaaaaattaaattaatttaaaattattaaaaaaaatttgttttttttcaaaaaaggtccaattggcattgggccagctcggcttcacccaaaacagctgaatgaagaggcgacgcgtcaatatggcgccaaaacaattgtctaattttctgaaatatttgttaaaaataggaaaataaatttatatcgtata

SEQ ID NO: 30502 - DNA, 1218 bp, Heterodera glycines
cggtagaacaggcacgaagctgatggatgcccacaggcacactgcccagaagcttgtgctgctcatgcacattgaatggccaggccggtgattgagttcgttgagttcggggaccatcacccgaccgttcattgtgctgcagttgtcgtcgcggcacgacccagctgatgggcaccttttcactgccacagtcgagattgtgtatgatcggagccaactctccgttttggggacacaaaccattgtgatcgaggccaacctgagtcgaaccgtccccaggagctcgtcctgctgcgttctgatcacaaacgaattgacctgatcggctggcagtaaggtgatgattgtggtggcagttccggcacattgaagtcctttggccgttcgggcacagtcctccgatcggacagtgaccgagagcggctttgaggcgaatgtggtgccaattaggagaagaagcgggaggagccccgccgcgactgttcctcggactgtcaattggttccgtttcggttgtctccatgcgtgcgcggctgctcgggcccgtcgtgacaattgaagctgttgctgtagctctcgaactctcgtgcgcgcttttctcgctcctctcttcagcttaatctcgacttgtgctgctgttggcggcgaaatttgtcttccggtcgcccaattgaagagacgaatggggtactttgctccccatgcaattgctttgccaagagctgctgctcccgaccaaaatcgtccgagaattgggcatatgcatcccattatggcgagaaggaatgccatcccgatcccgaccatcgtcatcgtccaccgggggaagcagcgtggattagcgaatgctcccagcaaattgcgcattggatcagatcacattctgattttgctgggcaccgcctcgttgtattgaaaggggcattgttcctccaccagcatttgccatggcaatgatccgccggcaattcgtagttcacatccgtcgacttgggcatggtcgcccaacatccgtcggcgcagcaaatctcgagtttatttaattcccgcccactcatgattgtgacccctcgttttgcacattccatggtacatggcatttttgggccttcttgaaatggcaggttcgggtccattcccgatgatcgaatttgacgctggcagccgaacgttccgacaatgctgatgagcatgatcagtagtgccattccctgtttt

SEQ ID NO: 30503 - DNA, 1014 bp, Heterodera glycines
  misc_feature (22)..(22): n is a, c, g, or t
ttagggtcgacgctatcattcngaaaatgtcgtcgtattcttcagactgatgatcagaaaaagagataggcgtttttccaaaatttcgacatcaaactcgcccagaaaagaaattcggaaaaaattagggtcggcgctatcattcggaaaatgtggttggaattcttcagactgatgatcagaaaaagagataggcgtttttccaaaattttcgacatcaaactcgcccagaaagaaattcggaaaaaattagggtcggcgctatcattccgaaaatgtggttggaattcttcagactgatgatcagaaaaagagataggcgtttttccaaaattttcgacatcaaactcgcccagaaaaaaattcggaaaaaattagggtcggcgctatcattccgaaaatgtggttggaattcttcagactgatgatcagaaaaagagataggcgtttttccaaaattttcgacatcaaactcacccagaaagaaattcggaaaaaattagggtcggcgctatcattccgaaaatgtggttggaattcttcagactgatgatcagaaaaagagataggcgtttttccaaaattttcgacatcaaactcgcccagaaagaaattcggaaaaaattagggtcggcgctatcattccgaaaatgtggttggaattcttcagactgatgatcagaaaaagagataggcgtttttccaaaattttcgacatcaaactcgcccagaaagaaattcggaaaaaattaaggtcggcgctatcattcggaaaatgtggttggaattcttcagactgatgatcagaaaaagagataggcgtttttccaaaattttcgacatcaaactcgcccagaaaaaaattcggaaaaaattagggtcggcgctatcattccgaaaatgtggttggaattcttcagactgatgatcagaaaaagagataggcgtttttccaaaaattttcgacatcaaagagggcagaaagaaattcggaaaaaattagggtcggcgcta

SEQ ID NO: 30504 - DNA, 1014 bp, Heterodera glycines
atgattttataataggcgtataattaatagatatcatcccaccccgtataaaacttggtatttcatggtgacaatcaaacctttttttgaaaaaaagttaaaaaatttggcaaccaaatagtgtagtccatggaggtaagaaagcagcgcactgtgggagagagtgcactatttcctgaattttgtaaagcataggtcggtggttttttctttgttgatggattaagaaagattttggctcaaaatgaagaaacccctaagaattgaacttacaaaaaaatttcaaaagatcgcttctaattcgcacccaatcttatccccatttacaaatattcccctctcatttcttgcgaaaaaaacatttttaaagcacaacgcaaaaaagtacacatgcggtgaaatgatgaaaatgataaatagaaataaaattattgtaataaatttatccagcgaaaactacaaaccatttgaataaaatcaatcattttcattgcataattaaatgctttcgtcatatttcacttgctacgctattctcttagaacaagcgttcgggttcgtctttgaatggcaaggacgtcattgaaattgatgagcatttgaataagcattaaaattttacaatttttaaattatactacctattgtttaattttattcaaaatataccattgaatatgatagatagggatagtttttttatgtaaatacatttttttcctgtattctccatagtccaattagtaggaaaaacattttcttttttgtgtttgcgaacaaaagttgggacttttatttacatattttcggatttttctacatattacatatgtacatattaatacatagactttttcgtacatatttcgtaatttttcgtccatattttcatatttttttttacatattttgagtatttttgagaatttatagaatttttttgtgaaaaataaaaaaaatttgttttgaaatatatccataaaaattgaatttttttcaaaaaatgatatatca

SEQ ID NO: 30505 - DNA, 1621 bp, Heterodera glycines
tcacgaaatcaagggaatttctgccgatcctggtttcttcctctcaacattcacaatggaaagttggagtttgagttggacagcggtgcggacgtcacagtgattgacgagatcgactggaaacacattggaaagccaaaattggaaccatcccaaggattggttgcctatggcgggaaatccattgcgggcattttaggaaaggcaaaagtgaaactgacgcacgaaggaagaacgactgagtccaatattcatgtcataaatggtaagcacaaaaatttgtgcggccgcgatttgatcatgggactgaaaatcgatctgaaccgagctttcggaattccgacaattcgtgccgttgaaaacaaaaaggaattggaagcatgtttggcccaatatccggaggttttccaggacggagtcggacgatgcaaaaagatggcgtcattgaaattcaaggagggatgccaaccgaagcgatgcaagccgagaccggtgccattttcacttcggaatgaagttgaaaaagttttggaccaatggcaggcggagaaaatcatcgagccagtggcaaccagtgaatgggccactccgctggtcattatgccaaaggcaaatggcaagctgcggttgtgctttgactataaggtcacggtaaatccttgggttggatgtacaccaataccctcttccacgccccgaggagctgttcagtatcttgaatggtgtcgaaaaattcacgaaaatcgatttgaaagatgcatatctgcaacttttgcttgacgaaaaagccaaaagttgtctcacaatttgcacgcacaaaggacttttccacttcgctcgattgccattcggagttgcttcggcacccgcaatttttcagcaagtaatggaagaagttctgcagggcattgatggcgtggcggtttatctggctgatattctgatcacagcagccactgatcagcaacacgtcaaaagaagcgaccaggttcttaaacggttgtctgagaacggacttagagtcaagcgtgaaaaatgtgagttcctcaaaccggaaatcgaatatttgggacacattgtggacaaaaaaggtctgcatgcgtcacctggcaaaatcgaggcaattttgaaaatgccagagccgaaaaatctgaaagagttgcatttctgggaatggtgaactattatggaaaatttgtgccatccctggcaacgctttcagaaccgctcaatgaattgaggcgaaatgatgccaaatggacatggacaaagagccaacaaaaggcattcgataggatcaaaaatgttttgacatcaaccaaagttttggtccattatgacccgcaaaaaccactttttctggccgctgacgcatccgactatggagttggagcggtcatttttcacaaagatgaaaaaggaaaagttggtgtgattgcgtatgcctcccgaacgctaaattctttggagcgcaattactcgcagattgaaaaagaagcgagggcaatcattttcggagtcgacaaattcaaacaatacttgtacggtcgaaagttcgtacttcaaaccgaccacgagccactaaaaaagatttttgggccaaaaggagagctcccgattg

SEQ ID NO: 30506 - DNA, 1849 bp, Heterodera glycines
cctaagccttagtgattttcaaaaataaaataatttccgaggcgcttttcctttggtaccgtatccccccccccttttgttaatcgaatgatttccctcacatcactttttgcgcatttcttccttttccttttccttctctttcccttttttctttcttctcttttttagctccaaatatttattaatttttaattagaattttttaaatttaaatttaacatagcaattaataaacaattttgaaataattaaagcaattattgtcacacacacaaaaacaactcaaattcgtttcaattacctatttggactttgactccttctctccctccctatttgcataacatgaaattagaaacaaatattaggaaaaaataaaatctgtgtgtcaaagagtgggaggagggggagggagggaaaatgaaccaaatcggcaaaacaacaaatgatgccatgccaaacccacggccattagttcgtccgtttttttgaaataggaaggggtactcccccctcccaccgcagaagaattttcaatgggagaggacttttttgggctgggttagaggaacgacccatgcgataggcaatggtaccgcattcgatccccagcgaatcgaataagcaattgatttttgaccggtccatctctgcccgctttgctggtgaactgtcgttgtgctctggcatgccaataatgacgacacttctctgtctttccaattcctccgctgaataacaagcaatataatttattttaataaaaattatttgtttttatgtttactgtcgaaaagtccactattttttgtgtttctgtcgaaaagtcctttactgtcgaaatgtcctttgctgtcgaaaagtccttctgtcgaaaagtcctctgtcgaaaagtccactgtcgaaaagtccggggagccgccaaaattagcgaaaaaatttttttagtggcaaagatccaaaatagtgatgaatagtggcgttaaaacgaagaatttccgagctaaaaatgttttttgtgcatttcagtcgaaacaaagccgcagaaaaaataattaaaaaactaaaaatccgttccctactaatcacactgtaaggccgcgaatggaaagactgattcttgagaccgttttgttttcatgactttcgaacaaaacttttctcccaaaaaagtggggagcataggcagtatttttcgacttcagggtttgaaattggtgcaaatgaatgtcaattcgtgatcagcagctatcctgaaaacccttgagggtaatactatcgatggtgccccccccatttttggaagaattttttttttctgaaatgtcgtggaaacatatttacggggggttttcagggtcgatcgatgatcgcgaatctgacatccattttgccctatttcaaagaaaattcaaaattttgaaaattcacttttagttcaccccctaaatccgctccctagttcactaagttattgctcacgaactgtacataaatgttgaagaattttttaagtcattgaattcacagcctttcttccatctctcttttattatttcgcgaatttttgtgtgaaatggactctacaaaaccgatcgtgtttttgaaggtcagcctaaaaggaaagccggcaacagttgtagggcgagtcggtgagttgtaagctcttctctatgaatgattaaaaatggcttatcaaaaattctgggtgattgtttgtattttttcagatacgaagacgtccgttttgtcagaagcttttgcctctaaaattggtgacattgattcgaacctgcgtggccgtgaacgaccccaactgccgatgtgcccgttgtaggatggtagg

SEQ ID NO: 30507 - DNA, 1116 bp, Heterodera glycines
agcgagcaacagagccctacacaagcaaattagcctgtccttatttacaatatttttcattaagggtctcttaacaatgctggacaagcaacaaagtcttcaattaatgggcaattaattaaccctgctgggcaagttcagcaaagaatcggtcgcataaattgaaatttaaaaaattttgattgtttaatttaggatcatcaaatgattatcaaccgaataatggtcaactgattaataactctgaccaaggaaaaattaacgggcaagtgggaaccgttgttggtcacgaccaacaaggagcaggtcattaattaaattaaaattatcattttattaaattaatttaagcatctcttactaatgaccaaattaaccaactaattactcaacttcaagcaaaacaagcagcaggtaattttggtcaaatgttcttttaaattaactgaatttattttcaattttgtttaggcttacccaacactaatgaccaaccatcaatcactggtcagacaaacaaaggtttattcgcatataaatcatttcgaatattcaaatcacattttaaataaaattaaaatttccagggaagggccgtccccgcgttaaaattacaaaaactgtggccgaaattttcctggacgagcaagagacaacgaacgaagcgataatggcaaatccatcaaataaataattgtttttcattgctgtttattgaacaagcattgttgtgagaggaagcggatttgttataaaaaatatccgaaaatatgaaaacatttttattacccgaatcgcagaataaagtagactttaggccctaaaaatctcaaaattggccctaaacggaaaaatatgcataaaaacttcaaaattttggaaataatatggtagaaaaaaaaagttttttggcacatttaatttttaagaaatttgagttcttaggagccggatcgtcttaagcataatttaggatttatttcactcaattatttttagtaaatttttgttcacaaaattgctattaaaactttttaaatttatcataagctgcgatttttaattacgagacaaaatgtataaacaaataaaagttcaatttttttggtaggataa

SEQ ID NO: 30508 - DNA, 1539 bp, Heterodera glycines
atgagactttaatacttttatttctttgattgtatttacttttttttaaattactaatttattttaaacattggatgccataattttggaattagtaaattttataatattatttaatttatgatttttttcaatttatatgttttcgttttatttgttttttatttctttgagaaacatttttttctcatgataaactcatttttgatggttattaagctatttgtcgagttattagggcctattttttaattttttttaaagccgaaaaatttaaaaaatttgaaaaaacctattttactacttattcgaaaaattttaaatatttatttatttccctacaatttatgtataacgaaaacaaagtgatttaatcatttttgtctttttctgcctaaaaagcgttaataaaaatttatttgttctttttttgtgccttttaggtgcctattttacgattttctgtgcctaaacctaataaactatccctttaattttttattactgtcctaaattttcaattttttgcgccgtattttttgaaaaaaaactttgaggaccagggaggaggaaggaggccggcggtgccggtaggcgccgccgggaaaaaattgatatttgaatacaatacagtgtcagattttgtccaaaaatgaccaatttttgcaattttttgaacaaattttttaagaaaattaaggattttaaaggccctgtggtgccgataggcgccgccggaaaattttttttttgatattttggctatatatttaacagtttttcgatcaaaaattattcattttgccaaaaaaattcaattcttaccagtgtaattttactcccgttttttcggtaaaatttacgggagcgggagtttgaagttttccgggagcgggaatcccgtaaactcccgccggtctctagtgataagggaacccaaaaactaaggtggaaaaaaccagtcatttttgacaggggaccaggtcgttttggcgccgacgatttggcgccgacgttttggcgccaagccaaaaatgaaaaaaaggcaggaagaaattgtaaaaattataaaaaaatgaaatttttcgttaaatataataaatttaacaaaatgaagaaatggaaacaatttatgggttcatatgataattgcgcgaaattccacggagaaattctaaaataatatgaaaatttggatttatgtggtaattgtgatcattttcattgttcgggttcaccgggatgtaattctgcaccaaattgaagaggcgctcatcagccgcttggtatttcttagctttccgcggtggctcaagtccagcaagaaatgacgcataccttcccatcggtgcccttctgctcagctctttgatagacttcgccagaaaaattataacaatttcaatcatttcttacccccccccccctacatgggcgtcaaaaacgtggggccaaaacgttttggtttgttttaatccaatttaaaacaaaaaaaaaaattttgaaaattttttattttcaattttttattcaaatttc

SEQ ID NO: 30509 - DNA, 1495 bp, Heterodera glycines
tattagcgtacaaaatttcagaaatttttgttaagcttccccacgttatgaccaaaaatgttgaaaaaataacttgcttttttgagcttctcaggtcataacttttttaaatcttaatgaatttctctgaaatttaacagaataatagaaaacacttagagctatcgaataataccaagattataaaatttggttcattttgggcgaagttttgaataattttgtgtcaaaaaatttccatttgatggttttttgactaccgtcccagcaccaattcaaatagatcctctaccacaaacattaacaatatgtaaattttgagaaaaattaggggcaaaaaaatgtgtttatcgcaacaataagccaaaattggggcatcgcaacaaattgctttcaatggaaaaggatttcatccgaagccacggaaaggtccttcgttatgcacaatgtcataatcaccattggcatcgacggaatattgttgaccagttgactcattacggaaaaagagctggccagacccattaagaaaatagtttctaacttcatccgaaaaatccaagactgcaacgttatgcaacacctgtactgtagctccaccataaatctgataaaaatttgtatatttattaatttctgcgattattttattatcattttaaagcaaaactttcagtaaaattcctgcgaatcgctggaataaaaatttcagtttaaattttattacataaattccttcaaataaataaaaataagatggctaaatatagtgcttgccattcgagaacaaaaaatttcccgagcaattcgacaccgttacccaaaaacccgagactttttttcacaaaattttctagttcgcttaaaaatcgtttaaaagttctataaattaaaaaatcaatttttgaggcttttcctaacaaatttttgctattttttagatttgatttaaccaaaaaaattgacatttctaagtactttcgcggtttttgagtcaatttaaaaaataaagagaaaacactactaaatatgaacaaaggtataatcaaagttgtttttatattacttaccaatcctttggcatttttgaaatcgatcatcgctttgggttgattttgaaattgatcaaaatctgtcatgtcaacttccacataaaattttccattcttttgatctgccttcaattcagtgtaaattttcaattctttatcaccatgaaatgccgtggcattgaacggttcgccaaatgcgaaataaattttcttctttgggtacaaaacatttttacttttttcaaatatcgcattcgcaatttccttcactccattcgtccatcccttctccgctttattcgcttttttaggctttaaatccgcttctttctccgcttcattcgctttttttggcatcgcattcgctttttgtaaatattgtgccagaaaaagacagcaaattccgaacacagaaaaatggttgttgtccttctcatctttct

SEQ ID NO: 30510 - DNA, 938 bp, Heterodera glycines
  misc_feature (55)..(55): n is a, c, g, or t
  misc_feature (93)..(93): n is a, c, g, or t
gttgtccatttttacccactattttctctcattcatcgtctgctcgtctctcctntattataagctatttttccaaagccaacaacgcccctnttctccctcttttctgttagtcatttctcattggtgttgacgatccaacattcagtgtacaaatttgttaaacctctcaacattttaaatcaaaatcctaataaaaatttcgttgaatttcttcgcctcttatttgtgcaaaattttcgaaaaagtaattttctatttaaaattaaaaaattcagaagcaaattcaagaattttttttatttataaatgcattttttaccacatgaattatgattaaatttttgcgtttcgaattcattttgaaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcctaaaatgaaggaaatattcgatgctgtgcgaactctgtgacccctctctgactctgccaatgcaacagttgtccatttttaccactatttttctctcactcatcgtctgctcgtctctcctttattataagctatttttccaaagccaacaacgcccttttctccctcttttctgttagtcatttctcattggtgtttacgatccaacattcagtgtacaaatttgttaaacctctcaacattttaaatcaaaatcctaataaaaatttcgctgaatttcttcgcctcttatttgtgcaaaattttcgaaaaagtaattttctatttaaaattaaaaaattcagaagcaaattcaagaattttttttatttataaatgcattttttacca

SEQ ID NO: 30511 - DNA, 1003 bp, Heterodera glycines
acgcaaatgcaaaggggcaaaaaataaataaatgttttttatttcaattttttaataattcttggcactgttttgtcttttcattttcggcgtcgtccgaacaaagcatcgtttcgaacacttcagaagccgtcaccaaaagaattttatgtgccgacaaaagctaaagtcaaaattcacattaattttgatttaaatatttgctaaatttgcctctttttcttcccctttcccaaccaaaaagtgcacatccgcgaaatatccattggtcaacagccgatccattcgctcaatgagagtgccattttttgttgtcattctatgaaatttaaaaagtaaaactttggcaggtggttgaatttttccagaatttttattaattaattatttgccgaaacgccccaaacgaaacaaaaattatgcgcaacacaaatgggaggcattcatttgatgacctactttacaatttccatattcttctgctgctgcttttcccattacctccaaactcaccaaagggcgaaaatgaccaattgtccattcgaaacaaaggcaatttgcccataggtcattcattttcggtatatttccaatatttaatcgtaaaaattattatcattaaaagaactttgccgttattaccggtcctgtttttggaggtgggataaaaattgacctggtgtcactgctaaacggggcttttcatttgaaaatcattttgacaaaacagtgcaattaaaagttttaatcagttaaataatgcaagatatttactcgcgccaaagaagccaatcatttggttttgaatgattaaaattttttcaaaagaagttataaaagaagcttaaaacaataaaaaaaattatggacagagtgtcaaatatactaattatttgggtttgaagttgctgcactaaaaaatgccaaatatgcgcattaaatatgcactaaaaatcctcaaaatatgctctaaaaacccgaaaaatgcccaaatatgtactaa

SEQ ID NO: 30512 - DNA, 1215 bp, Heterodera glycines
  misc_feature (53)..(53): n is a, c, g, or t
  misc_feature (58)..(58): n is a, c, g, or t
tcttccgttctcttttcctcttcttgctctccgcctttcacatggtcttcttncgttnccttttcctcctcttcgtctttctcctcctcttcctcttcttccgttcccttttctacctttccctcttccactttttttctctgctcctccactcttctcctcctgctcttcatcttcttaatctcgttgattagaatctccttctcctcctcatccagctcatcttcctcttccgatgatgtgtttctcttcctctctgtccccccactctcttcgctctgtctctgtccgtcttcccttctgcgtctctgtcggtcttcccttctcttttccttcatttgtatcactctctgcctcaattcctcgatgttttcattctccagtccgaacactctcttcaactcctccctctctttttctctctcaaaatggggttcgatttgtgcctcactctctccctcggcttttccctcttctcttccgtccccgtcacttcttcgaaatgtgctcgacaattgagtctgagccggacgactgaccagcaaaagacgttccgtttggcttcgcttgcattttctttttctgcaaggcgttggaaaatgtaaagccatggagggacagtcgagaatctcgaccatcatttcaatttttgaatttatgaacatacaaattgaattccgattgcgtctgttcgctcctttctttctctgttctgctgctctcttcgcccactttctcctccttttctgcttcaccttcttcttcatcttcttcctctgttgccattcccttccttttttggccattttctttctccacactttgccaaatattttgccataaattcgcttcactgcttttgtgctgtgtccatttgtccatcatcgtcttttgctgcttttccttctcatccgactttgtccctcctttgttgtcattgtcgaattggcatgtaaaatcggcgtatttgtcggccacttttgtgtcgctctcgacctggtaattaattcattacctctaataacccatttttcctttaattactctcttttttttttacttggatggcgatgtttctcatgtatcgtattcctcccgctgttttcctcatattcctcctccttttcctcctttcttcttcctgtttttcctctctcttttttgtctcttctccaatttcttcctccgtcggtgtttttgatgccattcgaatgg

SEQ ID NO: 30513 - DNA, 1503 bp, Heterodera glycines
  misc_feature (1474)..(1474): n is a, c, g, or t
ggttcacaacaagcgctgccggggtctgtagtgtggatggagggggcaaattgtcactggcgaagcagccccgaaacgctcgcccggtccgacgcgcggtgggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcccacaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattngtttgagtacccccaaacggacacttgaa

SEQ ID NO: 30514 - DNA, 1812 bp, Heterodera glycines
tcagcccaatccagccggaccaagtgaatggaacgacacaatttcacagctcaagaagctttttgccgagacacgttcgctgtttgtccgtcgcttcgaatgttttaaaattcgacagcaacaagggcaagatgtttcatcactgattgcgcagatcaacgcatcatgtgaaaatgccgacctgagtctgacaaaggagcagctcaagtgcattattttggtaatcgcgctcaatgatgaacatcatgatttgcgacaaaaagcattgaaatgttggaggacgctcagaaaaatggcaccaacatttcgctcaagaaaattgaggaggaacttcgggcaattcagcttgtcaaggagagcgccctttcgctggtcaacccaccaattgccacaaacgccattcgcacaaggccacggcaatggaccgacccagcgcaaagacaaagcggcggctccaatcaaaggcaaactccaaatgccaattcaagcggaaagccaacgcgtggtcaacggacgcatccatgtggatcatgtggcaaaattgaccactggcgctccgattgctcattcaaggacgtcacttgcctcaagtgcaacaaaaaagggcacatttcaacaatttgccggtcaaagaagacaaaggcaccaccgaacagccaccggtcattccacactgtcaaaatcgacgcaaattgcttacatgtcggcacgactcaaggacgatggtggaaattgtgcattttgattaatggaaggcaaacttccatgaatggcgacaccggcgctcaagccacaattatttcattgcaaacatggcgagagttgggagaaccggaactgactccatccgatatcgatgccaaaaactgcaatgatcagccattctccttacttggcaaattccaatgcactgtccaatttgccgacaaaccaccgcaaattctgatcgcttatgtgagcggagaagtcggacataatttattgggattgccgtggatcgaagctttggagatcattccccgccaaattttatttccgaccaacaaatcggatcaggcgacaaaaatgatcgacaatttttcggcagtgaagccgccaaacaaatcgatcaataatgtgtcaacgcttaaagcggtactccaaaaagatttccctgaagtctttgaagaaggactgggacactgctcaaaggcaaaggcgcatctcattttgcggtctgatgcaaagcctgtattttgccgagctcgcccaattccacatggcgccatggaagctgtgaatgccgaattggatcgccttcttcaaattggcgcaattaagccaatcgatttcagtcattgggcagcgcctatcttagcagtaaaaaagaagaacggcaaaacgagagtctgcatcgacttctcaactggcctcaacaacgcactggaattgaaccgccatccattgccaaggccggacgacatttacgcctcactgaatggcgcaaaatttttctcaaatttggatttacgcgatgcgtatttgcaaatggaaatggatgaagaatccaagcaattgtgtgcgatcaacacacatcgagggcttttccaatgccaacgcctgccgttcggagtcaaatcggcaccggcaatatttcagcatctgatggaccaaatttgtgccggaatcccaggagttttcgcgtacctcgacgatggactaatcgccacgaaaaccctggagcagcacatcacggcactttacactctttttgggcgcataaaagagtacggaattcgcatccaactggacaaatgcaaattttgcagcccg

SEQ ID NO: 30515 - DNA, 1247 bp, Heterodera glycines
gaatttttttttatgaattaaatagttaaattaaaaattaaattttccatttgttaattgtaattattaacaatgtttatcgaatggaataaagacacgcgctttcctttacactaattacttttaattaattgtcaaattaattaattacccgcttctccattgacatggccaatctcaacactgtcacagtacggtgccgcatagccatcaggacataaacattccgtacatttgttcgggtttgcgtagccgttatttcgacaatccggcgaatgccatggatagtcgtcacaaacatctaataaataaaaataattaataaataatttaaatgtttatttcttgtaggtaaaatataatgtgaaatttcatatgaaattgggtcaattaaaccaaaaatattttaaaaataatttggacctagtaatatacataaaacttttgctagaaaactttgataatttttaaattttcttgtcgaagtggtaacagcaccaaaaataagacgactaaaaaatattttaaattacaaaaatatatttccctaaataatttttcatcaattaaagaattttcaatcaaaaatggtcaaactcgctacttaaaaaactaaataatttattattagtattttgtatttttgtgcacaaaactattgatatccaaattaatattattttcccattttttgtcaatttctttcatttttgaaatcaaaatggacgccttattgacaaatattaattaatttaattacgttcgcaatagcggtgattaatcgctttggcgtccaaaaatgaaaggcccaggcgccatcccattgtttgctgatagtttttgtcaatcgtttcgattgtttcaagcctaaaaaatgaaattttaataaatttaatttatttttaaattattacttgtcattttttgcgaacgcttttgaattgtagtgcatcacagaaccgaagtcgtatgggtttccagttggcgagccgggaataattgcaaatgcatcagcaatgttctattttagggatcatttaaacggatcccggacatttggacagtggacatttggacagaaccggacaattggacagtggacattacgacagagactgaattttttttactattaaaaatggctttagcagtaataaaaaatatatgttaagaatatctaggtaaattgaattttcgagaggtaggtgcgaggctattaaaataagtaagtgaaatactttctaaag

SEQ ID NO: 30516 - DNA, 1214 bp, Heterodera glycines
tttttttgagaaattttttatcaaccaacgctctcggacaagaaacgaaatgggggggggcatgggcatttttatttttcaaataatttttatatttaatagatattccagaaaaatggctatctcttttttgaggaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatgggcattttatttttc

SEQ ID NO: 30517 - DNA, 1431 bp, Heterodera glycines
cttcttcttcttccccgccttcttcttcttcttcccccgctttttgttcttcttcttcttccccgccttcttattcttcttcttcttctcagcgctggaactgctgctgccgccgctggacgctccaccgcccaccccccgccccccccccccggcggcagggacgaaaatattttcgtcctcactcaccagggaggcctgggagtggcgggttgcagcgaagcggcgggcccgcgcgtggtggcgcccaacaccaccgcgggccatgatgtgggtggtcagccaaatggaggacgggatggtctcgacagtgtcctcgtcttccgtgcccgatttgtggcccttgaattgaagggaaaaccgttttcataattaatcataatgaatatttgttacgacaaaataaaaccctgggactcacttgacacgtgctggtggtgtccatgcgtgtgcgagaaatggaaggtgggcattgctgtggcgtcgatgagtccggcagctccgcccgcaatgttcaggtcgagcgcagcggtagtcgttgtgccaccgcttccgccactgcccccgccggtggtcgagccgagcatttgctgcatccgcggcacaattgtggacagaaaggcgttggcacgctgagccctaaaccaaaggaaagcgttttgtaagtccattcagcgcaaaaagtgaaacgttcccataaatgaaaaggattttgtttaaatagtataataggcgtaaaaaaacctggcgtcctgttgcacactcgacgaactctgaggctgctgatttgtgtggtggtgcggtcttcctgacgaactgaaaacagattgtaaaagcaaactccaatccaatttatacgccccaagtttatcggcatttttccctattttcatttgttcaattaaccgtacctctgtcccccgtggccatggtgtgtgttcggtgtggcggcgacgccattcccaacactttttgccgatgacgacccgccaggaccattgccaccactcccatttccacttgagccctgctgctgaacaccagacgaaccagaagcactgttgctgcttttgtcctgctgaattttgaggaaaaataagaccgaccaaaaaatgaaagaacgaaaaataaaaaacaaatctttaaaatgtacatttccttttgatgtcacacctccatattaaaaaaaaaattgccaataagctgaacatttatttgtgcgaaaaactttggcacgaaaaatggaagcggtggaaatttgggtaacccttcggtattggtgtcccgacgaaaaaaagagataaacattttcttttaactttttctatggtaaaaaaatggcgctgatcacgaatccgagcttggattttgcaaatcattgagcttatctatgatttttcatcaagcacttgattatttttgaaacttttt

SEQ ID NO: 30518 - DNA, 1620 bp, Heterodera glycines
  misc_feature (81)..(81): n is a, c, g, or t
  misc_feature (148)..(148): n is a, c, g, or t
gtgcaaaacgacatttacaatgactggacgcatatttgtcaaaaagtgagcctctgaaaagcctttgctttatccgtcgtntaagctcaaactgaccttctacaattacaagtcgtctattgagaaatacaacagagaaacttttccnggtaattgctttttattttgttatatcaattaattaggtcattaagttctaatttcatttctatttttgacagacatacggcggtgaaaattctatttgcgaactttcaacggcaagcgatggcaactttttggaggttctcaatatttccatgaacagtttcctggcgtaccattctgaccgccgatttgaaaccaccgggcaacaggtaaccaacgaaccaatcgatttgtcgctattatacaatacaccgaccaaattttgaattatttacatgtcgaattaattttaagattattttcttgaccccgggcagcggtgtttttaacgtggacagggaaatggtgaatttgaccaaacaacggatcattgacatgggtaacactttgggttactttctttttttaaattttggttcatttccgtcggttcctttttcagggatttccctggacatcgtatgcctcggggaacagcccctccacgccgttccgttgttcgtcttcaaacacaaatcgccccaacaaagcgacgactatttcataccgtaccaattggatttacttgctttctcctttaatttatcttttttattattaatttcagtcattggatgaactattcctatttcaatatgccccgaaattcgtccatttcgtccaaattcaaaactcgcattaattttccagaagacattgttaaggtgctgtgctttacttacaattaacttgctatagcctttctgtttccaaattccttgctcttctcagaacacggaagaaggcctctttttggagaaaagcattgaaggagaggaggaccaccgcatttatgacgaaaaggcctttgcctcgttcagtcagactaactttggagctgcagcaaatgcgctgaatgaattgtacaaagagctgatggtatccgatgggcctcaaagcgttgatttcgtaagaatgaattaaacatttggcgatgcatccatcgttcgactcattctctcctcttcagtatggtaggcgttcttccatctctttgtccgcttccgagcgtcccattgtcggctcactcgaatgccatgcaaatttcggcgacagaaacaatttgggcagcgcaatggcaccgcgcggaggctcattagagtcgaagtcgctgatgagtgagtgtttgccaattcaattccattactaatcactcttttaggcaatggtcaacgtgttgcaggccaaaggtccattcccccccccccccttctcttcctggattttcaattagtttgtgtgttttagtggtccctattttgagcccatccagcgtggttttgtcaacccttttcgtcctgaacaatttattgtgcgaataacagcaaatcggcgacgttggattcatggttgatcagctccatcttcaacaattcactcttttttaaatcatttacagtgtttcccgtcgaccgtctcggcagagcaaaattg

SEQ ID NO: 30519 - DNA, 981 bp, Heterodera glycines
aaattatcaaataattatttacgatttggtagaattggcttgtggatagctgtggttgagatggcctccacaaattccatgaactgctccatgtcgatgcccaactcgtccaaagtgagcgttcgctgctgcttttccttcatctccatgctgagcattcgattgatcaccggcgaaacggacataagaaaatgggaggacagatcgatctgaaaagtttaaaaaactttttttcttttttacaagttacatttaataaaataatgtcttttatttttgaaaataataattttctttttataacatcgacaattttttgtttttttaataaagttatgttaatattattgacaaaaaaatttatcagctaaattttgtatctaagtttcatatgtaaaaccctattaataaaatctaattgttaagatttcctgatcatttaaaattaaattttacttattttttcacctttttctcaccaatttcaacattaaattggtcgtctggcaaactgctgatcggtgggcacagactaaaaacaaaaaaaaaaaacattcatattttactaataaataaaaacataaaattggcattacttctcggcacttttttcccgttttttgagaattctaatcacaatggaacacagagaatacaagccgaattcaactgtctcacccgctttgatcattttactctaaaagaacttaggtaatcatataggtggacttaattaacaaaaaatgttagaaaatacgaaaaattatccagacagtttttcacgattaatttttcaaaatacacaaaaaaccaatttttttaatacgaataagctcacttcgttgatcacttgtttcccattcctatcccattgccattgaataatttgtgccaatggcacacccggaagctcggaagcactgccaatgcatttgatttccaaagatctatcgcggttattcaaaataaactcactgaaaa

SEQ ID NO: 30520 - DNA, 1050 bp, Heterodera glycines
  misc_feature (37)..(37): n is a, c, g, or t
  misc_feature (947)..(947): n is a, c, g, or t
aatcgtaattacgctcaaaaagcttctcaaacaattntagcgcatccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcatgtgatctacgcctagaaaaaaatggtgtaagtaaaaatcgtaactacgctcaaaaagcttctcaaccaattttagcgcatccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcanacaattttagcgcatccaattccttctacaatcgcctttatacatcccattatgaacgctaaaaatatcagagtgccgaaaatcgcatgtgatctaagcctag

SEQ ID NO: 30521 - DNA, 1107 bp, Heterodera glycines
catgtcgagagcgttgttgcatagaaatttctcaaaaaaagagatagccatttttctggaatatctattaatataaaaattattgaaaaaataaaatggccatggcgcaccgcacttcgttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaaaataaaaattatttgaaaaataaaaggccatggcgcaccgcacttcgtttcatgttcaaaagcgtttggtggataaaaaaattctcaaaaaaaaaaaatagccttttttctgggataatctattaaaaaataaaaaatttttttaaaaaataaaa

SEQ ID NO: 30522 - DNA, 1549 bp, Heterodera glycines
tcactcatcagaccaattgcatcattgaggagtgtaggagaagccggtccttcccaattcgatcactgagtacgtttttgcttcccatttctctccaggactcgccctcgcccgttccactcgcgtcgccctcgacgttctgtgggggtggcccttcgtccgctgcccctgccgcggtcgctgcctccgctgtttctgatccttcccccgccactctttgccacgtttccaattcattgtctccttcaccctcattctgccagctgaattcctcttcgaatttttcacttcgatcaccgaagtatcagctgcagaagacattgcccccggcagtgaaacctccttttgtccttccgccggcggtttctttttgtttttaattagacttaatgagttaatgaccgaccggggaatcagcccattttagaatggttgattttgatcaaaatgaataagatcaccctcttttgtgtttctttcctccctccatttgcccccccccaggcgaccaaacgctctccgccgtccccgccatgctcagtgaatgcggccgtggcacgaatattcaattcacttttgtgcatcagcaatttggaggcacatttgtgcaaattttcactggtcatcgactcaatgcttttgctcagaattctcatgcacaaattgtcctggtcggcttttcactttgtgccctttctctgctttccgctgttaattcgttgtttgccccagggacctttgtttggtgccaaaaaaacggctgctcggctccggcttggccgtcaccggtgcccccgggggtccgtcgaccgaccccagccgaagggcccattcgagctgttctttgggcagttcgttcaagtgaatagcccggaggggagagagagagctcagcattgtttgctttcagaagggatggccaaaacagtacgaagaatagcagcagcaaacactttcttcgcgttgactacggcggctcttcgcgactgtccaaaagagtgcacatccgtcgctcgaggcacgaattggctaataaaggctggcttactcactgggccgttgattgatcgctcctctgatcagtcgaacgaatgcttttcctttgtttagctcagttgaaataccgcggccgaaacgatttagcagcggcgcgaaggaattgaggaaagaacggaacagaaaaaggtacgaaagtcatcggttgggcaatggcatttcgccgcttcagactcggcactgacacgagcagtgggtcctccaagtcgaagaagaccaactcctcctccacgtccagcgtccagaaacacttgcccaaatacatcaccaatcttttccgcgggcgcatgggcaccggtaggaggagaaatacgcttttctaccaaaagcactcattaacgatccgtgcaaacgacacgcccgaggcagtcgcgagtcgagcccagaaagtccgaccagcgggtcggaggcggttttggaattcacaaagaaattacaaaatgcgccgccaacgcgtcgcgaaacaatgcgaatggcgtacaaacagtcgggc

SEQ ID NO: 30523 - DNA, 1483 bp, Heterodera glycines
tggatggctttaaatctgcaagaaattagatggcaaataagtggttgtaaaaaacttttgggtaatgaattattttttgaagtgaatcaaacaccctattagtgctttgctgtgccgagaaccggtatgcaatggatggctttcaatctgcaagaaattagattggcaatatgtggttgtaaaaaacttttgggtaatgaattattttttgaagtgagtcaaacaccgtattagtgctttgctgtgccgagaaccggcaggcaatggatggctttaaatctgcaagaaattagattggcaataagtggttgtaaaaaacttttgggtaatgaattattttttgaagtgaatcaaacaccctattagtgctttgctgtgccgagaaccggcaggcaatggatagctttaaatctgcaagaaattagcaaagttaggcaataaatgattgtaaaaaaattttattacttcaaaaatgaattattggagggccgagtctaaaaatggtctccaaaaacggcatttttcaagaccatcaaataacaaaatgttttaaaagtggttttggaaattccgaatttaattaaactaaataaattgaccacgctgagtccgaatatggctttagatttggtctctgggttctcaacaaacctgtacagctccaacttcatgcatggagttggagcagtacaagctcagggttaaaagataggtcagatttaaggccatattcggattctactggtctaatttgtacagaaaaccttcttttttgttatatcaggttacttttttgaccataaaaaatcgagaaaaattagtgggccaattttcaatttttgcatggtcgggaaaaaatactaaaaaattgaataagcaaataaaaaatgaaacaatggcatgaaatgaaagaagactttctgacgaacaaaataaaaaaagaattattaaaataactgcagaaattacggagttatgaatttttgaatttgtcaaaaaaaattgcgcggaaacttatgttacaccctaagtacaacaatttttaaaaggaacattaaatttaaaaaaaatcaaaaaaataaataaataaaattgttaattaaaaggaccattaaaaagatggtgcctggcccgagcacagaagagaacaacatcaccaattgataggcaatatacctaaaataattgcattagttaattcattttatttactattttaattggtattgattatatgccatttttgtttgtttttttgaaaatttagtcatgatcgcgtggattttgaaaaacatatgttgtttagcaacggttgagggtgggttgttgtaaaagaggcaagtttttggtaaaattaaaaacaaaatttcattaaaattccaattttataattcatactatcttttttcccccaattttttttgacgtaattctcatcagttaattttattttaaaatgtttttattttcgctataaaattgg

SEQ ID NO: 30524 - DNA, 1040 bp, Heterodera glycines
ggggatctctagagtccttcggtcgctacaaagttcgttttggcatttgctggctaataaaatcaattgagccatttgaattggtgaacgaacggaccaaagaaaagctgatattggagcaaaaagctagaaagtcttggctgatgaagcgatgttcaataattgttggggagacggaggcgacgattcaatgggaagacaacgaaaatttggacgacaaatttaacaatgtcaaatctaatttgtgtggtggcagagttcgactgggtaagcgcaaaagaaatgcacgccaaaattacgccgccaaatttcttagtgatttttttgaaaaattctagaaaaaacggtaatcgttcacatcattggtcccataaaaaaaaggaaaaaaagggtcgttttttgcgattctgagaactaccagggggttatctagggcgctgatcactagggcgtgtaattatatggatataaaatcgcgaaatatggccataaaatatggaccaaaaatcgcaaaatatggacataaaatggcaaaaatcgcgaaatatggacataaatggcaaaaatgtcaaaatatggacataaatttttcaaaattgaatgtaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttatttttgacataatttattaatttttaagaaaatttaaatttattcaatattctcgagaaattttggcgaaaaaatgattttttgaaaaatttttcgggttttgggctcaaaaaggctaatttagctgctgggggccgttctaatagaggtttttttgaaaaatgccaaaatatgacataaaatatg

SEQ ID NO: 30525 - DNA, 1576 bp, Heterodera glycines
ttgtgcggggtgtgaggtacgtggaatgtgcgtgacgttaaggagcgtttcgtcggacggcgcggctgttggaaaatagggggatgggacccgggggccgaagaacgccaaatgtcgtcattgcgaatgtaaatggttttgaccggcccacccccttttcccctgtttccgatcatgaccttaatcggctggggcaactcaggagtgtcgttggatgggatctgagcaggtttatccgaactgacagtcaaaggctcggccgttggtgtttcttcctggggtgtcggtgccaattcaacatccttaggagacgggggacagggttcggtgttgtttgtgtcggacgccaaggaaacgctgtcatggtcattaatggattccaaaatggaattggggccaatttgggaattgtcgggtgtcaatttcaaatgtgaaatgatttgagaaattaaaggggcaatttttggggtggacttagggatatggctcattctgaattagagaaaaaattaaaaatttgcgtataacattaatgggaagtttggcgaggggggtcgatttgctgggtcaattcgctaatggcatttcgaatttcggctaattcaatagaggtgataggtgagacatgatcagtgtggggggtggaagcgttaagaggacaacgagggaaacaattgggacaaaaaagggaaaaaagcttaaggaaaatgagaagaatgagaagggaaaagcagccaaaaacagtgagaaaaagggcggaaagctcaggctgctcctcaaaatatgaggccaatgaatccatgccaaagtacacggcggcagtagacaaaaatgataaggctgtgcgggtaacgggcttaccaactcggcgaaaggtatttgggacgaccttaccctttcccttggggtgacctgaagcgtggtggaataggctgaccaagagcatgaccaaaattgtcacggtggtgatttgggtccgggtacgatttgggtgccgaccagcagaggaacgtgcagcagaagttttgatccgacggcaaaacaaaaaacaaatgcagaggaggaaaatgaggacgaggcaatcagaagggaaatgaagaagccccaattgttggtggggtcgggagaggggctccaccaaggaaggacgatattaaacgaaaaaatttcaagagaaaaaatgttgcccattgctaaaaaaaggtggggagtaaaatttaaaaaaattaatgaaaaaagggagttgtgtgtggttaaataggataagtggaacataaatcggctgatcactgcgatcagtccgccttcccgccacggaacattggccaaggaaaatgaataacaaaaaaaaggaaaaaagagggggggaaatggtctttgtacaattgttgtaacggaagtcccttcacgggcgggggttgatttgaggagggagcggggcccaagccttgcctgggaaaatcttggatggaatttctgtttgcggtttttgctgattggtttgctgtaatgttctgggaaagtcagcgttcgtaagtgtattgcgatcagagggaatttttgccggaagcggagg

SEQ ID NO: 30526 - DNA, 1649 bp, Heterodera glycines
agataaattaatgaaaatttttttttgcatcttataattggaaacataaaattttataaaaaaatttcgttcaaattttggctgggggatggcttaattagaatttactaattgggtaattcatattgaaattaaaataatttactaaaaaataatttatttaaaaatatgaggtgaacaaaattcatcaaatccttcataggttttatagccctgaaacaaaaatgaaaatgtgggtggtcgtttctaaaccgatacaatggcaacaacaaccttgaaaaatttgtcaaatttatttcccaattaattacaatatttgcccaaattaatgcttttggaatttgttgaaaatgcaataataaataaaataaataaattatatgaatgctgcttgcgtgttcaatcaaacaaactggctaattaaacggggagagaaaaaatggaacgttttaattgaacgaaaaatgggcatatcaatcctattttaaatttcagctagtagtttataataaccagtagctttttcctgtaattaaaaatagaaattttaaatttgtaggtctgaaattgaggctttgatattgtcgatgccaaggatgtacatatgcggaattatttattcaataagctttaaatattttcaaattttaattttaaaaggaagcattgcccaaaatgcataaatttagaatttttttaattgacgacaattaacgaattcaattaataacacaaattgtttgttttggcagaccatttcattctttttaaagccatcttactaaaattagggaaatttatcccttttatggcatcgataattttttctaacaattttattggctttttcccattttattaaattttaagaattaaaaaatttaacacttttttgtaattaaattgaattttttaaaaaaagaacataatgagtgataccgaaaaatccattgtgcctttacagggtctaattaggttaattaatatttatgaaaattaaatttaaatagcaatcataaaaatgatgtgccgcactagtcatctaccgatgattctatttgccgcttttattttaatagtttacctagcattatgactcgtttaacctgcaacgtttggaagggtcttaggttcgaaccccagcggggtgttaccttctgtttcaacaagtagcatactgtactaaatggtagtatagggtgttattttcatcaatttttggaaaacataaaaaaaatttcataaaatttttttcatcattaaaatttatttttgcgacgcattcaaaaagtaatatttggacctgaatcattaattatcacctgattttcatggcgttttgattttttaaaatattttgtgcaaattgctatggtccgagaaacagattgaataaattcgtcaaggcctggttctcggatctctatgattaaattcccgaatcccaattttatgaattatatattaaatacaacccatgcttaatgctaattaattgggtaattataattgtcataatgagcgcgaaagcttctcagtgaatcagaatttgttgaggagtttcggtagaatgacgatttaaaaacctaagctcaactgatatccaaaggtaaattacaagaaccaaattacagaattttaaaaattta

SEQ ID NO: 30527 - DNA, 943 bp, Heterodera glycines
cgctcataatgggatgtataaaggcgatgtagaaaggaatggaagcgctaaaattgttgagggagctttttgagcgtaattacgatttttacttacaccattttttgctaggcttagatgacatgcgattttcggcactctgataattttagcgctcataatgggatgtataaaggcgattgtagaaggaaatggaagcgctaaaattgtttgaggagctttttgagcgtaattacgattttacttacaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttacaccatttttttctaggcttagatcacatgcgattttcggcactctgataattttagcgctcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgttcataatgggatgtataaaggcgattgtagaaggaattggatgcgctaaaattgtttgagaagctttttgagcgtaattacgatttttacttacaccattttttgctaggcttagatcacatgcgattttcggcactctgataattctagcgctcataatgggatgtataaaggcgattgtagaaggaattggaagcgctaaaattgtttgaggagctttttgagcgtaattacgattttacttacaccattttttgctaggcttagatcacatgcgattttcggcactctgataattttagcgctcataatgggatgtataaaggcgat

SEQ ID NO: 30528 - DNA, 1219 bp, Heterodera glycines
cccccgggaccttcaccccccgcgggggtgaaaatacacccctaagaatgacatattcatggataaaaggcaaaaaatttatacaattttgatttttttaaccattttgacaaattttttatgaattaaagttaattttattattggtcgttgatgtgtagtgtggtgtagtggttagtgaatcaaccttgacattactttctaacgtgagttcgattccggttgacggtttcttttttaatttatttttttaattttaaaattcgcctggcgctgcctatcggcatcgcagggcccaaaaattcgtaaatcttattaaaaaaattctctaaaaattgcaaaacctatcattttttggacaaaatctattaacattcccggcggcgcctatcggcaccgccggacctctacgctcgcacattcaccaagtttttttttttttggaaaaatgtgcctcaagaaaatatgttacaaatctgagttccaattttgagtaaatcatgataatttaatatattaaaaaacaaaaatttatcgtaaaaatcttattttttttgtaaacatctgttagaaatcgagcttaaatttcaaaattcgccaggcggcctatcggcacctccggccccccaaaaacctattttttcttaaaaaattagccaaaaatctctaaaatttggtaattctttagacaaaatctgtgtaatttatgccaaaaggaattgaattgaggcgatacattgactaaaggaatgtggagccatcacatcattcataaaaaattaattttttgtaaaattttttggagttaattcaaatcaaacccccgcccccgcccccgcgggggcggaattatcgtgcccccgtccccgcccccgcgactctgacccccgccatcccccgcccccgcgaaaagccacccccgccccacggggctcgaaccctagttcattttttgtaaaaattgaggatgatttgagaaatccaccaaattgtaatccctgtcatgaaagaataatgcagtttctaaacccaactgatgacacagtgccatgatgtcggtactctgaagaattgcaggttggaattatgtcgagataggagaatggccctttttcgatagtcaatacgttccgaccgtttgatgcggtcacgttttattcggttgtggaagtaaactttagggactctgatgcttccagtgagctcatttcctggcact

SEQ ID NO: 30529 - DNA, 1469 bp, Heterodera glycines
cccccgactccccggccattatttggggaatgagggactccaagcgttgtaaaaatacaaaaaattaattcaacaacgaaggggagaaaggttgaaaatttatgaaaattttgacaaattttcttattattaattataaaaattcagaaaaacttttcggcgccgcctatcggcaccgccggcccccccaaaaccaaacttttttggaaaaaattgtcccaaaattgcaaaaattggtatttttaggaaaaatctgttaacaaatttcaaattttcaaaaaaaaattttcctcgcggctcctaacaccaccgccctcatcacccctttgttccccaaaagtttttctgaaaaagagcgccgcaaaaaatgatggtcaaattagatgttgagacgggttcgcaaaaatttctgtttaaccccactcctttctacgtatttttaaaacagggcttccattaaaaatttttcaaaatataaacaccaagtccaaaataagattttagtgtcaaaaatatgaacatttagcaacatttttccaatcagttatttttccaatttattcgatcaaattttatatttttagtctcctattatcaattttgataattttggggaggaaaatgcaaaattataaatttcagtaaattcgggatcaaaagatcaaaaaaattttgcgccagaccttaaaatttcttgaaaaattgtgacattatgccataaaatttcaaaattataagtatatttaagaaatcagaataattttagtcgctaccccccccccccccaaaatcagaatattcttataaataagaacaaatgtaaaccccagcaggtttaaaggccaacttggactcactcttactggcgctaacgaaatcagatgattaaagtgaaaaaaagaagatttacgagcagttaaaaagaaaaaatggtttttttgggttaaaaaaatttggccattccccgatcggggtccccgatccccgacaattgagctcctccccgccccgacccccgacatgtcgccccctgaggggtcggggagcaaccctagtaattagtaaagggacaggcaaaattaacaaattattcaataaatattaaaattaaatttagtaaaaaataataatttatcataaataaaattattattttttggttgggtattttaattattaaatataattgtccatgatcaatttgagcaattttttgttcgaaataagcattttgtgaaattctgagcatgaaaaatcaaagttgatttttttgcggcgctttttccaaaaaaactttaggggaacaaggggggccggcggtgccgataggcgccgcccggacaatttttgcttttttaatgcaatttgttaacagatttatccacaaaaaagccaaaatttgcggttttcatcaaatttttgagaaaacaaaggatttttagggtcaggcggtgccgataggcgccgcc

SEQ ID NO: 30530 - DNA, 1248 bp, Heterodera glycines
  misc_feature (7)..(7): n is a, c, g, or t
caatacncaacacaccttttcccgcaatttgtgctcctctgttcgcacagtgatcggctggaaccacaattgttggaaggtctccaggcacagcttgcgaacgccctcctcgtcgttgatccgttgcagcagttcgacgagaatttggggccgtcgctcgtattcatgtcggctgaacacaatgtcgcgcagaatgcgaatcacgcgcttgcgcactgctaccgcggtgtcctgttttaagcaaatttaggtgaggtaagtcttggaggagttaccaacgaggaaaatcaaaaatttccagcaaaaaatgctatttcaattctggatttaaaagtgtctcaaaaaaaaaaaaattatcggcacaaaaaccctctcatgggatgcaaatgccaccgacctttgtccgattgaccaaaatggagtagtacgtgtccaacaagtcgggccgggtgaccaaacacttgccgatcagatcgaacgttgcttctcgcacggacgcgttcgcatcgatcagccgatcttgcacaattttgttgacctccgcgatcattagcacctgggaattgaaggagaaatggagcaattatctaattatacggtaattagttgagtttggtcatggattatgtattattgctgtacttggtagtctgcttccacaatttgggccaagcatttcatcgcttttgctcgaatggcgaccgggtacaggtcggggttgaagccctcgaggatcttcttcaggtacaggtcgaatgactgcctaaagcatagaaatgtttaaattgttattttacgaaattagaagcctcaataatttttttagaaacattaccaaaaattgaaaaattttgataatttgtttaatttattttcccaaatgacaatagaggaaaaagcatctatttttttttaaatcttgtaaaaaaacctttgaaaaaatataaaaaaagcgtacgaaagttccttcttggaggccaaatatttgaccacccaaagcgcgtcactgtccaccatgacattgcccgacttggccaacacttggatgcgtcgcttcagatgctgcttgtccatgagggcggtgatgaacgtcttcatgctggcccccttctccaaaatgcgggtcaacttttgctcatatctgaaggaaaggtggaacaaagtcatacacaattatttactcaaaaaggttgtataaaaaatagacacggatacagcattttttcgaaaatcctattttcttaatgt

SEQ ID NO: 30531 - DNA, 1502 bp, Heterodera glycines
cgtagtgaaaaatgaatttttgatttttgttcgattccgggtcagttgttcgaaaaattgtaatcatggagttttaaaataaaaccgatacaaaaaaaatttggcttacatttttctcattttctttaccacgcgccgtcttccaagcgattgctgctgattttcactaatggcggcaaaaattagctggcggtcggcaaatacatttttgacgggcgctgccattgcaaattttaatagcgagaaaaataaaagccgaattggttagcagcgagactaaacgaaagttaaacattttaaacataaaatagaataaattggaaagtatggggtgaaaaaattttaataaatttcttaggaaaggcgtgtgggtactcaaaacaaaaaaaaggtcgcggattcaaaattcggaaaaaagtgaagaatacaactgacaacttcgattttcttattgaattatatatctttcgattccacttgtaacagggatggaccaaatctaaaataaaacgcgaaacgcgttttgcgaaagcaaaaaatacgaaatagaaataaatgcgaaacgcgaaattccaaaaaacgcgaattgcgaaagcgaattttttagacaaaaaagtttgctaacattttagtcaggcgataatcgatttattgatctgctgctatagataaagatgcttctcttttgttgcaaattattttttatttatttatcgataaagaaaaattgccatcagaagggcggagaccacttactctgatgactgatcacataaaatagtctcagagtaagtgaataaatatcgagtgagatcacaggttaaaacaaacaataatgaaaaaataaaatggaagtcagagtcaatgagatgcctcaaaagttaataattgctttatacattggtgctttgagaatcaagagtcaattctaataattttttaaaggtgtttaaggagctagacattaacgttttatcaagggcattccaggccttgactgatctgttaacaaaagatttggaagatttttagattgtaatttaacatttaaccggaaaaataacttgtttcgagtatttaagttatcgtagttcttttaaacagagaatttggatccagatgtgtaaaaccatcgtaaaattttataagtagggatgcgatttctagtgaaaaaactttttttgctcaattgttttgaagaaaggagctctaaaaacgcatttctgcgttaaaattttttcatttgggcgtcatttttcgtcactagaaattagggttgagcggtaccggtaccgaccggtaattaccggtttttttggtaccggtaccggtaccggttttttcaaaaatcaaagtatcggtaccggtttgtctagtaccggtaccgccagtaaaaatttgcactggtaagaatgggggtctgggtgagaaaagagtagggaatggtgaaaaaggagaaattttttgagaaaaaaaaaattaaattatttatttacatttaa

SEQ ID NO: 30532 - DNA, 1172 bp, Heterodera glycines
  misc_feature (73)..(73): n is a, c, g, or t
  misc_feature (101)..(101): n is a, c, g, or t
aactttgcagggatactccccggtaaaggactaacttacactgaaatgagcgccgagctagctggctcaaaanaattttcgaaaatctgagtctttcgttnttatttattttttgcaaaattaattcttaaatatttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggaatctgaaaagaaggagaaatacctttttttccccataattgttcgagtcccccaaccggacttactgcaaaaaattttttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggag

SEQ ID NO: 30533 - DNA, 1394 bp, Heterodera glycines
ctgtcgcatggcaactttgggcttgaaaaagagaagacattaaatatttaaaatgattttcatttaatttttgttcatcggtttattttgaaatttgtcatcctcaacccaattacacgttgagactacgaaaatataccccctaatcggcaccgcatcgaaaatttcaaattttcgccgatttttcatattctttaaaaaggcatattttttcagaacgtttcccattttaggttaaaaaaattttttattgggaggaaggaatactcgagcccaattcatagccggaaaatgttataggttttgatttcgtgtcttttgtccatttttgctctgttttgtctctcttcgctgtccttactcaaccaggctgatgatctcgcgcaactgttgcggcggccgcagcatcaaatccacgttcggttttgttttggagtgaatttcaaaaaaaaatactgcgagcaaatgtagcgcagcgattttagcagcgccaagtaggtgttcgagctgatgtttgacggctggaaaacagtaataaaatataaaaatattgggtttttaagacaattagccgttccatgattaattggacaaaatttcgaaaaaactggtagcgaagtaatgtctcggtcactttgatgcacttttcccattgcttacctgaattgccaacagcttttggacattgttgaggaattcaaagttggcgcccacaacttggcggagtttgtccgggtgctggcgcatgttttcgatgatccgattgaagagtatgcagatcgattccaggctccgcttgtcgtcgacatacacgagccgttgggtgaggtcggaaaggcctgcgaaaaacgcattttaaacataaataaaaaattaaatttttgttaggaacttacaatctttgattagttaaaattcagtttgggtcacgtgaatggcgcaattcgcggcgatggcaaatgccagactttgtgaggcaaacaaaaaaagtcgacatgcgaaatggtcgacgcaatgccgccggacaacagaatgtttttggcattgcgacgcgacatcacttccaaggcgttcagcaactgttcctttattaaatgggggacggatttggcgattaaaatttaaaatgaatatttcttattaaaaaaggtaccgccacgtcaatgtattcaatgcgcttcagcttttgaaacagcagcggaatggcttctgtaatgccgggcaaagcgcgcgcggaagctgaacaaattgggcaattaaataccataaatgaaaatattggtgcttaaagtggcataataaagtaacaaaaaatactaaacgagtggctgtcagcatctgttgaaattgcatcaaataaaataagaaacaaaaaaacaattaccaattcaaaa

SEQ ID NO: 30534 - DNA, 1500 bp, Heterodera glycines
tcggcagaatcacttactgagatcttgcgtgttggcccttctttatttcttgcaacggtgtcagcgtgagttggagtccttttactacaaaaaaaaaacaaaattcataaaaatgttttggaaacgatctttgatacaccgagcaaatccgtccgaaatgatgggaacctaatgaaccaaaaaaatgttttattgccataaaacttttttccctctcaactgttaaataaaacaagcataatagctttaaatgtttggaatttacagataattaggccctcctctcaagggagaaagcaagtgcaaattttgaaaatttcaatgaaaaatggaggggtgcgtcgatcaaaatttttgaaaatttaacgacattttttcaaggtcccagaggcttacatttaataaatatttccattccaacgcctaatttgtatgaaaaaactgagttggcaaatcatacttttgacaattgtcgagtcgagcaacagccgtttccatggcacacaaacggtcagttcctccacatatccatccttcagtgaaaggattcgaacacctaaaaaagtgggttaaaaagcagttaactttagatttggagttgagttgggcccataaatgtgccatttagaaaagtcaggtcgaactggttgaaaaatttgcgatagggtcgaagaaaacgccaatttttgataccaaacccggttccaatcaactctaatgattgcattcacatattttttggggatggtttctaaaaaaaagcagggaaatgttgcaaaaatggcacaaaaaattggcaaaaatgcgtaaaaatttgtccatttttctcccccacacccacccgatgcttccaacgtctcattgatgtactccgtgttgagcatgacgccttggacactggccgtgccgtcggccaagtgcaactccaactggtccgagctcagctcggtcttcaaatattggcccatatatctaaaaatggcataaatttttggatttttagggtgtgtaaaaccaaaaaaacctttggattaggaaccggcatatctgttttgtgaacacagaaaaattcatcaaatatcaaaattagttggcgctgctgaataataatgaatggcaaaatggatgtcaaaatctgtgctaaaaagcaatgattaatggggaaattgagactgaaaattttaataagaagcactcagcgacggtcttagttggtatttaggatttttcggggcttaaggagaggcgacccgcttgaaaaaaaaaaaattttttagccatttattcggatttttcgtcgttttctcacgaattttacccccccccccgctcccctccactcccgagatcgtctctggttcgaactggacccaaccaaagcgggatttctctggtcgagattaactcaattttactatgtcctgggatttcctggacacacagttccagtggacaattcctcggctgtgttgtaagggtaataatctaattatgccgtgg

SEQ ID NO: 30535 - DNA, 1111 bp, Heterodera glycines
  misc_feature (964)..(964): n is a, c, g, or t
  misc_feature (1001)..(1001): n is a, c, g, or t
ccaaattgaagttggtgttgatccgcaaactcctcttgttgacgccaccgcatttcagccgcagcaaatggagaaacggcagagcgcacgacgatcgcgagcacatgaggcgagtttggcatttctcactcaaaacccatcgtaaaattttggccaatcgtatttggggatggtattggttgtggcatttgacgctgatttttcctttgatgtttagcgcgaggaagaaaacgaggacgaggaagtgttcactcgtcggacaaagaacgttttgcagtcaatcgcgacaaaattgcgcgcggcaaatacaaacaaagtgcgtttgcttattgttaatgatttgtattctctttttaaaagcaaatgcattagcttggggattcaatgtcaagatcaaccatttaataaccctttttagattgtcttcgaagatcttttcaccaaagggtcgacgcgtcgcactgcggcacagaaattctacgcacttttggagctgaaaaaatggcaagccattgaagtggaacagcgcgatgctttcgacaccattgaaatttcggccggtgcgcgaatgaatgagacaattaaattggcaatttgattgaagattatgggagggttccttccgtactaataatgatttttcattggatctcaattcgtatcttaatggccatgaaaacaacaaaaggctctgtttgatgtatcacttcttcctcatcctttttatttttcagtttgacttttttttgttcccccttttctctgtacttattttttttatttcagttttgactacttaacattttgtattgccttgttttttattcatatttcttttacgttagccatttgaataaaaagtgcaagaaacatttttgggttcaattccatatttttatgcatacattaagtcataatacgaatacaaaataagtaaaaaatccaattaaaatcgataaattanagcaccaaatttcagtgaggaaaaacggaaaccgaanagggcgaaggaatgagaaaaaataacgataattaattagttcaccgtgtcgtataataaacaggcaaaggaaaagcggagaaagaaagcgatcaccgaacagcaaattga

SEQ ID NO: 30536 - DNA, 1048 bp, Heterodera glycines
gcgccgagaaaaaaattccagaacaatttgtataggcgagattaatctgagaatgcggttggaattccttgcactgttgagcagaaaaagagatatacatttttccaatcttttcacatacaaacgcgccgagaaaaaaattccagaacaattcgtattggcgtgattaatctgagaatgcggttggaattccttgcactgttgagcagaaaaagagatagccatttttccaatcttttcacatacaaacgcgccgagaaaaaaattccagaacaattcgtattggcgtgattaatctgagaatgcggttggaattccttgcactgttgagcagaaaaagagatagccatttttccaagcttttcacatacaaacgcgccgagaaaaaaattccagaacaattcgtattggcgtgattaatctgagaatgcggttggaattccttgcactgttgagcagaaaaagagatagccatttttccaatcttttcacatacaaacgcgccgagaaaaaaattccagaacaattcgtattggcgtgattaatctgagaatgcggttggaattccttgcactgttgagcagaaaaagagatagccatttttccaatcttttcacatacaaacgcgccgagaaaaaaattccagaacaattcgtattggcgtgattaatctgagaatgcggttggaattccttgcactgttgagcagaaaaagagatagccatttttccaatcttttcacatacaaacgcgccgagaaaaaaattccagaacaattcgtattggcgtgattaatctgagaatgcggttggaattccttgcactgttgagcagaaaaagagatagccatttttccaatcttttcacatacaaacgcgccgagaaaaaaattccagaacaattcgtataggcgtgattaatctgagaatgcggttggaattccttgcactgttgagcagaaaaagagatagccatttttccaagcttttcacatacaaacgcgccgagaaaaaaattccagaaacattcgtataggcgtgattaatct

SEQ ID NO: 30537 - DNA, 1233 bp, Heterodera glycines
aattattaaaatttggacaagctcccgaaatcaatcgaaattctttagatttaaacaaaaaaaatatttttttgaataatcttacatttagatcacttaaaacaaaatttttattagttcaaggataataaaatttcaacttaaagctaaagccaggaatagcaatttaaaaaaagcaatttaaaaaaaattcaatttatctaactctaatcaatataatgtgtttttttttcaaatttgtcttactgtaatcgtgaaagtcgggtcgatcgtgcaacaaaaggatgctgaactctttggtgtcgtgcaatttgagacggaaaagaaatgagacaccgttaatcacttggacttgcaattttttgactaatggaagatgtacgcttggcttaaaaaaaataattttttttttaattgtcatttatagagctcgacattttggaaaaaaaatattggatctggcggtctggatttcttgtggacaaaacaccaggaacatccaagtctaggaaaaatcgcaggcttggcattgcctggactctcacgccttgatgatctggatttttttttgaaatttgtactaaaatgcaaacaaattgtttaaaaaacaattaaatgcctaggcaaacattaaaaagtttctaattgacaaaaaaaaagatactatataattttaaatgtatttaatcaattttttgttagcttgaaacaagacatgttcactcgaaataacaaattgtaaaatattatccaggaaatccagctttttggtgcttaaactggaccaccaggacttttttcatatctgacctgaactgatagcctggacaaaaagccaggaaaaatccatgttgccgaaaaatggcctgggtcacccggtgttatgtcgattccaaaaagtgcaataatcaaaaatctgatttttcctattattttttaccattttttaaattaaaaatatgttaaaatttaattaaattgatgatgcttaattaaatacacattcttctaaaaagtttttttttatataactcgaataaaagaattaaaatttacctaatattaaataaaataattaggtaaaaccagattatgttaagctttttcattcaattacaaatggactaaattaaaaaataaactcaaattttaggaaaaatggaaatttttttttattaaatgtacccgcttagaatgaagctaaattgcttgggcctaggtctatgcttagga

SEQ ID NO: 30538 - DNA, 1304 bp, Heterodera glycines
gggatttttagtgcatattttatgcgcatatttgccctttttgagtgcatacaacttataaccctagtaattatgctcggaataggaaaaaaacagggttcggttcgctggacaaaaacggaaattccgagtcggacggggaatcccgagcacaatcatcagttgtaacatcattatgccttttatatcaattttgggttagtggcctccttacttccttacttatagtgcttctctcctctcctttcttttcccttctttctttctctctctctctctttttccaccattttctttaattttattttttgcttcctttttctccccgtcctctgctccttctcctcattttcttcttccttccttcctttattgcctttgctggtgggcaggcaaatcgacgctttgtttgttgatctgaaagtgtttgccgtttttacaaaaaaataaaataaataaaaataacaaaaaaaaatcaaatgaatggtaaaactaaaaaaggaaaatgatcggagggacagagaaaccatcggtcgctaaaggtcaattttaaatcattgtttgtttgtttttttggcaaagtattcgccgtcttcttccgctactccgtctgtgtgcccttctccaccatcttcccattcccccggtcaaatttggtgccaaattttgtgccatattcggaggagaaggcgagcaaaggctccgtcagtttcacctctttggcgtaatgtctcgtgtaaatgcatgaagccaaagtccactaaaacagtgagaaaattaactttctattctttgtgattgtccgtgccttcgaagtcatccaaaaccaaacggcgccgatccaaagattttcgccttggagcccttcgcgggtcaaagattggccccaaagggcggccaaaagcaaacaaatggccatgccgacaaaagtgagcacacaaaggaccaaatctgatcagcgaatgagggagcgattaatataacaattattaaatttctattgccttagggcaattttataaattattcattggatggattttgtaatttctcctgcgtaaatggcactttctttcctaattaacaattaacccactaattgtccacgccatttgaaggcgtttcggtgaccagtcgaacatccacgacttgtgatacgccaaatgggtgaagaacaaataggcagcgcaaacggagctgaaaaaggccattgcggtggccaaataattctgaggggggggggggggggaattggaaacgaaacttgggaattattaatttattgtaattaaggggatttgcct

SEQ ID NO: 30539 - DNA, 690 bp, Heterodera glycines
cgacaacgcatcaagtcggcatttacattctctttgtacacagaaaaatgagtacatttttgaaattgaaggggaaatgcactttttccgtcgaaatgcttaaatgaagtcgaactctgacgatgataccgagtaactccatcagtcgcggctgttgagacttgatgccaatgcaacgaagccatgtttgcatgacgggcaaagcgtagatggtactcccctttttgaatttttgttttgttttaaaatagggttgcaattggaaaattcggggttggaggcgtcggggttgccaaatcgttcgaggtcggggttttttaatttttgccttataccatatagttaaaaaattttatattattttagcttaactttttttattattcaccattcaaaatatatctttattgtaaataaataaataaatctttggtcaaatgtctgtcgtcgcttttacacccgaaattcgttgctcttttccgcttcccccgcttccgttcgcttttcttcgctgctgcccctccgctgcgctctctccggctccaaactcgacgcatcggcgaactttgccggcccgttgacgcgtgaaaagtcggaatgacggcactgacggaagagggtgccgtagttgttggggacaatgaaaagggaaaatggacgcacgacgggtcaaaagggcactccccgggg

SEQ ID NO: 30540 - DNA, 1326 bp, Heterodera glycines
  misc_feature (1275)..(1275): n is a, c, g, or t
ctttattagtcggacggagaattgtgacgtccctcttttgtacttttattggaaaccgttgggctaattccgccgctttttttgtgggagaaaaattggaaatgaaaaattctaatttattgaattctgttaagaaatttctcaaaaaaacccaaaatgtcaaattattggccgcttaaaagtctattggacgaataagtaagtgctcttgacccgaatatttatatgtaatttatctcggcacattaaatctttgccaaaattaaagtttgataatttttttaaacccatattcagagatcactttttgcccgtttttctcaagtaatttctcatttaagaccttagattttttccgcacggttggaccgctaaatcaaatggatttttcgaaaaattttccgattttattggccgagagggcccaatttaaagaattaaatccgttttcgcaacaaaagacatttcaattcgaacaactgtaaagtcaaaagtcagagttgaattgaattaattgtctgtcataaatttaataatgtgatcgaagttcataaaatgagataaaataaagaaagaataaatgtaaacatttgtcgttaacttttgtctttcgcttctgcgtttaaatttgagtgtggaagtgcctaaacatttaaattattttaattttcattttaatttttgagaatgaaaatgcctaaacatttaaaattattttaattatttttcaattttcgttttgatttttaccattttcgcagattttctctctctgcaaattccgatttcagctgcacattgtgaaagctgcccttctcaaagtcctccttgatcttcacgtccaacttcttcctcagattgtccctcaatttgcgcttaaatgcgctgtttgccttttgttctgccgccatttgaatgcccaccagccaatgcctcaggccaattgagtttctgtccaaatttgaatttcgaatttaaattagtctttttttacccatttttctccaagtcggcagaagggcattccgttgggccgatcatttttgggcggacgtggcaaaagtccacccaaatggccaaggggttctccacaaattcaagcagttcgtagcgcagcctttttccgacaaaatcgcagaatttgtccacgttgtgacttgagcctttgcattcgatgacaataaaatgttcgtactcaaacaataaaaactaataaatatatttaaaacatttgttttattactttctcagtgaatgctatcgcttcatcttttngttccattttgctttctcattgtcacatgcttaaataacaataaatctcaa

SEQ ID NO: 30541 - DNA, 1257 bp, Heterodera glycines
acactttttgaccacctatattttgatcaattgtgaacatgtgtaaaataaatcaaataaatgtttatgtcacaaatgcaaatatggtatcattggaaagcccataaaaaatgctatccaatggtatgctacttatctgttgaaattggaaaatgacaattttatacgcaattatttttttcaaagcatgatgggacaacacttatgaccatgactgtatgtcctgaatttgaaaaaaaaacttggtcaacctgaatatacatatacttctgaacaattctaatgctaaaaaacaggtactcacgcgaaaactgaataaaaattttgtatttggaaaattttatccaaaaatttttatgttctaaaattaccggtttttaccggtaccggtaccggtaccggttgaaaaagttggtaccggtaccggtttttgcagtaccggtcagtaccggtaccggtttttttgcaattaccgattaccgctcaactctactcaaaatgcaaaaatgggaaaatatgcatttttctctaaaaccaccataatatgcattcatcttagtaattcttttcacttatttgcttttcattaaatataaatctttttccacttgaaaatttttgttcgtttaattaccaattcagtttctttttcgtccattttttcaatctcccattctttgccaaatatttcaccaaaagttggccgatgttttccattggttttacaaaaaatattaacagataaattttatcgtttaatttctcttatgaaaaagggcaaaaaaaagataatctttcatttatctacgaaattataataaataatttttaaattttattaaggaaataaaatgaaaaaacagataaatggcaaaaatcaatcatcaaaaagaaaagaaaaatattaaacagataacaattttattaaaataattatattaaaaaataattttttaccctctttgatttttgttgataagattttcatttctttgtaataggaattggctgagacatttgcctaataatttccttacaaattagcaatcaaaaacctagataataataataattttaatattataaattacaatttattttctttttgttattttttatcatttaatttctgtgtttttagtagggttgcaaccccgacgtcggggttggaaaattcggggtccggggttgtcggggttggaagcttaaaaatatttattattcataataataattttatgtgctttttttattatt

SEQ ID NO: 30542 - DNA, 1924 bp, Heterodera glycines
  misc_feature (34)..(34): n is a, c, g, or t
  misc_feature (113)..(113): n is a, c, g, or t
taatgcccgtaaaaatttgatgagcgactcctcnttccctctcgtgagaagtgcgccaaaacattccaccattaacacccgaatggcctcaaagacgacaactactcctgacncacacttcaatcccaatgaccgtgcctttgtctctacctgcacccatcttgagttaaacgcagcattggaggccggctacaccgtccgcaaagtcttccatgtcctacaatacgaccaatggagcgacaacatcttcaaatcttacgttagcgaaatgatggccctgaaaatccatgccaccggcttcccttcatggtgcagcagcgaagaggagaagaaggaatacattgaggagaaccgtcagcgatttgggattctgttggacaaggaaaagatgaaagctgaaccagggaagcggtacatcgccaaactttgcctcaactcactctggggccgcttctccatgcggaacctcctctccaaagcaataatcaacaacgacgaaagcctgattcgccaatataccgacgacaagaaaatcgaattagtggacttggaaatgatggatgaggacaacgatgtttttatgctgacttaccgaccaaaagaagaatttgtcgacgaaaataaatactccaatgtcgtcatctccctcttcacgacatctgcagctcgcctctacctctacgaagctcttaaaaaagtagccgacacccccgactgcgaaatcctttattacgacaccgatagcgttatttacgtgcaccccgaggaaaacgacccactaccaacaggaaagggacaccttggagaactaacagacgaaaaccccgaccacgatatcctggagttcattagtgctggctgcaagaattatgggatgaagctgcaacgcaaggacaccggtgaaatagaacatgatttgaaaataagagggttcacccttgatgcacaaactgttcaaaaaattcattacgatactgttaaggaccaaatcttacgttatgggtccgatgaccccgctgaccctatcattgtaacttacccccattttattcgccctaatctaatccaaggtaaagtgtatactcattccctcacaaaacattatcaacccatattcacaaaaggtattattaatgattcattccaagtcctcgaatttggttatcgcaaatgataagtatgcattctcaattaaattttctgtatattagttttcttattgttcccttcttttctttctctctgtttatatcactcatgtgggacggaatgacccctggttgatcctctccaacactccaggccatccatctgagatgaaggtggacgagctgttcattattgtaacttataataaaggagagacgagcagacgatgagtgagagaaaaagtggtaaaaatggtcaactgctgcattggcagagtcagagaggggtcacaaagagttcgcacagcatcgaatatttccttcattttaggcgtcattcttccccactgcacttctttcttcggtttaattacccaagtttgaggtacttggcgtgtcctgcccataatatctgtggcatggaataaattttggaactgcgctgcctaacggcggtgcttaaagtgcgctaaaaatgatcaaatgattatcaattttatttttcttaattccaaaatgaattcgaaacgcaaaaatttaatcataattcatgttgtaaaaaatgcatttaaaaataaaaaaattcttgaatttgcttctgaattttttaattttaaatagaaaattactttttcgaaaattttacacaaataagaggcgaagaaattcaacgaaatttttattaggattttgatttaaaatgttgagaggtttaacaaatttgtacactgaatgttggatcctcaacaccaatgagaaatgacaaacagaaaaga

SEQ ID NO: 30543 - DNA, 1687 bp, Heterodera glycines
  misc_feature (1621)..(1621): n is a, c, g, or t
  misc_feature (1627)..(1628): n is a, c, g, or t
  misc_feature (1670)..(1670): n is a, c, g, or t
taattaaatactttcttgggcattaaattccttttttcatccatatagaaaaataaatttaagtcctttaaaaccgattcctcatttctatttgcaacttgtcaaattggatacaacaaaatttcatcttttgtccaaaattttgagaaaaatgattctacaaattaatttactcgccatcatacggtaaagaagtcatgctgtctgtatcttaagagtaaaaaaaaatctgtacaaaaaagaatgtttactgtgtcttacagtattttagaggtttactgtacaaaatgtaatcacaaccaattaaacattggctggccatcccagcttcaacccaaaaaaaacagcttactgtcatttcgtccgcttcgtcgacatatcccacgtgggggttgttgaaccaactgacatacaagccggtgaacagaattggcttcgtgaaaatcagcatgtacaagccgtacaccgaggcgagcaacagccacacataagtgcgccatgtttggaacagaaaattggccaaccgattggaaatgatttgaacacatcgattgattgccaacaacacttccgctgtgactcggacacccacaaagctgagcggaattattattattttttaattttgaattaaaattttaggatattttacattttaccactcattgtcattaaaaattaatttaattttcatttattttttggatgttttctgataaaaaattctatttaaaaccattgaatttcatatttttataatttgaataaactttcatttggcaaagttgtaaaatttatcgacaaattagctattaaatgaattcaattagcgtaaaattttctgttccagtacaactgagacagaaaggaattatttcctgcttacagtataacactatctacagtgtgtatttgctagcaaaaaaaaattgatttaaaaaattttttttttatattttaccaagtccaaatgctccgctgatgtaaatgaagcgtggcgctgtgcaataaacggcgccgataattgcaaaaatgcccgtcagaatggcacagatcaacaagctcagcatgtcggttatggcgatataaaacatgaactggaaagggccaaaatatgcaaacaatttaattttcatggcattttcattattatggcatgcaaaaattgcataaaaaatcagtacaaagtttcgaaaaggttgaaaataaagggtaattcacccgttgggactcgaacccactattattccaaaccgaactatgccctaaccgactgatacgggcacaactttttggcattcctactcggttattgattaaaaaattatatttgatatttaaaaactaaaaatgaaaaatttataaaaagtatatttgatattagaattataaaaaaatagataattttttttcggttatcggatattagcaatttgggtatcattagacatatcttcttaatgagctttattcgcttaaactatgggattctattgggctaaaaaagctaatttttgtttaacagcgcctaaggtggctgcacccaaactccagcagaccaacccgataacaagtggagtccgtgtgctttcgtattgcgatcatgcatgggatgtacaanatctannattaaaaaaataattatttaattatttatttatttttaattnaatacttcacaaatgat

SEQ ID NO: 30544 - DNA, 2152 bp, Heterodera glycines
  misc_feature (25)..(25): n is a, c, g, or t
  misc_feature (66)..(66): n is a, c, g, or t
gcagcagttggaggcttatgcccancaggggttgggtgtcggtggccttggcggcggactcggcgnccttgggggtctttgcccgcccggattggccactggcggcggttttggccttggtacatatcaatgcttttcctatgcttttaccaatgggttttcatttttacaattctttcaggtggactcggtggacttggcgggggactgagcactttgggtggacttggaactggaggacttggagctggtggacttggaactggtggacttggtgggttcggtctgcccacggggcttggccttggcggctttttgccggacggttcgtcgccagggctgttgccgggtgcactcggcaagcggcgcagacggcggaggcggaggacgcgcgaacgaagtgccaaaaatgggccatctattggcattctttgagagcaataaagacaattttctcattttttaaaatttcaatttaaatttttaattgactttttgaagaatgaacaaaataactcatcacttttcttatcatttttgggtacaacagaattatattttataattacatttatactttctgcttacgttttacgactttatccgatgaacgacaatttttaatcagccaacggcaaacactaattgaaattgcaaaaaagaaaagaattactaaatgacgttgaataatgtactgataaatagataaaatgaactgttgaaaaaatgcagcgaaaataattcatgaaagggagcaaaaacgaaattgggagatgaataatttgtcatggccaatattcggcaaaaatgcctgccaaagagttggaaatgccatttaatttgtcgtggttaaattgaccagctaattgccctttgtcggcactctttgatcaccgaatgatgagtcatcgctcttttcggcgtttgctctattctcacaattctccgctccgtggttcactgtatttgaacgattgtctttgatcatcggacacttctctttgcttcgaattggcccttcggggcattgcttcaattttcgcttatcattttgttcgcttttctcacatcgactacgtaaattggcaattcgtactcccccccccctctcctccaccatttttctacttctgtcgttcgtccatcttcctttttctttcatcgctgctggaattttgttatttaaaattttgttttttagtataagtcaaaacttgataaatcattaattaactgaaaactacaattttctttacccaagggtttttggagtcgctgaccacgaatccggcatctgtttcgaccaattctaaacccccggaccccgaattcgaacaaaaagtcgaagattcaaatttttcgaattttgcattcttggttcaaactttgtttaaatacatgaaaatgaagttaaagtcattagtgcttcaataaaagatcatttaaaccatttttagactaaaaatggaaattcgaaaaatttgaattttcggctttgttcaaatttgggtccgggattcggaattagtcgaaatggatgccgctccgtgatcagcaactccgaaaacccatggaaacatgttttcatgttttttgaaaacaaaaaaaattttcgaaaaagggtggggggataaactttactattaccgaaaattactcatgccagattatctcaattttgtttcgcgtggggggggcacaagttcgaattttccttgaaaatcctttcgagttatcccattaacaactacaagggagtaggaggaaaattaggtcataaaaatatcaaccctactgattattatacagaaaaataaggctttacaaaaattaaacggagcgattaatgccggtggtttgtaatgtactcgaaaatgatgtacagttgcttcgaaaaacccgcaagaaacgaagaatacacttctgaaacttgtccaaatgttaatccaagccaggccgaatagaaatgggataaatacccatctctagaggttttatgaacagggatagtcaagaaaagacttgcctttttaaatacggaccgattttaagggcgaattgttaatgaactgcttgcactggttgagggtgttccaaatgacctgaccgcgccaggatcgttgtcagaacgtgaaacggatattcgcagcga

SEQ ID NO: 30545 - DNA, 1448 bp, Heterodera glycines
ataccaaatggggacgatgaaaaataggcggaaaacctcaccgtacgaaattatggcttttttattgaccagcccataaaaggttattatcttttttaacaattgtaacaaaaaaataaattcaaacaaaagttcaatttttttattgtttgttataaaaattttttaaacctgggatttttttaaattttgtagtttaatcaaggacaattaaggttaactatgcttctgagcgaaatatgatttcattttgacatatttactaaatgcaaaataatatcatttaatatttagaaaacccagaattgaaaattggaagggaaaatcactgaatgggcaccaccgagaatatgaggtatttaaaaattcatttaaaaatttgtaaaaatttttatttctgatgagcgtgaggagaaatgaagttcggatatgagaaattaaagaaaagaaaaaactgaggcttttttggatgtgaacacatggatgagtaaaatgttgaggaaaaaaaattttgaaatttaaaaattttcatttttttattttcaacttaattttttccattgcgcttaaaggttgacttaattttgggcactctaaaataatatgcttttgacgctgtaaaaactcataataactcagtaaattctttgtcatccggcaatctctgtttttagaatagcattaagcctttgctaatttaagcgttaaaaaaagataaaatgtttaaatattcaatcatttttatattttttataacgtcacaattaattttgtaaaattaaatggttacaatttattttaactttaattacaatttattctaactttaataatcaatatttccattttaaataccgcttccattttaaattgaaaataattttcttggcaatttgtcattttctcgaaactttttcatggcaaaatgtccaaaaagtcttggtaacggtggcttctccgcttcttcttcatggtcacgatcagctcgcgttcctcgtccttgaacacagtctccaagttgagcacaccgatgtcaaacgttttctttggcgtcgcactgtccgtgacataggaattcggaattttgaacttcaacttgcgcgagccgggcttaaaaaaatccaattatttcttcggcatttgagatttattaagaagttaatatttaaaactaataactggcattaagtacttcaaatttttatttaacaattgcgaatattattctaaaacaaagctatgtagaatatattaaaaattttcagcaatattaaaatattatttaaataatatatttaaatttaattaaataataaaaaattaactcaaaaagcaatgttttcaccttaatcccatcgtcacagtcgtggtagaccttaaaaacaacgtcgatgttcgtcagctctgagataggccagaaagtgaaagttgccatttgggtcagaata

SEQ ID NO: 30546 - DNA, 963 bp, Heterodera glycines
  misc_feature (782)..(782): n is a, c, g, or t
  misc_feature (902)..(902): n is a, c, g, or t
  misc_feature (911)..(911): n is a, c, g, or t
  misc_feature (916)..(916): n is a, c, g, or t
aatagacacgaaaattatgtaaaatatctttatattcgggtttggggtccgaaatggatgccggattcgctgcaaaaaaatgctggacagattaagactgctgagattcgaaatttttcgggacttgagaaccgaaacttgttgggaatttacccgtgagaatcgagacctagacgccaaaaaaaaacccgacaaaatttacgacacgaaaaccaagaggagaatctcgagcagaattactggacatttgcaatgttcaattatttcagaaaatttttgttttagaatatgtacatacctatattgtaggctgcgaagtaaaagaatttttattttatttttctaaatttgttattgattttaaaaaatttgggttcaaaaatatttgagaaggaaccggcccttttagtactaagacggaactggcgagacggaactgacccgcttcgttacaggttaagtcattatctcgctcttcctctaattcactcactctcttcctctctccatttctcacccctctctcttactttttcataccttttcaccctcactctcgtatcattttaaagattgtgttgtttcgcattattttcaaatgcgaaattgtgacggaatgacaaacccaatccagaatccaacaaattcaaaagaaaatttttattaaggacatcaattgtgtaattgatattcaaagtgtcatcccaacataaaagaaaaatccattattttctaggcaaaatgccggcacacatttccttaacattttttcagaatgaccncagtgttttttgactaaaaaaatttgtaagcatggtttttattaccttaatttcgtgcgcgaaacggccattgatcttgaattgtgccctcctttggccccgaaaaattcttacccgganttggtcagntcggnctaaaaaggaaaaaagacctaaactcctcctaacactctgaccataa

SEQ ID NO: 30547 - DNA, 1306 bp, Heterodera glycines
  misc_feature (1264)..(1264): n is a, c, g, or t
tagagaccggaaatttcaaattcgcggatcccgccgcgggaccggtctcaaaattttttgcgggacgggatcccgcgggattaatcccgcaaatcccgcatttaaaatttgcgggatcccgtgcggaattgcgggattttggaaaattcgaaaaaatttcaattaaattcaaaaaatttccaaaaatcaaaaaatggtcgaaaaataaatttttaaggggtggacgggatggattaaaaggggctggatgggtcgactaagatttttcgattggatccgacggtaaaaagttgatcggaaatcaaattattaacggttcataaatttgactatttttttcttttcaacccacttttttgcggtgcaatttttcaaaaaactaaggaacagggatccggcggtccttatcagggatggcattccgaggccccaaaaattttcggaagtgtcggaaatcggatttccaaccccaaaaacgtcggaaatcggaaatttttcaaaaaatatacaatataataaaaaaattttaaatattaataggcaaatttaaaattctaaaccatgtaaaaggtgatttcaaactgtttttagtgtatttctatatttatttgaaaattttttttaatgcttttcaaaataatttaatgtaattttatattattttggaattttttttgggacagttacaccctttttttgcggtgcgctttatccaaagaaaatttagtgaactttggggaggggttcgatggtgccgataggcgccgccgggaaatttttaaaaataaagttcaatttattaacagaaattgtacaaaacttactagttttttgaaaaaaaaaatttgtctaaaattgaccaaattacgcagtttttgactcaatttctacaggattattaagtaaaagcctatccggcggtgccggtaggcgccgccgggaaatttcacaaattttgaatgaaatttgcgatgaaaaatgagaactttaattaaatttactatttaatttatttaaaatatttggcaatttatttctttgccttatatttatttttatttaaatttcaattttttgcatattattttctcagtcgttattatttatttatttttaatattatatttattttttcgcttttcatttaaaattttatcttttttgatatacttaaaaacatttagtggtggcgcaagtaacgttaattatttgtatattatttgaattgaaacagtgataaagtgaaaatttaaatatttattanaaaagtactaattccaatataggcagaaatcatttaaaatca

SEQ ID NO: 30548 - DNA, 1549 bp, Heterodera glycines
  misc_feature (89)..(89): n is a, c, g, or t
cgatggaaagaaaggtaatacgccaagaaaaatagcgaacattttaaaatgtatgacattttgcggaaatataaacaaaaattattacncctgccaaaagtcccgtcctaatctcgggcccttttgtgtccagtgcaatcgccacgttgcgtttcttggtgcatttggcagctgcttcacgcacatttttgatggtaccgccgtgatactgcaatttcgtagaaattaatttttggcctattctgaatcccggactcgaacaagaagtcgaaatttaaaaaaaaattaattttcgacttctcgctcgaatttgggattcgaaatgggcaaaaataaatgccatatttatgatcagcgacgctagactccaggaaaactattttcacgactctttaaaataaaaagttcaaattctcaaaatttagtgataaaactcacttcgtggtccccgtgactgaagttcatccgggcgacgtccatcccattttcgatcatttgaaccaacatttccaccgaacgacaaacgggccctgaacagggaaaacagttcagaggcatgccttatcgaagagattaatccattttctggctttacctatcgtgcaaatgattcccgtcttgcgcacaatgtgcggttcctccgtacacttgagcatcgcaaggtgctcgagattgttgcgggccggatatttctccataatttgcttttggctaaactttggtttagtttgacgggaatggtgtggaattgtggtcccgacggaaaaaaatcgtagagttaataaaaccaatttttctggggtaaaaaaatgcgctgatcattaatctgaactcagattttgaaaaatcattgattttatctatgatttttcatcaagtacttgatttttttcaaaattttttaattttctttgagtgttttttccaatgattttagggtaaaaaatgcgctgatcattaatctgaactcagattttgctaaatccatcattttgtctatgatttttaaccaatgtggggtggtattcctttcaaatttgcttactgagttccaatggcggcagctcggtacttatacagtttgacccacataaaaaaaattttttgtttctaatgataaaaacgtgtttctaggggttttcggggctgctgatcacgaatatgaactctattggacgaatttccgaacccctaacccgaaattcgaactttttttcgaaaaaatttttttttttaatccgtttaaaatgtgtcaaaatgcgtgctccatgattctccggtgagctgctcgttcaatcgcaagtgtaacatttggatgcatgcgaatgctgattgcctatgaagaggacgtttcctcactgatgctccgatggcgcggctccatttggaaagcggagactcaaagatctgatcggcttttacattgcttactatgagattctgaatagaaaagaatatattatcatgttcttgtggtctcttggagataaagaaggactcggaattaccgcttttttctaattatccccccgcggcttatttaaaaact

SEQ ID NO: 30549 - DNA, 1681 bp, Heterodera glycines
  misc_feature (26)..(26): n is a, c, g, or t
  misc_feature (84)..(84): n is a, c, g, or t
  misc_feature (124)..(124): n is a, c, g, or t
  misc_feature (130)..(130): n is a, c, g, or t
  misc_feature (1593)..(1593): n is a, c, g, or t
aaaataatttatcaaatttgaaaatnaattaaattatattatttagagaattaaatgggtgtagaaaaataataataattaatntaattaattaaataaaataaaattatatctgttaattttntaaganaataaaataattaaatgggtgtagaaattattaattatatcaatgatatattttattattagaaaataaattttatgacatattttttgtataaaaatatatttatatatatatactaattagttaacataattaatcccaaattagactttgctaattatagaaaaaatttgttatttacaattgggagttgttgtaattatttgttcagttgtttcttcctcatcatttctgcttgttgttgttgtttttggttgttgttgttctgctggttcactttcaacattattaactcgtctccttgattcctattttagaaataatttatttatttttataaattattaaaatttgtctgccctcatagaaaaattccaaaaaatgaattttttttcttattaaaatttcataaatattttcaatagttttttcctgacggcgctgcctgtcgtccaattatttttcatctactttttaggacaaaatcttatttaaatcttcgtaattttcaagattcaaataaaaatagtattttttaatgcaatttttgcctgtttcggatgccacaaatgttccgctctttcagcgtcaaatggtgaagcatcggtctcctcatctggcaataaaccgcctacttgtccaattgctaatgatggcacttggccacgtcgtaagggaaaaacgcgacgcggtggcgcgtaatgttgctcttcaccatgttggggttgatgtgcctttgcgagtttttggcgccttctgaaattcgtgtcaaaaaataaataattttcactttttttaattcaaaatctttcaattttctttgtttaattttgtctttattagagttaataaatataacaagttttttatctaatttttttaataaaagcgatttaaaaaaaaacttataaatttttgaagaataaaaacaagctaaacatctaagaaattttaacgataaaataaaaagccttttttaatctaaaaaaaataaatatttttttataaaaaaccaaacaaacctttccataaaaaactacaatcaataaaagagtgaaaattttaatttcttttaataaaagtgccgaatatttttcagataaattttaaaataaaaaataaactgaaatttcttaaggaatagaagtatgtatagaaaattttgaaatatttgtgttgcttggcactttatgattattaatgccatttaaaattgtttaatattacctattcgaggttggcactcgtcgtccccccgacgatgatgccgaaattggtctcggcacatccgtcgtaatttctggcacttcatttgcctcttctgtgtgttcctcctcatctcctgggcttggtaatgatgttgttgctgttgtcatttttgctgatgttgttaacaaatgttttgttgtttttgccgtaaaatttttgttcgaacttttaatgagagctaaaattaaaaatanattttaatttaataattctctttagagttgccgcccaaatccccgattcccataacccgacatttgaatcgccccaaatcccgaatgc

SEQ ID NO: 30550 - DNA, 1825 bp, Heterodera glycines
cgattgacttcaattttacgggcagtcaacccaccactccctaaactgaacggcgaaagaattttgcctctagcaccattttgagcggtacattcccgacgccccgcccctcgcgcaccccaagacttgcgcagttaaactcgcgcaccccttgtccgattgacttcaaattttacgggcagtcaacccaccaccccataaactgaacggcgaaagaatttcgcctctagcaccattttgagcggtacattcccgacgccccgcccctcgcgcaccccaagacttgcgcagttaaactcgcgcaccccttgtccgattgacttcaaattttacggcagtcaacccaccaccccataaactgaacggcgaaagaattttgactctagcaccattttgagcggtacattcccgacgccccgcccctcgcgcaccccaagacttacgcagcaaaactcgcgcaccccttgtccgattgacttcaaattttacgggcagtcaacccaccaccccataaactgaacggcgaaagaattttgcctctagcaccattttgagcggtagattcccgacgccccgccccctcgcgcaccccaagacttgtgcagttaaactcgcgcaccccttgaccgatttacttcaaattttacgagccgtcagttcaccacgccctaagctgaatgaggggggtccgcgccgacggacggcggaatgatgggggggggggggggtccgtcgaagagaggggtcccgccgccctggtggggtggggtccgcgacgatggcgagagagggtctgcgccgcccgaacggcggaatggtggggaggagtccgtcgaagagagcgggtccgcgccgcccggacggcgtaatggtggggaggggtccgcggcagtggaaagagggggtccgtgaaagagagggggtccgcgccgacggagagagggggtccgcggaagagagggggtccgcgccgcccggcgaaagggcgcggccgtcgagcggggaggggtccgcgatatttaacgcaaaatatcgcgaccccgcccattccaccggtggccgactggttaacgcgtctgaccaccaccatctctagttaattcctgcgcggagaaactcccgcgcatttaacacccacggtccaaaatctcacgcaagacaccctatgctctaacatcaaaaggaatccacataaacaataaatcaattgaatcaaatcgaatcgctcaccccaaagcactgagttcgccctcggcaatgtttctcagagggcccaccaaattgccgctcatattcactccttttacgaaagagaaacggtaaaagtgaattctgtgacgaaaaaccggacaaaactccgatgaaattggcgaacaaaatgccaaaaacactgaagaaactctcctggccaagaagagtcattgcggtgttttggtgttctctgaattgagttcggctcttttcctttttcgctgtgattcgatcactcatttgccgataattccgagaacggcgtgtaattggtcgggtcgtaatgggagtgccaattcagcgacagtctttcggcactcatttcgccgatgccgacctcttaaagagtgtcaaattattttcttccgataattcgaaggtcaaaatacctgagtacaatggagtgaagagaacggctgcaagaaggaaatcgccaatggttattgccagaaagcacatcacaagcagctgaatacagatgatgaagcgaagcccagcgaaattcattgctaatgagagaaatgccgagaattaatgtatttaccgtaactacccaatcgaagagcttttaaaa

SEQ ID NO: 30551 - DNA, 1368 bp, Heterodera glycines
tgaaatattgaatttaaaaaatatatattttaaggacatggctcaaacgagccgagtgttggagttatggcagtcaactcgggtttgactgaaacttgtaattataataaaaaaaacccaaaaaataaattatcatattttttcagtcccaccaaccccactcagctctcatgggcaaaacagtgctccattgcgtcagagtgcgtttaaaacaaattaagtgagagaaatctgtttaatttaattttcagatgccgctggtgctggtcccagcacgggaattgcagatgggggcgctgaaagcggcggtaagaacatttttctttctttaagtcattataatggaaatatattttaggtcagtggttcaggcccacgattgaaaaccacatgaaccgatcacgacttcgacttgtgcgcgaggaaatggcacaccgaacgatgcagcaacaggtggaacatcagcatcagcaattgcttgaacgggcggaaagagtgcgacaggccaatgttgaacaacagatggaggaagcagacgttctacaagaacagctgcagccgcaggacgaagaaaacgacgagaaccgcgacccagaaatggagcagcgacgactagttcaggtcgctcgacaggcacaatacgagcgacttgtccgcttgcaattgcgggaagctcgccgttttcacaacggagtcgcttcttcggttgtggtccctcctcccttgttttgggaggaggaatgcgttatttgcaccaacgcccgtgcaaatttttataatcgtcagtgcgggcatgtttgcctttgcgcggagtgcgcagtcactgcggtaatccaaaaactcactgtctgtatgatgtgccgtgccccagttaacggatatacccatatgttcgttaactgagacacgaaataagtgttagtataatttttaaaaatttgaaaaaaaagtacagaacaatgagtaactatccattacactaacacactatttgcagcattttctgtctgtcactctatcccataatatgatcgattgtattacttaattattttaaaattggaaaacttttctttcatttttgtaaaacattttcaatgacaccattgatcatttatttgatcataatacttaattattttaaaattggacgactgtttcttgcacttttgtaaaacattttcattataacatcgctgaccatttatttgcttatctgattgtatacctaattattttaaaattggatttttatttttgtaaaatttttcaattttgcatttcaacaaaccctcaaacattattttttattaaataagtgtaaatggtgaaataattaacaattatggccacggtggtcacgttgct

SEQ ID NO: 30552 - DNA, 2048 bp, Heterodera glycines
  misc_feature (2009)..(2009): n is a, c, g, or t
cctcagttttttggaaggatttctcagtgtttgcatccgttggaaggaattcgccggtcgaataaaaacggcgcaatatttcctctgtttttaggtattttagtgaaaaattagacaacttaaaaatgagcacccttttccgcccatttgttgttcagccattgctccaattgttcgtcttcctccggaattaatgaaattggaattttctgtaccaaaaaatgcacatgggcaggcgtaaggccaaggagaagctcaaaaagagtaatttgcgaggaaaaaagaatggtgattaccaaatcgaattccgactgaataatacggccaccgtacgccacagagacatcgtagataaagtcgacatatttttctgaatggaacgatgaattaattgtgcatatattatagtaaagcttattaaattaagcttattgttagaacaaaagtttaatccgattcagggttttatatcctattttgatgatgttttttcagttttaatccattagtatatgcaaattacctttgcgcattctcttcaaaatgtggacaaatccaacggtgcgcggatgaagcaaatatttgtatttgaccaatccgttcttttctgcaaattgctcacttcgttttgtggctattgggcatttgtcctttaattaaatcgttagtgaccaaagaagaaaaaaaatggtaaaaagtgcaacttacagttccttcagggaaaaggagcaactgaaaatggaacaaaacagttaaaagggttcaattcgatctgtcacttggtaattccgtgaggtttgagaatagtaactgatcattcggtcaatgcgagaccgatcgaaggcgaaattccggttgaggaaaagaaaagcattggtggccatagcccatccttacaatttaaaaagtaaagaaaataaataaccgaaacctgcgccggggataaacatcagcgtactctttggtgaaattttttcagtagtcaacagccaagggtctaattgtaaatatttatttatttcggtttcataacctaaaactttgactactacccattctccacaatgcattccaaaagaagagccaatccaaccgagttctgtgattcattatgatcagagatggcctgaaataatcgtaaattaaatggaaattttttaatgcaacttgttccgatctattttatcgccttgtaagtgaatccgaacgccaaacataaattcgaccagagaagacggaagaaccagccaaaatccaatcaagaaatcagtgagttgacgaaataaatttggccgaaaaactaaagaatatttaatatgagaaaatgagctcgaaaactttttatagacccattaattaacgaattacttgcaaatggcatcaacggcataaggaagaaaaaggtgccaaaaaatgacgagctcagcaacaaaagggcgaatgtcaatcctttcagacaatggaacaattcgaaaaaactgacagccggcggttccattgctgctaaattccttttaatttacattattatggctgcacataatcacataaccagacaaataatatgaatatgttatagcaagcacactatgggtcaagcccagtgttagacaaaattgctcataacgccaaatagcgcatttggcgtaaatttttgcgcgctaattcaaaatttatactggtaaatgccttttttgcactgtttattttgatcagccataactcgcttcatacccaatcaaactgaacaaatttggtatctaaaaaaagattttgaaaaggagaatctttttctaagcgaatgttaagtaatttgtcatctcagaaaaaagttgtcggaatttcaaacttttatcatgttataactcaagtcctaggcagctctttctaaccaaaatgctaaatttattcttttttctattgattctaaatgctcaaagtgattttgttcctttacaaccaaaattattagcatttacgaatttgatgttttttgtgtgttagagatngtgaaagatagtacgccaaaaagagagaaaaagaaatgc

SEQ ID NO: 30553 - DNA, 1649 bp, Heterodera glycines
atggaaaggttagcgaagaataatcatgaatttatctttttatccctttttatcatttgcatatattttatcggtgtaaccacggcacaaaaaatgaaatattttatgtaaatattttcaaaaaactttcctttccctcaaaaacggacaaatccttatcattttttgccattgcatctgttttatctgagtcatcgctgctcaaaaaataaaacatttttacgtaaaataatattaaaaattttcatatttcttaacgaaataaataaataattaattattcgataaagttttagctgggcaattgagttctctgactgtccgttttttctaagtgttgtcaagatttgtcctattttatggagcctgcgtggagtggggtgcggtaactgtgccaatgccaatttgaaaccatggatttcatttaaattttattctgacgttggagaaaaggcgtattttcggggagggactttgggatttgctggggtttgggttgagattctggggtcaaggaaagatttacttaattttcaacaccactttactgacaaggaattagagaataagggaaattgcaattaggaactcaaacaacagtaccaattaagcctttgggcgtttgttgttgctgaatgaaagtccacggggaaaagcaccaaattttgtagttttattacaataattcaaaagcacaaaatatataaaaaaaaacttgagagaacacgaagacaacaataaaaaggaaaattaaatgaagcatcaaaatattttaaattaacgcgaaaaacaatcgttgcaaaaaacaataaaataaggataaatcattatttatcctacgctttactttaacccattcaggcttcctaaacctaaatttgaacaaaaaaaagaatcataaaccgcgaaattcgaattccgacttttattcaacttcgggttagggattagaaactgatcaaaatatatcttcgttattttaaccccaaaatcacaaaaaatttttgcagagggatccctccccttggtttttaataaaatttgaaagtgaccactttttaaatagcgctaaattcaattattgttgaatgcatttttctggcaaaaaaaaaaattagtagcgatgcgataccagttttacatttcatttggaaaaatgaaaaaaggttaattactttttaatgcgccgcgacatttgcgccgctcattcaaaaaaataaggcaaattaaattttcatttttttaatctgattttggaatgaacggtgcaaatataattttctataatcatacaaatacggaaactagcaaaataaaatataataattcataattttatgaaaatcaattagcaaaaccggatatataatatatgcttcctgtttatggataatattaataatttttttcatccataaacaaatcacgtcaattgcttaattaccccaaacggcgtatttcacatataaaaagcaattaatttttgaaagtaaacattaaaaaaagttaataattactcatattttcgattcaaatgagaaacaacattatgctgatcactttttgtttggcaattttatttcaattaggtaacatttttaaattttatattttaatatttcttaatttatataaattataatttattt

SEQ ID NO: 30554 - DNA, 1425 bp, Heterodera glycines
ttatttgatttaataaaattacttaccatcacttaaaatacacgaatttgtttctgtgcaagtgaacgttcgctgactatttactatacggcgaaaaaattgtttacatccttaagcaacaaattgtttactcattaattaataattatattttagtgaaatgcttgaaagttcatttttattcttaccattgcaactttgcacattgtaatatttgaacgctgcacctcgtccacaaattaaacatttttttggtgtttttggttgctttttgtaaatccttttttgtttgattggttccgccgcgtccatttcgaaataggatttttcgggatttaaataaatttcaatttatctaagcatatattatttatctaggttctgataatttctcattcaatctgcactattaacatagagatatataaaatggaaattaataaaagaaaaataaaacgaacgtgaattacatttttttagatttttttctaaataaccaacagcattcattgtcagatgctaaattgattttttaaaaaccgaaaaatttaagcgaaataggcacaaaaatatgcatttaggcattaagcacaaaaagtccaaaataggcaaacttaggcattataaaagtcattgtagacacaccaaaccaagcggaaaatacgtttttcgtgcttatttgagcgtattaagtgcgcagaaattttggcatttgtctaaaaatcgcagccctaattattttatatacgaattcgagaaaaaaattgaatttttttttgttttgtttctatgcggtcaaaaaataataagaaattgcaccaatttttgaaaattaacaaaaaaaaattgtagtgagcttgcttttttttattgcattcttgaaaataaatatttaaaaaatggtattataaaaaattaatacaaaatcaaaattaacaaaataaaaaacgtaaatttatgtgtttttttacgaaatttcataattggggattttcttttttgaattttttttctcaccgattaaaaataatataataagaatttttataccttctattcatttatgataattataatgttttttaaatatttctaagaataaaaaacggaaattattaaataacgtttccttttaaaccgaaaacctaaagataaaaatttggcttttgaaaagaattgcgtgacataaaattctaaatttttgcgtgatgtaaaggccgtcccttatttatccccaatttaacaatacaaattcattgaattcacaatgatttctttttattggcacaaaatgccggaaattagacacctatgcaattccatttgttaattgagtcctttcataagacggtaaaagagggaaaaacatacaattatcaccatggtgggattcaaagaattgaaattaaaaagaaaatgcgaggg

SEQ ID NO: 30555 - DNA, 1688 bp, Heterodera glycines
  misc_feature (1364)..(1364): n is a, c, g, or t
  misc_feature (1371)..(1371): n is a, c, g, or t
  misc_feature (1373)..(1373): n is a, c, g, or t
  misc_feature (1376)..(1376): n is a, c, g, or t
  misc_feature (1383)..(1386): n is a, c, g, or t
  misc_feature (1412)..(1412): n is a, c, g, or t
  misc_feature (1423)..(1423): n is a, c, g, or t
  misc_feature (1434)..(1434): n is a, c, g, or t
  misc_feature (1444)..(1445): n is a, c, g, or t
  misc_feature (1455)..(1457): n is a, c, g, or t
  misc_feature (1466)..(1466): n is a, c, g, or t
  misc_feature (1468)..(1470): n is a, c, g, or t
  misc_feature (1484)..(1485): n is a, c, g, or t
  misc_feature (1492)..(1492): n is a, c, g, or t
  misc_feature (1495)..(1496): n is a, c, g, or t
  misc_feature (1498)..(1498): n is a, c, g, or t
  misc_feature (1500)..(1500): n is a, c, g, or t
  misc_feature (1516)..(1516): n is a, c, g, or t
  misc_feature (1524)..(1524): n is a, c, g, or t
  misc_feature (1528)..(1528): n is a, c, g, or t
  misc_feature (1551)..(1551): n is a, c, g, or t
  misc_feature (1643)..(1643): n is a, c, g, or t
aaattgaaattaatttttaaaataattattgaatttcaaagcttttaaatataaataaaaaataattgagaactctctttaatgtgcagagaagaagctgaacagttggagcagagtttggcacaagtgattttaaagcattgattaataataaattgaatttaatggacaatttttcaattaattaaatgttaaattcacaattaattaaatattgaattcaaaggttgaaaatgcgcgaaacgcacttttaaacgcacggcgcgacttggagcgaaagtcggaacaggtgaccaaattgggggatcatttgaagacagagatcggatcggattggaccatctgtcctttattaaaaattattgtccttaatcggccaaatgccactccttttttgtttcctttattttgaattttatttatttaatctgataaaattcaaattggcacacttttgaccattcccatttgtttttttgctctaaaatgtgttaagcaaaattcctgagagttgccagagttacttacccccttttttattcctcttttgatttattttagcatcttttgggccttttcgctatttaaatttttctttttattttccttctctttggagatccgatccctgttaataaatatttcacacatttatcataatgatttgcttaatcttaatgttcccagttgaatgagctgagagatgcgttggtccgttctgagcaacgattgcattggcgcaataagtcagtccaaatccaaatccaacgctttcaattttaattttaattttaaatattttaccgtaatttatttaattttattttcccccaaatatgttgtcacagaaacagacaataaattttaaaaagaggctaggcacacatcattttatttgttattttgttttttttttttttgcagagcctttgccggcaaatgaatggcaaaaaacggacggacggacgtcacggagaaaagaggggacaaattggattcaaacaaaaattaattagatttaacaaattgggctaatgataagcataaaaccggaaatggaaaagcgatttattaaaagtcgataggaaaagacaaataaaaaagattccttaaattaattctctttttgcattttttgtgccgatttttcagcaatttttttggaataaatatttgaatattttaataaattgtatttatttaattaattaattttgttttaatttccgattttcttttcgcttggccaattctccacaatttttggccgcctcaatgggccaaaacaaaaatatggacacaaaaataaagaattaaagcaaaaaaaaaagaaagaagagaaaatgagtgagaattttgttttnaaatttngnttntttttgnnnntggtgattttatttttgtatgttttngttaaataaanaaagaaatggnattttggtgnnaaaattatgnnnatttttggnannnattatttttatttnnagttttnatnnananataaaattgaattttntgttgaantatnagatgggagtggaaaataaaggnatttgtggagagtatagagtttgagtttgttttttgggataggagttaatgatagaagttgagaatttttggaataaagttaaaatattatntatgaataatgttgattgagaattggatttattagggatttaatt

SEQ ID NO: 30556 - DNA, 1737 bp, Heterodera glycines
  misc_feature (1635)..(1635): n is a, c, g, or t
  misc_feature (1681)..(1681): n is a, c, g, or t
  misc_feature (1684)..(1684): n is a, c, g, or t
taatttcacactttgttaaaaaagttacaacaatgacagctgagttaaaaatgactccaaatgtggtgataattgcataagtcaatgcgcaaccaattagtgaccagctgggatggacatctttgaaggccaaataaaactgcaaaaaaaataaaaaggctaaaaggctgttaattaatatatatattttattttccaaaattagtcgaaaaatttgaatttttaatattattattttccagtgcttactgtattgtttgttatgtcggtcattacggtgatggatttaattttgatttatggcaataatttcagctaagctaagatattttcgattctttattaaaaaaaattttaattttataattggaacagaaaatgagaaaaaaaaaattattctacctcaaaaaattccgaacaattaaaaatttaagcaattaacgagagaaggcaattattttagctaaagatattttcgattctttattaaaaaaagaaatttaattttatcattggaaccagggctgtgcgaagctcggcttagcactcgaagccgaaggcgaagcccaatttttattcggagccgaagtccgaagctcgaagcccaaaaaacccgaagttttcgaagccgaagccgaagttttttcaaattttttttttaattccaaatttttttcatcacataatttcggttaaatatcaaatttaatcaattgacgcagtttctagtagagaccggaaatttcaaatttgcggatcccgctgcgggactggaactcaaaattttttgcgggacgggatcccgcgggattaatcccgcaaatcccgcatttaaaatttgcgggatcccgtgcgggattgcgggattttggaaaatttgaaaaaatttcaattaaattcaaaaaatttccaaaaatcaaaaaatgctgaaaataaatttttaggggctagcgggatgcattaaaaggggctgatgggtcgactaagatttttcgattggatccgacggtattattaacggttcataaatttgactatttttttcttttcaaaaccacttttttgtggtgcaagaaatcggaaatttttcaaaaaatgcgggattgcggactgggatcccgcaaaatcccgcgccggtctctagtttctagagaccaaccaacccttttcgataaataaatataattaactttttgagcaatatattttgtaaattttatacttcttagaatattcacggtttttgagtcgatttaaaaaataaatgaaattttggagctccggcggtgccgataggcgccgccggtgaaattttgaaatttttagtgcattgttaacagatttagtccaaaaatgaaaaaattttgcgattttaattgttaaattttattaaatttctgtcgaaaaaatgaatatttttgaaaaattagaagaaaagcaactactttgatgggaagtgacccaaggaaacataatgaaaagagccgagagaactaccactcgaccaagcatgcgaaaaaacacaaataagcaaatagtttaaatatatattaattttaagtttaccaaaagtcaatcactagtggtgcattttcacattgaaaactcaatctttaggggtgtatttttcccganacttcgggtaaaatagccgaagccgaagcacgaagttcgaagctcnaanaacccgaagtttttcgagttttcgaaagcgaagccgaagttcgcccagccctg

SEQ ID NO: 30557 - DNA, 1102 bp, Heterodera glycines
  misc_feature (57)..(57): n is a, c, g, or t
aaatattttttatggataataatagaaaaaaactgggcgttctgtcacatttacttnttatctttatttctctcacttttacgtactatctcttcattcttaataatgtaaagaacaacatttacttcatcctgtttaactgttttcctacttgttaaatccacaccaaattttacatatcgatagagaaaaaaattctgcatcgattaatgcaaaaagtatttttgtttatgcgctccgatccaaaatttacatactcaaaattagtaaattttatttttaatagattttatggctaaaagaaaattaataagtaagctgcaaaataaaaaagcggcacaaaagcggtggcaaaagcaagatctgagaaaagcgcaaacggccaaggcgagacaagcttatctggccaaaaaagtgagtttttcaactgattttaaggtcaaaaacacaatcaccacgccgcgacaacattttcatggctcttgaactcctggcaaaactccaatcatttgccgtcgctgatttgctttctgctgatcaaatcgccgatttccgcgccaccgctgaccaattccgtgtccacatgttggagcactttcgccgccactgttcaactacaaaattccatcacctggtccatcatgcacccgaatttgctgaaaaacatggattttggggccttctcagtgagcagcccgtggagaaatttcacgcgttgttcaatgacgatctcgcgcgcaaagcaaacaccaaagatctccacgatattttaatgttctgcgctagagaatctgccattcgaaacgccatttttgatgccaatgaactctgatcactcttttgtagttttttgatgtgtttattatgttttttgttcttattatatgcaattttctcaattttttatatttaatagataatttgctgtcaaattataataaatgtttaagtttgctctcaaaaactatgctttataatgagttttgacgattttaaaacatttgatcagatcaaatatactttctttttcatttgagtgtgttggcgttttgttttttacgccaattattttggcaatttttttcgttttttaccatccatg

SEQ ID NO: 30558 - DNA, 1626 bp, Heterodera glycines
  misc_feature (1614)..(1614): n is a, c, g, or t
tatttaataaaattttaattatatttatgtggtattcatttaataattttaaaattaatttccatgtgaattaatatttattttattcaaaatcttaacttagaaagatcaattaataaataaataaacttcgaattaaaatttaataagaacaatttgaaacaaaaatttctttctatacttggttctaaaaaaaataattattgaattaatattacgaatttactatatttaattaatcttctgattattgcctgttcttgcacgaacgaatgaatcaatgacataaattatgtcaaatattatatcaagaaaaataaaaatcatcaggcatgcgaatgacactgattggctgtcaatgaaaacgcaacggtaaacaattaactaaatccaaacaaaacaaaaaaaattaagaaggaaaatccaattaaaaaaacgtacaagcaaattgtaacagtatgccaacgtaacaatgccaagccatcggtaatagtaatcccggctcggctccaacacaaatttgtcacgaaaaaattcccattttgataggccatcccaggcaaaaacttttgtagcattgcctgaaaaacaaaatcattaaattaattcattttactcaaaaattaaaaaatatttaaataaattaatgaaaaaaaacaaaatttttacttaaatcgcatgatttctcttgctgcacactgtcggatgtgctgatgccgaatttggtaaaaaatgccagttgttctcgttctaatgccacatctgctacacggaccttgctcattaggcttagtccctataaatttcaaatttttatttttgaataatttctttgaagtaagcgaacaaaatcttagcatttattgttaattaatagcgaccattaaagcaatttttttagtttcaaataagaaggaggaaaaaatattaataaatatatccgtaaatttttttattaagttagatttttgtccaccatattttatatccatatttcggcatatttaattattaagaaaaggattcaattatgggattataattcattctttacaaaaaattcttagggtttaagaattttttcaaaaagggctttcatatgagtattaaaagattaacaccggtttcctacttttcgagatattagaaataaaaaactttaaaaataataaaaaataaaaatttacaaaaaaaaatgaaaaaggtcgtacccaatcttataaatcatataaactttatctcaacgcttgaaatacatacacttaatttgcaactgcaaaagtaaacaattttttttccctttttattttaattaaaagagaattttcaattttttgttgctctaaatttttctcatttttggtcaatattttcttaaatgttttgcattgttgcttaaaatttcaggattttttgtaaatataaatcctcgctctatttatcactttttattagtttaaataattttttttttgtgaattgtacgatttttatgaaattcctgtatttactaatttttaatctgatgggccttaataaatagaagccatgattaaaaccaatttttcgatttccaaattggttttcacctttgcaatgggtactgaatttcantgcgcggatttt

SEQ ID NO: 30559 - DNA, 1100 bp, Heterodera glycines
ttttcatgagaccatcacaccctttagggggggacatcgattttcacctttcgacgattatactcattctttggcagggcggcaaaatgttcactttcaaagagagagataaagcatccaaatgcaaaggaacagctaacaaaactctctctctctctctctctctctttaaattcgttttttctttttctgttaaataattctaaataattaaatttttaaaagtttgttactttttaaattttaattgcttaatttatttgccttccctttgaagttccacccctttctccccctcagctgctccgtttcttcgtcacttcctccaccgttcctttgactctccggcgatgctttccgctgcctcgggagtggctgtttccgtcccatttggcaacgccataaaagtgccaacggcggattccaaagcactcgcaagccgaatcagaaattatttatcggtctttcttcatcttttcccctttttttctctcattcctctttttttctttctctctctctctcgctctcttctctccttatcacttcctcccccctcttcagaaccccgccgtttcttggcagccttccaccgatcaacggcgcttaatcggtcacatggtgctgaccaggcccagccgcttctccgtaggcccctgctcttcttcctcctcccccggaccttccaacagttcgttggatttcggcgtcaaagtcgtgggcgggcgcagtccgttgacgggtcgcttcggtgcttttgtgtcgcgggtacggcccggctcagtggccgaatcggtgggccaactgaagacgggtgacgaagtgttggagtggaacggacactcgctgcaaaacgttacgcccgaggtcggtcggccgcttctccgtccgtccgatcacttccccccccctccgcctcaggccgtttacaaaatcgtccaggcaaccaaaggcgacgttcgccttgaactgatcgtttcccgttctttgatcagcgggggcgatgattttctgaatcttggccaaattcacgagcagtatggcctcggtttgtcctgcgttttcgcttttcttttccctccgaatccatcccccccccc

SEQ ID NO: 30560 - DNA, 1076 bp, Heterodera glycines
atctacattgagagggattgacgggatggagtctgagcttttcttctgttctgtttgttctgcttggggataggaaaagggaagtgaaatgggttcgggtcagtaagggaatcaatccgggttgccatggttgccagcccagtattaagttcctcagaacgtttaaagattgcctcatttgttgcattaatcctacgattaagatagcgaaggtttctgtttgaggcatcctctaagccagagacttgacttaatacattttcgaggtcactaactttcgcttggacggatgggtttctacctgagaagaggcgacggtcaatcgcaacgatatcttcgtaaggcaaattctctaagggattgaccatgataggggaagtgggatgtatcagagagggtactggacttgcgcaccgtgaagggaaagaaataaagtaaaagttaattgtgtataatcactggatatcgcacaataaccaggatttaacttgctttgctgtatttaattgggggtgattccggggcagatataaatggttcaatgcaccaaatatattaaatgagatttgaatattagaaccaaaagaaacaaatatttaattgtcttaagtcactggatattgtacttcgtaaccaggggtttacttggtttactgatttaattggggtgggacctgagctgggaggtaattggttcaatgcgcaaaatgtgttaggtgttaaaatgtgcgtaaatgtgatcaaaaaaacgtaaatgtgatcaaaaggaatgttgtgaaatttgtgaattgttaaatgtcagttttttttgtgttattttccgccacacctttcggcttggaggggtgagttgaggctgagttggtgtgaaatggcaccacgggagaaagactgagtgtttggtgggggagagcaagttgagccaaatgaacaaagggcgggtagagatgtcgaggacaaggacgtgttctgaatttgctttgagttttaacccaaatcaaggcaaccgtactccgagaatttacaaaatttaaaagaataggggatttttgaaaattgtgcgaacctaggaaggg

SEQ ID NO: 30561 - DNA, 1185 bp, Heterodera glycines
  misc_feature (101)..(101): n is a, c, g, or t
  misc_feature (115)..(115): n is a, c, g, or t
  misc_feature (118)..(118): n is a, c, g, or t
  misc_feature (144)..(144): n is a, c, g, or t
agcaggcgaccctcgccgctttcactgcgaatccctccgcaaatgccaacatctgcacggttcaactacatgatcaacacggaccttccatttcagcatcncaggtccacaagcnccnttattttatttataaacaaacccatnttaaaattgtacctaaaatccccgcataaatttaggagagtcaaaacgctttacccatgctcggcacagcacgacacggagctgagctttgaaaaggatcaggttgggagttaatgtaaccaattttttgaaattatattttcttagattatcacaaatgtgtatcagtccaaggaggagggatggtaagctatgggaaattgaattggacttcataaaaaaagcatttgatcaaattgtgcaaaatttactcgattttggcaattgtagttcgatttacaataaaaaaaaaatttgaagggtcaaatttatgaatttattttccggaattttcgggggtcgctgctgattacgtagttgctttttggttttttaggctcgtcggcactttgaacggcaggacagggctgatcccggccaattacgtcatttacattgattccttatgattccgatattcctacacaaatgttattattattttacttccttgccctcctcctcctcttttcctcgtcctcattttttggttgtgattcgctcttttttgcttttattttccttcctttttttctttatttcaatgcttaccaaacgaaaaaccgaacattccgcgcacatcgggtgaactgatttttgatctaaccattacaattattacattattcattttgtcatcggtcgttttttgtataattaaaaatgcaaaaaaatacgatccatttttaaataccttttgaataaatgcttcttagcagagatcagacggaacattacaacaacaatttgtttttaacttataataaaataattaattgtaatttatttttcaatttttgaaattccattttttaaatttctgtgttaaaacaataagtgtgggacagtttcaaattgccacgaatttgtaccaaatgcaatcctcgaaacggctccattttgacgagaaagtttcgatgcgcaggtgacaattaactgcattaatttgtgtatgatttccctttaggctgagaccgttgtacgacgtacgtttcgtttttt

SEQ ID NO: 30562 - DNA, 1180 bp, Heterodera glycines
  misc_feature (1157)..(1157): n is a, c, g, or t
aagcaaaagcaaaactcactttgcttcagcccttcttgtatgtgctgatatggatgaaagtgatggtggagcataaaatgaggagacggagaagagaacgggcgaatggattttggaaggatcggtggcggataattgggtggacgacggatcgagaacgcgagggaagacctccactgtttcctgttcatacctggaatcaccatgatagggttcttcaggacttggggcgcacttagtaacgcccaagaagggttccatttggctttaagaatgcaatttaacagtgtgcatccgtcattatcgaagtgaaaatcgcgtttaatcagcttaatattttaattatcagagttatcactgttctgaagaaagaagagcgaatcgcagccgataagctgcggcagtatgagttggacccaactcaagggataagaattcgagaacggaagaaaacataccgtgaaaacgatttggctatcagaaatttggttgaaggctttgatgccattgagaacccaaacgaagatgagattcttgctcatctcaaatcgttgcaatacagacttatgcgcaatgattttgagaattgggacgacccaaatggtgattaattctgttttcacatcccgttggcccttgggaaaggcacgttaaataaaaattggaaaaaggtctactgtagctaaaaatgtttgtggtttgtctattgtgttgtggttagtatgggctcaaaattctgcgcctcctcgcggtgagtccggaaacagagttaatttttaaaatattaattaattttttttgcaatggaattaactctggctaaagcagacgtaattttgtctaattttgtggcttagaattaaattttttaatttttttttgttttattgaaatccccaaatgtcgggtctctaaatgtcgggatgccaaatgcgtggttttcttaagtgtcttttgctcaaatgtcgttcggtccccaaatgtcgggtccccaaatgtcgggtcccccaatgtcgggatccccaaatgtcagatccccaactgccgggtccccaaatgtcgggatccccaaatgtcgggatccctaagtccctaagtgttggatccccaaaaggcgggtccccaaatgtcgggatccccaaatgtcgggtccccanatgtcgggtccccaaatgtcggg

SEQ ID NO: 30563 - DNA, 1348 bp, Heterodera glycines
  misc_feature (39)..(39): n is a, c, g, or t
ccaaaacggagtacagagacaattctatccaaatttccnacacaatcaaatgaaaccaaacccacggaatcaacagaacacatcttcctctccttttccatatacttctgcatttacaacgaaatcaaactcagtacgcctggcacagtttaaatcaaatccaacacaaactagaacccaaaataaaatattttgtcgcttttgcgaaagagaaaaccatgcaagtaaagaatgcaaaatttattcaactcccgagaaacgaaatgaacgtgtacgtgaactcaaactttgtctaaattgtctaaataagggacatatggccaatgaatgcaaatccacctatttatgttttaattgcaaatacaaacataatactctcctttgtacccgcaaacaaactcagtacaaaccgaaagagcaaaaaaccagagtgaatatggctaaaaattacgaaaatcatgaagagacacaaacattcatgacaatggattatgataaaaatttatctaattatgaggaagaagaattacttatgactgctgaagtaaactgcataaatcccgacaaacataaagtaaaaaaggaaataattttatttgataatgggtcacaaaaaagctatataaccgaagaatgtgctcaaactcttcaattaagcacaattgaggaaaaattattagcaatttccactttcaatcaaaataagccaaaaataattaaatcaagactagtcaaagttggcattaaaacattaaaaggtgaaatagagtacataacactacaaacagtggaaaaaattacagatgttacaaaaatggttaataaagaaactgttgatgtacttggaataaaaatctcgatcgctaatgcacgtcctcaaattctaattggaatcgactattactggcacttcatgttaccaaattcacaaattcaattacttccatcaggattttactcaataaatacaaaattaggaaaaatattatctggaaaaggaactattgaggacaccaattgtaactcagtgaccgaaaaaagaaaaaaggatgaaacaaaccaaatacttcagaaattttgggaattagaaaacattggaattatcgactcaccacatatgacggatgaagatgcagcaatgatacactttgataaaaatgttacatttaaaaataacagataccatgttcgatggccttataaaagaggaacccaaatttaccaacaaattttggattatgcatgggaagactaagaaatgttgttaaacaactaattaaaaacaagcaattggaaaattatgacagaatattgcaagaacaaatggatactgatgtaaatgaaattg

SEQ ID NO: 30564 - DNA, 1108 bp, Heterodera glycines
  misc_feature (27)..(27): n is a, c, g, or t
gctggctctgttgccccaatttcgtcncctttcccattccgttcactgactgttgcccatctctcgcaacatttgtccctccatccgtgccccggtgatttcccactggtccaactgggcgtgcaatttcctcagccgcgtgtccaactcgtaaagatgttgttgctgctgttgctggtattgcttggccgagtcgtcgccggcggaaggcgccaaagggcgggagacatcgaactgaacaaaaggagaagctcagagacaaggagaaggcgacggcacgcgcaatggcaaaaccttgcgaagctgaacgccgcccccacggaaaagcatcggcgccagcggaggaatgtactgaaatggactgatcaccattttaaacatccgcttctccgatcgcccactgacgtcgtattggtactgattgtcctgctgttcgcatgtgctcagttttctctgctgcgttttgtttggcgttttgttttccggggtttccgttatctttggcattgtgtcatttccttcagtcgaagtatttgccgtttgttttccttcggcagacgatggtttttcctccgtttcggcgggcgaagtgccgccggcagtgacaatttggaccatcggcggcgcacgagcaggcgacggacacgcggagctttcctcgtccgcggcactgctgcacgtctgtacgcggtcctgcggattttgcacttcctccggctcctcctcctcctcattttcggcattgctgcttttcctctgctgcttcttctcttcccctgggagcaccagttcggattcgcccgatgacgaggcactgtccccgaagggattctttccatcgtcgtcgtccgcttcgtcctccgacccgaatgggtttagctcctccgggtatttgagtaccttaatgacaggcattccttcgtttgcctccccccttttttctccctttttgcctccctcgttcctccttttctcccctttcccccttttgtctctcccctcccacctcccaacagcatgccgtgtccttctccgtccccctgctgctgctcctgttcgcctcccctctctccaatggcattggctttgttttcctcggcttccgcgt

SEQ ID NO: 30565 - DNA, 2017 bp, Heterodera glycines
  misc_feature (1935)..(1935): n is a, c, g, or t
  misc_feature (2008)..(2008): n is a, c, g, or t
aattcaacgaatccaaaaattatttcaacaatttatttctgatttaaaaatcgccgtaatgtcatattactcgaaaatgagaaattcgctttaattactaatatctggtttccgtaattaaaaatcaagctatattggaatgcatgaatgtgattaattatattggttttggttttttttattccaaaaatgatggctaatcaactaaactcttcatcatttcgtaaataattttatgaatggtctttgaatcggcgcaaaaatgtatatagctttatttataaattaatattattgcaagaataattttctgaaaattttatttttcaatatattaaatgtactcaaaatgttcaattacctctgttgcaagacctactatgggggatttaaggatcatttccttctcctaattatttttttaagatataattatcgttgtactagatatctcttctcatataatattttatcaatttatctatcattcattggttttacatttcaattattttcatgcaaaccatgagttcttcgaaattaaatgatcttttaatcaaatattttaaaaagtttttcaagtataacacaggttgtctcccagtcaatttttattttttccatttcaaatctaactcctcttcgaaaattctgctctatttcgtattttatttttgaatttatttcacatttttctattaaatcttttttatctatccttcgggcatactataatagtccgctgtatttttttgggtctcgtgcctttaaaattatgggtttaatatttcacaatataaatcaatcgaaactcacaatattcccaatcattttcttttttaagcattcattttttaattaatatttctatcattttcttgaaattttcagtgtgttctattttctttttttggggtttttaaatataatctgttcgtattttcatatatcacctaatcggttacattttttcagtcgacggcatttcgaataattgttttcattcaatttatttaggcagtggttttttgaaataattttttacatttctattttttgcttttctcagcaggaatattatatttttttctgtgacatttatctaaaatttcattttggttaattttaattaaagttaattttaatttattttaataagcttaacattctgaacgagattttatttttcttggttaaattgatggaataaagtttttaataaatttattaataacaatggcttcagttctaaattatttttttattcttgatttttacaattattgttaatttaaatcataatgattcttttacaattctcttattgtattgctatcaaagctaattttttctattttattaaatcattatcagaaatctcgggaattcctgcggtgttgtccgaatcaggttctcgtgattttttttatgaatatcatttattttatgatcgtatattattgccaattttcttaaattatttatttatttgttcttaaaaaaagccaaaagtcttgtaaatataatttataaactttgaaattctctaattatattcaatttcttgcagagatcatttttttgaattgctattatgagaatcaccaggagtaaagtggttatgcttatttttcataattatttattatttttttatttaaattttttttttttaatttttcagcaatatccttgaatttttatgtaaatttatttatttattcctattattttttttcttaatagaaaaagcaatatcctttttaaattcaaaaataacgatgatgtgttgaattatcgttttgaaaaaatgaaaattgatcaaaaaaattttaaatctaaaaatttttaaatttttgtatgtatataaatttaaaatatttctttgtataattctcatttacgtattcactttgctttcctttcttttgctgnttcatttgtttttccatttgaccaattttgcatcggttccttatatttcaacttttctttcagcaatttctanatacatttt

SEQ ID NO: 30566 - DNA, 979 bp, Heterodera glycines
gtaaacttcatctaagactaaatacggccacgagtcctatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttggcctgctagcctccagactggggtttgctgtccttctgttcagtggcgaatggggcatttgcaggcggagtgcgctgagatgctcggagtagctgcgtgagctcggtcttgaggccagcctttcggggtctggtacccggatcgggggagtgctgtttactctgggtgaattgtgcaatggtttcgggtccgtgttgactcgagctgggggtcggtggcggtcgcgtgcgacacgtaccagcaaccagttcggtccagctcgggctctcagttgtgcgttctcggtgtaaaagccggtcatctgttcgacccgtcttgaaacacggaccaaggagtttagcgtatgcgcaagtcattgggtgttcaaaacccaaaggcgcaatgaaagtgaaggcttcttacggagctgatgtgtgatccctggcactgcggtgttggggcgcaacatagtcccgtctcgatcgcatgcgatggggcggagacagagcgtatgcgctgagacccgaaagatggtgaactattcctgagcaggatgaagccagaggaaactctggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttgggggacgaaatgtccttaacctattctcaactctaaatgggtatgaagccagggttgcttgactctgaacccaggcgttgaatgt

SEQ ID NO: 30567 - DNA, 1023 bp, Heterodera glycines
agtcggcccctgaattatatagcagtgacccaatactttctggaaatttccagtacgggtttgtccgtgaaaattggaaaatatttccaaaatccctatttctttttctatccttgtggactgagtcggcccttgaaattatatagcagtgaacccaatactttcttggaattttccagtacgggtttgtccgtgaaaatttgaaaaatatttccaaaaatcccattttcttttttctatccttgtggactgagtcggcccttgaaattatatagcagtgaacccaatacttcattggaattttccagtacgggtttgtccgtgaaaatttgaaaaatatttccaaaatccctatttcttttttctatccttgtggactgagtcggcccttgaaattatatatcagggaacccaatacttccttggaattttccagtacgggtttgtccgtgaaaatttgaaaaatatttccaaaaatcccattttcttttttctatccttgtggactgagtcggcccttgaaattatatagcagtgaacccaatactttcttggaattttccagtacgggtttgtccgtgaaaatttgaaaaatatttccaaaaatccctatttcttttttctatccttgtggactgagtcggcccttgaaattatatagcagtgaacccaatacttccttggaattttccagtacgggtttgtccgtgaaaatttgaaaaatatttccaaaaatccctatttcttttttctatccttgtggactgagtcggcccttgaaattatatagcagtgaacccaatacttccttggaattttccagtacgggtttgtccgtgaaaatttgaaaaatatttccaaaatccctatttcttttttctatccttgtggactgagtcggcccttgaaattatatatcagggaacccaatacttccttggaattttccagtacgggtttgtccgtgaaaatttgaaaaatatctctggaggtccctatttcttttttctatccttgtggact

SEQ ID NO: 30568 - DNA, 985 bp, Heterodera glycines
ccggtgagattggataataatttttgatgcttaacttttaaaaacggctctcttgacagaatgacactgtcccacccggcagaaaggttgaggtgttcccgttggagctgttggaagtgatggaggaccaggtaaattcgcaatttacgcaaaaatttatttacgtatatttttacccagaattttttcgttggaaaacccgaattgaaattgaccttcagacatatttaggaaattggtattattagggtccaatacacgcattcatccaagataacaaatacacacatttatttaaaaaattcaatacaaatttcccattggagcgtgtccctcgtgagaaaactgacccagttttgatggaccagttgctcaaattcaactctatgaaaccggatgagcgcatgcgacgcatttgggacagtgctcgtgcgctcgaattgttcaacgaccagaaccttgtgcttaaagcatttgggatctctgtggatcaaaagtcgaacctggtcagtatggtgctttgtgcacgcaaccgttttgacactgcccaacagtttgctgcggatcgtttgggtcgcatgggcaacgaaaagggcattccgattgcggagccggagattgtggctttcaacagcccggatgtgagtaacaaattgggaacaaaactaattaaaaatagcagacagtttgccaaaacatgttttaacttttgataggataggaaactcgatcccaggagttgttttttctatttgaatcttcaaagtaaagatttcaattttttcaaacctttttgaatcatcaaatttatataaatacctaattccattacaaaactaatactatagtaattttgcttttcatcaactaccttggtgcttttgtaattctgattaggcatttcaaatgaaatatttgtctgtctggtgattgaaaaatggaaacattaatttgcatgacatgttttgatgtttgtttttttttt

SEQ ID NO: 30569 - DNA, 1079 bp, Heterodera glycines
ttttattgaggagacaaatgaattgcgaagcttccttgtcaccgaccagcaacgtttgttttgtcaccgcattctatgttttggtcaagcctttgggcaaagttcggacgaattcctccggcactcccttcaacaaatactccaaacgaagttttcgtgcctcggggattgcaaatttcataattttcggaaactaaagagctattttggcggcggttaagaatctctgagtgggagggagacctcaagaagttcgtctgtaaggccagtcagctcaggcagaatgcccttgtcgacgatccaatcggagtgtcccctcaaagtcgcattagaccctcagaatttacccaatttttatttacttgcatttttcgtgttgccgatgtttggaacaaaatctgatgacagtttctgtattaatcatttgctgctgctgtcccaccgcattatgcgccgaaggacgtgcggagggacgtccgaatttgggtcgggcgcgtaaaagcgacccgccactccgttgatcagttcgtcgacctcctttcccaagccctggacagtgttgcccaagtcgcccaacactccgtccaataagccatggccaccgtcccttccgccctgccgttgccccccttcggtggcttctccttcgccgatcagtccctccagcagtccgccatcattccctcgctttccctgccccccttcggtggcttctcctccgccgatcagtccctccagcagtccgccatcattccctcgctttccctgccccccttcggtggcttctcctccgccgatcagtccccgattgcttcttccccctgcccggtgcctattgctcgcccctcctttgtccgcttctcctttaactgaagtccctccaaagatgtcaaacaaacccttggcaattgcaaataatgggaccaaaaatgaacttatgaggataagtaaagcattagttgcaccaaatacggaccattttctggttaatttaattaattttaatggaaaaaggagaaaaaatggtggggaaaatggtcagtgagtaaccaaaacaaacaatcactacaatttctttg

SEQ ID NO: 30570 - DNA, 962 bp, Heterodera glycines
  misc_feature (929)..(929): n is a, c, g, or t
  misc_feature (934)..(934): n is a, c, g, or t
agagaaaagccttgtctcttccactctttcttcaccagccttcgccattttattattgaaagttttggtctcaaaatcatttgtgaatcgaggcgaaatttctttgaggccaaaattttttaatttatatttttacatattaattgatttactcattcctcattctcacatattcaagttctctaggcgtgcattccaccaatctctgaaccctccctaaattgtgaaaattctcaaattagtcctagtccccatcccctccctctatctcagaatgtctcaggctttgtaaatattacgcaattgcttttcccgtagcttagcttcttccagtttttgtattatagtccattagtaaataaaataacaggcaaaaatagtttgtacgcatgcaatgataagatgtcaaatgtgtgtaaattgaactaaaagcgcgccggcctttctccgacacaatttcaccacaaaaaagtaaaataaacccgagttagagatcgtttttgcagttggcctgacacaattaaaaatgacaagctttatttagcaaattaattaatccccgaaaatacttccgttttaatcgccccttttgagtgtttattccctttttgtgtctcgagaatcgcttccggccgcgtttgttttgtccgttctttcacaaataaaattgatgaaatgcgcacaaaagccctttaaaaatgacggaacttggatttcccttgacaaatttatgagaatttgtgcgcagaaattgcaatttgttggagcgaatgaatgttcgattgtcccaacagatcatcggaacaaaagatattcttctcccataccctcccactcaattttttgtatattttatttttaaattatttgtgtctcagagcgttagccaatcgtctcatttttagaccgattgtcttgatgatcatggngactntttgtcttcttaatcccacccatgacag

SEQ ID NO: 30571 - DNA, 970 bp, Heterodera glycines
ttgattgtcaatgttttcggtaaaaaaagacgcgaaacattgcttcaaccaaaagaattattacgacgctgacgctgtgaaaccctgcctctaaaaaataaattgcatatatataatatataagcaggtttaccagtacaagactagttctgctgacactccatttccgcaacgtcatcacaaaacattgatgtttcaccatcagcataatcaggttgctctgctgctgttacagtttgttcatcagcaatgttagcgttcaagaagcgacgcacaagaaatggaatgccatcatcatcgtcatcagcatcagaaatgtagatttcttcatcaccattattagtttgtcggcggttattgtgactgtttttcaacacagtcattccggtgtactgctgctgttgcccctgcccctgttgctgtcgtcgatgctgatccaacacaccattgagcaggttaaccgcatcaagagtctttttcgcttgatcatacaattcaggatgttgaacaattgtaaggcaattagcagaaatgaagcgcagcacgtcatgaaaaggtttcaaatgttggcttacaacatcttcagaagcattttcaggtggtggccacacaatcggtggaaactgaacatagaaaatataaataaaattccttagaagacaaaaataatggatttttgtgtatttaaattttcaccaatctggattttaaaattaataacataaaaaccaaaataaataaaactgtttgaaaaatccaaacctgcacattagaatgaaaaacattaaaatcgcagccgtcacacttctcaacaaacccctgcctttggttaataacttcatattttaagccatggttgttgtcattcgaaacagttttccgttccattgtaaattattgaaaatattgatcttgacaggtaaaagatatgtatgcttttttaactgtattaattgagaaaatcaaattt

SEQ ID NO: 30572 - DNA, 988 bp, Heterodera glycines
catgaaatggggaaacacttcaaatacagcgaatgagcaatataatttctctattgctggacaaaatttggtgactcaaccaacggatgtgcacaattcaaatgagacaggtctcgagcagggatgtgcctaggtttcgcttttcgcatttcgcttttggcgcgaaacgcgacttttacacccctaagaattggattaaattcccataaaattttattggctaattttcagtgaaaacctgtttataaatgatcaaatttccaatttttttccccggcggcgcctatcggcaccgccgcgcccccaaaactcctattttttcttagaaaatggccaaaatcgcaaaatttggtaatttgatgaaaaactgttctcagcggcgtgccaaaactcttatttctcattagaaaaatgataaaaatcacaaaattcgatcattttttagtgaaaatctgtcaacaaattttaaccaaattttcaaaattttcccggcgccgcctgccccctcttcccaaaaagtttttttggaaaaagcgcgcctcaaaaaagcgttttattgatttttaaatttggaataaaattttaaaaaatgatttttgctttatgattttaactattaaaaagttgtagaaaaactttcgctttcgcatattttagcttttcgcatttcgcttttttttcatttcgcgtttttcagtttcgcaaatttcgcttttcgctttttatttttcaatttggcccatccctggtctagagctcgtcacgcattcatctggtgataatgaccatcaaaatggtggaacaatcccagtttttttgaatgccgaactcccaccacaaaatcggaatttgtctccaattgtttcattattttgtttgagcagtagtataagtgatttttcatctaaaaatcaaaatttttgcaataaatagtgagtggattttgtggtaaaaagcaaaaattccaaaaataatgatttatcacata

SEQ ID NO: 30573 - DNA, 1103 bp, Heterodera glycines
ttttttttaactagtttgggaagggggttatcccggttttagtatcctgtttgaaaaacaaaaaattttaatagctgatacggtagccccaccatccattgccccaaatgtaccctttcggtttggtcaacgggagctaacaattgatgagtttgtttggtttcttttttaagcaattttccgtcattgctcaccaactgttaggcgtacagcaacggcggcacttgcatccgatgcagctgttcacgggctctctaaccctatttttattttttttctatctctctctgaaagcagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaccctatttttattttttttctatctcttctctgaaaggagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaccctatttttattttttttctatctcttctctgaaaggagttataacaatttttcacaacagttttgcatttaacagacacatttctaaa

SEQ ID NO: 30574 - DNA, 1144 bp, Heterodera glycines
  misc_feature (1049)..(1049): n is a, c, g, or t
cgatttggctggggccgcaaatgtccgagccgcaaatgtccgggccgcaaatgtccgggacgcaaatggtctggacacccgtgcgccctgctcaatgctgccacaccctctctcttttttttgcgtgtctctcggcaggtcgtccgtcgatgatgatgaaaattgtcaaattgtcacccctcccaaattcacccaaaagttcctcacaattactcctccgtccctcgttaaaatttgaaaaatttttgttgcttggctttttgccgtgttcaaatgccttccgccattttacgccggcattattttttgttgtggaaagcgttgacaatgggcacaaccatcgccgcaagacaccagcaaattttgttgctgttacaccaccactaccaccaccattatcaaggtaaaaaatattattggaaaaacaaaatgatgggcctagaaaaataaaataaagatagatatgtattacgtatttttcttaaagattaaaaagtaattctctatcgaatttggtgagaaaattggcgggaccgttggagctgaaatttttcgtaaaaatcctgctgggtcaattctgaatttcattttatcattccagaaatatcaaatagcccctgctaggccagtaaaatttcaaaaaaaaatttgacaaatttttttcttattttgtaacgaatcatagcgcctcaatcgtcccccccccccgtcatttttcgctttgtggggggaacatttattatcatttatcaaaattatcagagaaaggctcagtttgctgtcaattaggattccaagatctcggattgtttgggtctctttaataatttttccattaaattggcagggaactttaaaattatccttgccaatgtacagagaagctgatttttctggtgaaaatggtagaccccacataaaaaatttttggaaaaatacacatgtatcttatttgtaaccgcaattagtgaataaaattgcttgtattaattcgaaattacttttcatgtagaaaacagcaattttaaaaattatacccctaaattggnaactttttcgcccttatttacggccttattcatcaccccataactttaaaatggatagaaataaataaataattcagaatttttttctctattac

SEQ ID NO: 30575 - DNA, 1386 bp, Heterodera glycines
caatggataaatttcataaatttttgagtgtatcggagaagggcgtttcctccccccatgaaaatttaaaaaatatcagatgaaatctttttacaaaaaatcgcaggaaatttactcaaactatgttggggacaaagtgctgatagtcccaccttcctcacattatttacatccatggaactagtccattggtggcgagtctgacactgtggcagcaatcatagactaacatctgagcaccaactgtttatcctttcgctcggtcgccaattagcagacaaaaccgggctgtgtagaaagacatttagggttttcgcggaaaaattttaaatccaaataataaaatcatagggagaaattattttatttttttaaaatggatatcgcaatcacaaagaaccaaggcacgtattatgcggatcaggatttgaatttcacagaattattttttaatgggtctccaattagaaaattcggacctggccttgacgacgaggagtacaaattatgaaagcatcacccaaatcaagcatgatcacctataaaaaaagacatggttttcctattgatgaatccgccatcagccaaatcgacgtacatcaccccaaaatcacaatcctcttggtcatccactgaaaaatttcctcctctcgcgccggcttcaaggcatattcttcttctttcaccccccccccccccctccgcctcctcgagaccgatccattctctcccctcccattccattctcgacgacctttttcttcacttggccctgccccttcccgcccccaaccaccagctccttggcccattcattcgaaatcagcgagaccgaccccgactgatgatgatgatgatgcagatggtgctgattggttgtgaggaagcaccccgggggcgggtgaccatggttcaatgagtgagtgatcagagcaattgcccttgccgccgccgccgagattattcttgggactttcggctcacttcacttccctccaagcccaacaaagggcactaacccacaaaaaagttcaatagcttttgaaaaaccgaaatttctttttgatgggtgagaaatttgaaaccgatccatcgccagagggatgaaattggactcggccatcaattggcccatccagccgcgtcataaggcaaaaatttgattggcacggataacgcaataactctcttggccgattaggatgagacagaggtgtgaaatttaggcctttgaaatttgggaaatttttcattaaaattgcattaacaattttttaaaataataagcgtgtcactcattcttttaatgtatttggaaaaaatttctaatatttggtatgggtagagatgctttttcctaaagatttcatagaaatatgcaatttt

SEQ ID NO: 30576 - DNA, 353 bp, Heterodera glycines
aatgaaagtgtcagttacgccgtaaagacagcggccgtaggggaagggcaaaatggctgcaaaggctgaccaaaattacccttttatacgagcagaaaatggcggagtcggcgcaggaggtgccacggggagggcatttatcattgttgcgcggggggggggataaaggctaaagccgggtaattgctatcatctacatgaaaggggagggtcgacccccccccccccttcgtctgaagtttttcctgcgacgcctttcggcattgccggaccctaaacagccctaaatgtaaatccggtgcaggcccgtagctggggggggggggggaggtgtgggggctacgtgtcgacct

SEQ ID NO: 30577 - DNA, 1556 bp, Heterodera glycines
tgtttccactcccttctcccaggggtattatttcgtttagtctttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattatattgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactaaaaaaatatgagtgatcaaactttcactaaaaagttaagcctaaactttttcccaaagttaaaaagcaattaaaattttattcacctccattattgatagaaaaagcatcagagtgcctaaactaacatgtaaataaaatttggtgcgtttcagaaccctttctgaaaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtggccttcgcccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgatttttttca

SEQ ID NO: 30578 - DNA, 1131 bp, Heterodera glycines
aaattttcagaatttaaaaaaatacaaaagatagagctcggcgagctgtacaataagttcgctggtgacgacccgctcagcgtaaccaccagcgagtattgccgaaaaccgaaaatccggtttttggcttttcaatttttagccacgcgtaccgggaatacggtaggtcgtagagaaaaatgtttgctggcgaacttgtagggcacacttcaacttaaaatcctcccagcaagcattttttgatcagagcaaaacccatcgtttcacaggctcttgaaaaaacgaaaaagccatttcagcgccgctggcgctcagttggccaccggaccggaatgcccctatttttcccggatgcgccgtcaaaagttacccctgcctgcaaaatttcagatccccccgattagccgttcccgagatttttgttttagcaatgagttgcactgttgttctaaggtatataaactagcgtgaccagttggctatggtgtgcatgcgtggcttggtaatatatggccctcattttaggggaaagcgcttcgcgctcagggacgcggcttcgccgcgtcgctagaaagtgacgtaatttagcaattgatcgcagcctcaggacgggcgctttgcgcctgtttttaattttgtgggaagcattcggctgcttcgcggcctcagacgggcgtgtcgcgcccgttttttaattttttgggggacattcggccgcttcgcggcctcaggacgggcgcttcgcgcccgtcttttaattttttggggggaattcggccgcttcgcggcctcaggacggtcgcttcgcgcccgttttttagtttttgggggacattcggccgcttcgcggcctcaggacgggcgcttcgcgcccgtcttttaattttttgggggaattcgggcgcttcgcgcccgttttttaattttttgggtacattcggccgcttcgcggcctcaggagggcgcttcgcgcccgtcttttaattttttggggggaattcgcccgcttcgcggcctcaggacgggcccttcgcgtccgttttttaattttttggggggaattcggccgcttcgcggcctcaggacgggcgattcgcgtccgttttttaattttttgggggaacattcggc

SEQ ID NO: 30579 - DNA, 86 bp, Heterodera glycines
tcttacgacgagggggggggtgtccgaggcctcttacgacgagggggggggggtgtccgaggcctcttacgacgactttgggcggc

SEQ ID NO: 30580 - DNA, 952 bp, Heterodera glycines
ttgtaatgccttctgaatcagccattttttccaatgcttaggcataccaaaaattaattatatttttgtatcttttcgtgaatcttgtttgattttgatttatttaattcacttaaaggtagcttaaagttagttttatttttataaaaatggaaaattaaatataaaataaaaccatttattttatttaaattcctgagtgaaatttttaatcgctttttcaaatttgtgaacaaatggtattttaggaaatctttaaagtaaattaatttacaattttatctttactgagaaattttttgtagttacggaaaataaaaatattttttaaattaaagacggatgcacaaaaataactaataaaggaaatgaatgaccgaaatttaaattttaatctggtgaataattttaaaaatctgccttctattgagaaattgtgatgaataagaatcatttattcttccctcattaattcatccgtttgtttttattaattaatcttatgttattatataaaaattttttaataaaattttttcgttatttttgtttttattgtttttttaattaattctttattttttcgcgtaatgacgacataatgtatttatatttttactatatttgaaatattaattttaaaatatgaatctgtgaaaagagaaagcaaattctttataaaatacaataatttagtcaaattcaaaaacacaaaagcaataattaacatgattaccgcttaattataattttaaaaaaaaagaaattaaaaattaatgttttcaaaaacgactacattaaaaatgaaattaagatttaattatatcaaatttaattgaagaaataaagatcaaattcgagaaatattactataatcaatttttaagaatttgatttattgtggtggatgacaaagatatttggagttatgcgcatttagttttatacttaa

SEQ ID NO: 30581 - DNA, 1560 bp, Heterodera glycines
aatatgggatcacagtgaaaagaaagtgggatattttaacaaatcagtgaaatttttcaaaatgttacagcacagaattcaaagattatgatgttagcacgaaaaaacaaaaattcacattttagcatttttttactcttaaaaaatgtatgactaattaaaccaaaaaaattaatacataaatcaatcaaaagcagttactcataagtttctcactcctcaactaggtatgctggtttttcttaccacaatatacacattcaaattcaagcgggcatgaacagtggggcattccgtcaatcatcttaagacactcatccgtgtttcgtattgggcttagctaaataaataaaaattattatatttttaatttatatttttgaaaaagcatttccataccaatgttggcttcagcactgatgggtcctaaaatgaatttatatttttatcaaaatcccgtttcaacatttagatacatattattatgttgcaaaacttatttcttattatccaatttttatttttttaatcaaattaattgttcaaaaatccctagatattcgttttgtatttgattatggtatgtcagtcaatgccagtgtaattctgatcaaacaatgaaagattcatgaacttagagcttttgagtgataccaacagttttggatttggttgacaaagaaaaaagttataaccaaaaaaccgctggggcccaaacgtgccgggggggcccaactgagccagtccgaacatgtaagagattgacatttaccttcaggcaacatttacaacttgggctgctgtcgcagcatcttccaacgaatcgtttcgggcttacaaggtacggctgccggcaggcgcaaaagattttaccgtcgcattcgggcgttttgaaaaaataagcggacagatattcgacctaaaaaatggggacaaacacaaatgtaaatagtaaatggtaaaaatagtttttcaagcacaatacagtaatacccactggcgttttttcttcccacacaatggacggctgaaaaaatggaacacaatcagagaatcacagttgggcaaatagaatgcaattgaattaaaaaaaaattttaaacttaaaaaaaaaattaaaacaccgtatttcttgagacaacattccaactggtaacggtactcaaaatggtcggcatttttttactgtatttttgcccacctccatgcatgtgaacttatggccggccccacagcacgattgcccggcagcgccaatttccggaagacaagcgtattcacgataagggcatttctgcctcgcactttcgcattcagcgagctcagtcaattggcggggcggcggctttttttgtggagttaattaattcaatttaaaaaaataaaaaaacaccgtattacaccggaatttgaaatgttgataaaaaattaccgttgtctcctaaaattaaaaaaatgtttaataggaaacaacaaatgtttaattttaattatttattatcattataaaaaactcaaaaaatttaaacaattattttttctggagaattttgaaaaata

SEQ ID NO: 30582 - DNA, 1216 bp, Heterodera glycines
gacccagaccataccgaaatccacccccccaaaattccgattgtgtcggaaaccatcttaaactgcactcgacgaggcgtcaaaatttcctctaatcccgtcgtccaaaagataacgatctgctgctccaactcgtgtttcgatcggttagccgcgtctaacatcaattaacgaactgccctcccgatcttaaggctcccgacaaaccccgccaccgagtcgtcagccgcccctttcaggctttcgaccattcatcactcctttctgccgccagccgaccctttaggctcccggcaactcaacccttcgctgtccgctgaccatcttaggcctccggcactcatcactcaactcaagtcgccagccgcccttttaggctcccgacaaaccctcaccgagtcgtcagccgcccatttcaggctttcgaccattcatcactcttctcccagccgccagccgccctttcaggctcccggctttcatcactcgactctttgtcgccagccccccctttaggcttccgacaagccctcaattgagtcgtcagccgtccttttaagccgaccctttaggctcccggctttcaccactcaactcttatcgtcagccgtccctctcgggctctcggctaatctccactcaacccaccaaccgacagccgccttctctaggctctcgaccaaccaagccgactcttgcgtcaagccgccaatcctagactttcggaaatgtcggaactcattcgtcaacgtctcaccgccgaagtccgaaccctttcggacctcgtcaagcgcctccgacaaagggtcgggaggctcactgaattcaccaggatggcgccagaggaaatcccgctcgccgaggagaccaaactcgccaagggcgtacgaactgaccgacaattactacagagaagcatcgaccgcgtcaatggcctgctacgagaatgttttgaccacattcagctgctaggcgacccgtttctgaagcaggcggaggaggacctcctggacgcactccccgaccttcgacgaccagcaagccgacccaaatgtcgaaaaatggccagtcatcactccttctctctaaagcccagctcaatcctcgacggccttcaagtcttacatccagggttcgattcgacacgacgggaggcatctccttctcgcagaagcagtcgtggttttgatcaagggggccgacgaagaaaaccgga

SEQ ID NO: 30583 - DNA, 1740 bp, Heterodera glycines
  misc_feature (1592)..(1592): n is a, c, g, or t
  misc_feature (1636)..(1636): n is a, c, g, or t
  misc_feature (1654)..(1654): n is a, c, g, or t
  misc_feature (1693)..(1693): n is a, c, g, or t
ttcgatttttccaataatgagaaatatgtgctcgctcataacacaaaaaagacgtaaacacaaaacagaaaagaaaagaaaaaaactgaactattttccaaaaggaattcgtttcgataaattgtttacttttacatgtattagttacagcgcaaaattaatatatagaaaataaacatttttaaaataaataaattaaaatttttttaaataaaaatcacttttcagttgttgatttttgataaattattatttatttattttttttggcagcaaatgacagacattaagcaatgatcaagtaattaactttttattttattttttaataaaataagaccaaattgcaaaaagtaaaaatttaaaaaaacataatttaaaaattaaaaatgaaggtaataattaatttctaatgtcgaagaaatatctgaaattatttttacaaattttcgggttgggaagatgacatcaaagatgaatcatggacataattggaggaataggtagtacaaatcaaaaattaattattaatcataataattaattatattttggcgcctgttataacgaagtttatggcccgtaaaaaatttaaaaaaaaagtctaaatttaaaacgtctcgagttgattttttgggaaattttcgatttcgagcagcaacaattaaaaaaatccacaaattctcagtcggcttttgttttatcaaaattttgaattaatattttattgatataattattataaaataatataggaaattcattatcgttgataaaaaatttagcctaagaatgaaagcagctccacgagaagaaccgcacgcaataataagacaaaatttttgtctcgagtaagtttttaggaaattatttgattttataaagatattgacggatcaaaattccttccttatttcaacatcagtcccgtcatctcctaacccttttgccatcacttgttctttgtccaatccctttaattgtcagtgggcggtccgttcccgatcactatttaagcttttagcgctccctcacaattgttcatcccctggttcattttattccacctgtctccaattgtgcagacacgaatcgggaggtgttccacacagtcgactgttgttccccctttccccttccgaataaaggatattattcgaattaccgctacacaatgttttggggaatgcattaacaccaaactatcccaaccatatttttatttaatattcaatatctataaatgaagaattttctataagaaaagtgaaaaattaaaaatagtgactcatacttggcgttttaaaaggtcaaacccattattaaacaattgaagcgtgagtcatctctagcggtgctagatcaaaaatttcaaaatctgatttttcctatgattttttatcaattttttaattataaatatattaaaattttaataaattggtgcttaaatacacattcttctaaaaggtatgctgtatttcgaataaaagaataattaaaatttactacatattaaataaaatcattagccaggttactttgaattttttaaaatttgaagtttcaatggcgcctacaaattttagaanataaagcctaagcataggcttaagccaaagcaatcttgattgangtgaacggatacacttanatataaatatttccatttcctttttatttaagtgcattntaattgagcttccaaatatgtatttaaaaaattcaaataatctgata

SEQ ID NO: 30584 - DNA, 960 bp, Heterodera glycines
ccattttcgatgtgttcggtccgattggctctttacttcgatttgcctaaatgatttaaatgttggcaaagttattgatgaaaactgtgcgcaccgaatccgaacagtttggagcttgccgacttatgcggtgcggccaacggttttgtgggcgaagtgccaccgccgaaggacggcgcgggggaagttggagtgcccaaactaccggcactgtcctttttgccacctctgttgagaaaccatttatcatttggacaaaaaccgctaaaaactcacaaactgatcactccgatggaattggccaattggttctgataccttttcgggtcgaccaaggcattcaaaaaggtctaaagcagaggacatcatcatcgttttctcgcattaaattgggtttataaccttttgctggtctaattgtgccgacaatttggccagccattgctctttgtcgtcgacagacgccgcctgtgccacgtaagtggcctgctgatttgggtcgctgctttggagcacaaaacgcaacggttcgtcaggcactttttcgtccaacatcattttgttaacctgaaaagcgaatgaattgcaatttggtttttggaaagacgaataaagaaagtgccggttctgagggattaccatgatttggtttttgaagttgtacgtcgggttgccgtactccttcctcggcggaatgcactcggcgattatcaccgactgctcgaacagaaacacccgccgttctttgcccttaaatggctgcgcaatgccaccgtcggagatgaacaaagtgccctaaaaagcaattttccccattaaattttctaacggcacttttgccaagccatatcagcctttggcataaacccttggaaattcgtcaaatgacctggaaagtgagccgtccctgcgcgtttaggttgccctgaagttctgaagtcgtccgacttgcatcatgtc

SEQ ID NO: 30585 - DNA, 1854 bp, Heterodera glycines
agcaatcaacaaagaacaaagaggacaaagagctggaacgacatgcgcatacggcagaaaaaagacaatcgacatgcaagagaaacggcaacgaccaagagacgaatggccagaggaaaacgaaacgctgctcagctacgttcaacgcatttacggaccggagaattggacgtcagcatggcaaagaggacgtgttctccgagaactccatgaactggaagatcaagggcgatggatgattcatcacaaatccgatcgcctactactcagcgtctcgcgaatgtatagaggaaaacgaccatttgccgagttccgcttcgtggaaggcagatactactcacacatggtgccagaagatgttgatcttcctccaagcagtaccaaccaaagaacagccggagatcataacaatcgacgacacaacggcaccggcaacaaatacggaacaaacgaagcacccaacaaaaccgcaacgaccacaatcgccaaaactcgaagaataccgcatggccgactccaaaccgaacacgcacagccaattcaacctgttcgagccatgcgacaacacgcacacaacttgcgccaaaacagcgacttacggttccaccgcgggcaaccgatttcaaatggaagaattccaaaacttccgtgccaacaatttcttcgaggcattgctcttcaactggttaacacgcaacatgaacttgccagccgaagagatttgggcggcacacgaaggctacattcagtcagacacaacagtggaagaagtggcgcaaatgttctaccaacaacaagttgcagacaacggacgacaaatcgcacgagaccagcatttgaccgaggtcatcaatgtctggcgtaactcctgtgaccgatttggcgaactttacaatcaaccggcacacaagcaagtgaagtttcggccaatcacgacggaaaacgaacaacaaagcaactatggagaatggatcgaacggctcaacaatcgtacggcggaaatcttctccaaagctcggaccaaggcacaacatccaacgtacctgaactacaactgcacaacaattctgatcggagacaacgttgcagaagtattcaaaccgctcttctacgacgccaaatggttcacacatttcccggcggacgaattccgactcatccccggaccgaaggttaaacacttatcttcgcgtaccaagcgacagccgacaacatggcagcgcagatcgcaccaatgctccatcgattcatgcgatcagagatcgaaacaactttgatcctagccaaggacgacagcgctcaaaggatcagcaacaaaaaatatctgatcgacgtcacccgtgaactgaaggttggcttcttcgttttcaaccgggaaattggagaagcacgacgaatcgccaacagaatcaaacaaacgatgccggagccaatggagttggaccaagagcccgggacgtcaacatcaacaagttcagcccggcccggaacgtcaacaagtcaacaagtgatcagctcgttaatgctgatcagccttctttgccttctcttcaccagttcggcacaaggacaaccaactcgacaaaagcaatttgcggaagtcaaaacatggcacggcggctacatttccaacttcctcaacctattcacggaacgtgacaggaggacggcaacacaacacagcccatacgtccagcgatacattgacaaagtcctcgtccttaatcggagtctgagccaaacaacgactccaccggcaccaacaaatccaccacgcacaacgactacaaatccaccacgcacaacggcgaccataacccaaacacgctcaacaatttggtcaaccaaagcaac

SEQ ID NO: 30586 - DNA, 1038 bp, Heterodera glycines
  misc_feature (17)..(17): n is a, c, g, or t
caatgttttgacgcacnagcagcatttatttgtcacttcaaaattcgaagccatcaattctcccccccttgaagcttacggtaaccaaatgttgtggaggatgaaaaagcatagtgtaaaactgaatactggtacatacggtatgattgtttgatgatattaaacatacacaaaaaaaagacaaaagacgatggttgacttgactgattgacttaacgcaaattggcgtcagcccgagtttttggattgtaacattttccctttgtctaccaaattcgataattttggcgtcagaattataccaagattgtttgatcgacaaaaacagtccaaaaactcggttggcgccagaacgaccctttcccgcgaataaaggtccgtttttaaaaggttggcaaagcatgagaaatgaagaataattggaatggtcggggcctgagattgtccaagaaatcttcatttttttaaaatttcgtactgatttattggtcaaattactctattattaaggaattacattttgccaaccaattgcattatgaaaccttttaaaagcaattattaataaactacgttttgcatgcgaaataaacacacaaagaaagcagcgtgataaaagtgttatcaaatgaaaagatcgtgtcaagcaagcggtgggtactcgtccaaatcgttcaggtcggccggtggtgcaaccacgtgcagatggtcggaccccgctgccgaggccatgtcggggtagagcaagtccgtctcaccaccgtcctccaatggggcgatcagcatgtcctccatgtcgaacggatttgcactggcttaacgattaaagggattgatgaacaacgatttggctgtcgccctctccccctatttaaataaatttcctaccataaatttttcagaccttcaaaaaattttaaagaaaattaaagaaaaaactaagaatttttcgtttgaaattcttcagatttttttctgataaatttataagaataagtttgaatattttttttaaatcattttgggaggggggggggg

SEQ ID NO: 30587 - DNA, 1015 bp, Heterodera glycines
cccgaaaccctcccccgggtccgacgatttcggccccaaaatttttgtgatttgtaagctgtccatttttcagccaaaaaattgagcagagttggtgtagtaccaggctgatgatgagcattaaatagagagcaaagagggcccagcaaacagcttgatgaaaaaagctgctttcctctggtatgtccttgcacatttgaataagcggtggaagaacaccagaaacatgctcatcaattaacttgtcgctctttggaggtgttttagctgttgttgcggttgttgttgtttttgtgctcgggaaggttgtggtacgtttgaaaaaagatagttttcttaaatattcagtgtaggaatattcaggctcgtgttgttgtcgagtcaaagtcagattttttagataagcagaataggtattttccggttgtctttgttgttgttgttctcgcagtgttgaagaaaccaagggaaggaaaattcggagaaagaacaaaataagacccaatctttttgaatacataatttatttatgagacggcaaaatgaaatgacaaacggtttaaatagtggtatctgtgcttattgatcggtttttgtccaacattacaagggaatcgcattctcccatcaccactagcattattcctccgacgggtactggttgattgaatttgatgctaaccgctgtggtcccattctttatcaaatcaaacagtgccgcttgatcatccccgctgttggtcaaattgaacacataaatgcaatgagtttttccgtattgagcaaaagtaatcccgttgctctctgttgagttggcgaacccgaccgcttcattcatgtcattgaatgggcgaacatattttccatttctgtaatccaaatcatagggcgcttgggggtacggtcgcccatttacactaatagaaatttcgcgcacattaaatggttgaaagttgaatggactgcgcaaaattgttccagcatagtcagtattagcgaccaatcccattgtgat

SEQ ID NO: 30588 - DNA, 1471 bp, Heterodera glycines
  misc_feature (19)..(19): n is a, c, g, or t
atttatatgttaatatacntttttttaaaattaggtactcttggcaattttaatgtataatttatttaataattgtaattagcgtttttttttctcttacataaaaatctttgccctagtatttggaatttttgatgaactttgccctgcgcgtaaaaggccgaccgctccggaaataattaagcgaaaggatgatttattttctgtgctgctccccataatttaatagcaaactcaaagcgctccgggctattttttttttaaatttatattgaggaaaaggcattcagagccgcctaataagcagcatgtttctgctcgcttttggctctcatcagaataaagaatatttttgcggcctttgggccatttgtcaagttttggatgatgaaaaagtactcaattatttattttgccaactgaggtaatgaatacccagtggctattgtgaactttgcccttgcgtgcataaaattttttttcttttcattattctcaccgactgtaccggaaatgcattacacccctaaaaacgccgaagaatggaatgtgaaggcaagccacttaaagcaattttctgaaattttctcagcctttcaaattaaaatgcaaaagcaattaattacaaaaatttgtcaatataattttattgttatttttgagatttttgaggaattttatttattttagcaaaaaggctaacattctaagtctctcttacatattcagtcctgtatctttttaaatatttatttaactaaattgcggccctagggttatttgtcaagaaatggtaaaaaaattcaatatttctttatcagagaattattttgattccgattttagtctaattcttcaattttgggactatcttaaattggactagaaaatgatttgtggatgccattattttttatccgaaactattccagtcagagccttaattgcatggaaattaaattaacataaataggttattttacaagcagctcaattcattaatcgatataatttgtgaagaatttgaaatttaaaaccaaactttttttgctgaaaggctaccaaatatattaaggacaaacaaaattcaagctgagaaacttgaatctcttttagctacccaaagatggaccatttcaagcgtttaatttggtagttcaatggctttgagtgaatgaggcttcaatgcaattgaatgttattttttacaggcaataattattattttttagttcttttttgtgaggcaatttaattcatatcagcaaaagcctagacatttaaggaacgtcgctccttcgggagttctgtcatgttgaatggcgaaattgaaaatttatgtgccaaagagccttaacaatccaaactaaggcagaattgttaaacgggcgatttaaaattttgaaatttaatcgccaaaaaaaagccttataagagaaaaaaaatccgcttttgatgttttttgtttgga

SEQ ID NO: 30589 - DNA, 1178 bp, Heterodera glycines
cactctcactgttatggacaaaaaagtggtcaactttttggtgtctaccaacacttcattcagagtggtgaaccatccaaccttccaatcattgctcgcacctcaacaaattaaagtggttccttttactgtatcacaataaataacaaaaaacttattttaggaagaaacgcattatcgaacccaaattcttcctgaagtttataaacaagtcaaaaacaaaatcagagataaattgaaggagtgtgaatcgattcattcacaacagacgcatggagtgggccaacaaacaatttcctatggtcaatattagaatgtaaatcttttaatgctacttttagtctgacggctcatgggatcactcaaaattggacaatgaaaaatcatgtgttggcagtgaccgattttcagggaacacattcaggaagagaaattgccaaattattatcaaaattcatctcagattgggagatttgccaaacgaaaattcactgttttttgcgtgactccgcagccaacatgaaatcagtagtgttctatttttcatttgatatgttgtgttttatttttaggccttttcctagactattgtggaggatagcggtttgaccagccaaattttgccatatgaaaatgtcagctgtggtgcccatttactcaatcttgtggtccaaaaaagtataaaccaatcgaagaagcatcaaagatgcttataaagggaccattgtcaggtgatttaaattacatatttatttttaaagcccgaggaccagttaactcaaataccaattgcactgacccttcacggcaaactttacagtgcaaaattagttaacaaagacattgatgtggtgcgttgttcattggttaatgaactcgataaatatttttttgctctccgtgaaagacagtataacattacatacatattttttcactttaatctattatttaaaagtgttcatcgtttgtcgacctttttggatttgcgtttcaaggacaagtttttgctcgaaggacggaacatttttcttgctaaaatttcgtcctggctcaaagaggaacttggcgatttcatattgccatttgataatgcaagcgatgaaattgttttggctccgtcgcccaaaaaacagaagctttctctttttgatgacctcaatgaatattgcttcaac

SEQ ID NO: 30590 - DNA, 1003 bp, Heterodera glycines
aaaacttttttatataactttgctcaaaagcaactaaatttttaattcttaatatttttcgatagccctaagggttttctattatcatgcaaaatttcaaaaaatttctttaattttaaataaagttatgaccaaaaatgttcaagaaaacttgcttttgagtttcacaagtcataattttttccgctacttaatgattttttaatagaaaacacttaggcctatcgaaagataacaagaattaaaaatttgattaattttggggcgaagttatgaatgattttctgtcaaaaattttcattttgatggtttttgagtaacgacccggcaccatttttttgttttaagctgacctaaattcttttaatgtatttgcgcatttcagcccggggtctgtaaccattcagggactggttgccaacaaaatttgaattttttcagattcttccattataaccgagagacgccgatttgatataaaaatatttcgtccgatttttgctttggctaagtacatttctcacttgtggaatttcgctaacaaataaaaaattgtattggttaaatgaatagttctcccctttttgttagttctttcgccaatttacattattaagtgaacaatcgtgacaaaaaaaatacaataaaatatgaaattgagtaattggtcaacaaaataacaataccgaggaagaaacaagcattcgccatgataaaataatttaaaaagcattgacgaataacggcgacacttttttaaggcgagatccaattgagcatacatttgcgtctcttttttcaactcgctcatgggctttctcgagtggtctatctcagcgcgggactcttttctctacttggccatttgtctgagcatcccgtcggcgctgctttacgtggccgaaattgtcaccattctgcggcataaacaattccacaattcattctacgcactgttcatcaaaagtgccgtgccgggtgattgctttggttgtgcagtttc

SEQ ID NO: 30591 - DNA, 1668 bp, Heterodera glycines
  misc_feature (1623)..(1623): n is a, c, g, or t
  misc_feature (1653)..(1653): n is a, c, g, or t
ggaaaatgttaagattttgcccgttatagaatccgttgtaacaggacagtctcgtacaatattttctcaggatatcctggtctggatcttgcatattttatcccggatattctcgtcctgtcctggcgggttgttttttttaattcgattcaaatcatcgcctcgattatcaataagtccatttttttagtgggtaaaatttgtttgtttcttataggaaatgtgacataaaaatattaatttttacaaaaattttcccctgtttcagtgtaaggacaaatgcattgagcagtaccaaaaggcggccgacatgtacaaaggggaggagcagcgcagttcggcggccaaatgtctgctcaaagtggcgcactacgcggccgagttggaccagtaccagaaggcgcagctcacttttgaggaggtggccatctacgaggcggacaatccgatgctgaaatacgctgccaaaacccactttttccaggtgcagttttttaataatatttttctcggcagtccaccatcaagaaaaattttgttgtttgtaaacgggtctggaaaaggaccggattttgacatttttgggccaaacttggtaatccaatccagggttgtcgaaagcgaatgcagattaatttttgttcaatttaacgaaattaacatgttacatcaattaaacaatttttatgccaaaaagttgtactagtgctaccagcagtgaaatttggaatttatattatgtttttataaacaatttttttagaccaattgattctgtcgtttgggtcctattcgggagaaatagggacggaattaattgttgttgtccaattcaggcccttctctgctccttgtgcatcgatttgctggacagtcagcgggcactgaaacgatacgaaggttggttggtcatttgatgaatgaatggtggggttcacatcaaaatcttgccaccggaatctcgccgcagaaattaaaaaaaaattttgaacatagaaacaaagtttgaaaatttttaagcattcctgcgccgagattttgtcccgcccccgtcaagtggtggttggacagggaaactcccgagggatgacggcgcgacaacatttataatttcattttcgctcataccacaaaatataaactttgaatttgtatgattttttcagaattgagcaattatttcgctgacgcgcgcgagtgccaactggggaagcagataattgaagcgatggaggtgagtgaattttatattggcacaatattcggaattttcattgtttgaagaacggggacccggacggattcaccgaggctgttcaacagttcgacaaaatcagccgtttggaccaatggcacgtcgcaatgttggtgaaggtaaggtgcaatgatcactatcgattgatcagtcagtgatcaattgattggttttttaattttccaggtaaagcgacgctgtggcgacggcggagacgtgaagaatgaggcgggggaggaggaggacgatttgcgataaaagggggacaccaaagacaaaaatattttaccaccaatatatttgacatgacacacacattcaattggacgacatgctgattgactctgtattatatgtaatgattctgngattcgaaaaagaaagtctaggcccacganaagaaaaattttttt

SEQ ID NO: 30592 - DNA, 1030 bp, Heterodera glycines
  misc_feature (22)..(23): n is a, c, g, or t
  misc_feature (40)..(40): n is a, c, g, or t
  misc_feature (49)..(49): n is a, c, g, or t
  misc_feature (57)..(57): n is a, c, g, or t
  misc_feature (72)..(72): n is a, c, g, or t
  misc_feature (76)..(76): n is a, c, g, or t
tttatcgtttttatttcttgannccctaagaagttacaanaacatattntgaccttntttgtgtttgctcanaatntatgaataaaaatgtaataaaaacaaaaattaaacacctaagaatcgatccttaaaattttcaaaaatacatcaataagaattaaaaaattttctaaaaatcatcaccaaaaattatttatttatttttttttgttaattttgagtttaaatattatgtatctcaatactgatttggcttaattgttgatttttggaaaaaattttacgcttttacacaactaaatgtgaaatttaattactttttactgtcgaaaattcctcctctttctcccctccttcttgcttcgaatttttccttttcctctctttctcttccgtcactcctccttccccaatgctattttcatcctttccctctctctatccgtccaattgattatttgattgattgatttgtgggtggggggataaggtaaaacgcccggcaaatggtcataattttgcaaaatattctctttggtggtcctcctctcctctgttgcgttccattccaattcactgtgccattccctttttctgctcgccgtttcttcggtcggtgctatgatgttggtcaaaaaaccatcaattgtagcaatttttttcaatatctttacttaaaatcaaccaaatttttacttctttatatcattcaatagctctagttgttttctattagcatgcaaaatttcaaaaagggtgtgcgtacgtttcgcctactggacatctcgcctactgacacttcgcctactgacatttcgcctactaagccaaaatcggacgttccgcctactcacctaaaatctgacattttgcctactaagccaaatacggacgtttcgcctactcacctaaaatctgacattttgcctactggacatttcgcctattgaatatctcgcctgctaacctaaaatacctagctctttcgacagcaaatttcaacaaatatatattctaattgacatataat

SEQ ID NO: 30593 - DNA, 1325 bp, Heterodera glycines
  misc_feature (1203)..(1203): n is a, c, g, or t
  misc_feature (1228)..(1228): n is a, c, g, or t
  misc_feature (1267)..(1267): n is a, c, g, or t
  misc_feature (1281)..(1281): n is a, c, g, or t
tcaaaagatttcgaaaataaaattgtaaattctgggaaagatacgttgcatgaattgatagacgccgaaccaattgatcaaaaaaatggaaaaatttgccatttttcaacagattgaccaaaaattactaagaagccataaaaaggatcttcggcatgcgaaatttaaatttgtaacactaaaaattatataaatcaaagccagcataaatattttataattatattagtaaaaactaaaagaattaatttaaaattgatttaaagtaaaaaaatgcatgcccttcttttttactaataaatgaacgagaaaacaaaaaataaaaataatcaattttattaattagtaaatacttgagtccataacaaaacttaaaaataaaattatgaaaaaaatactggaagtttattaagataagtttaaccctcaaaattagtctatagaataaaacgatttaacgcatttatttgaatttatattaaatcttaagtaaattttatgtaataaattaagaataattttcgaagcaaaatgcacaaaaaatagcttatcataccaagttatagaaattaatttaagtattgcgtaaaatttaaaaaagattatatgagaaataaaatagaaataatagataaaaaatgttcggaaataaactaaccatataatgatgaattcaatcgctttttctccgtttaaaaatacgaattatataaatcagcacatttaacgagaaaatatatgcatcaatcggtgttattttcaactattattattaataatcattttaatgaagaaaggccaaaatattaaggttgtacctcttccacccgtggttgtaccttccactcgttgttgtacctcttccacccgtggttgtacctcttccacccgtggttgtaccttccactcgttagctaaaatgccaacgtttcacgcacctgctagttataacttatattattaaagcattttatttataaaaaataaaatcgaagtcataaaaaatatacagttaaaagacattcatgtatttaaattgttgatcaggacagacttttttatacggtgcaattacctaggaaacccctaaaatgtaaaaacaattataacttaatcataattatgctttaaaaaaatgaataaaataacataaatttaaacagaaatttataaatgctaattttgattatgaacaaacattanaaatccaaaaaatataattgtttanagaaataaaaattttggttttgaacaaaatattaacaanaacttagcaaatanaaacattaattgttacaaaaagacacattataaaatcactaatt

SEQ ID NO: 30594 - DNA, 801 bp, Heterodera glycines
ttttctagattttattttttagaactttaaattaataaatttttcaaaaaaacttatgaatcaaaaggtaataaaaacgaaaaaagacaccccctaaaagtcgatcaaaaatttcaaaaaatacatcttaagaaatggaatattttaaaaaaatcatctccatttatttatttgtttacattcttgaaaagaatttttgaatttaaaaattatgtatctcaataattatttgacttaattttaatttgttgcttttggataaaattttaagattttacacccctaaatttgaaacttaattacattttactgtcgaaaagtccactgtcgaaaagtcccctccttaaatttaaaatatttctgtcgaaaagtcctttgctgtcgaaaagtccttctgtcgaaaagtcctctgtcgaaaagtccactgtcgaaaagtccggcgccctcacttttcaatttaatattaaagattaattatttttaactgaaagctaaactgatttacaagcgatatataaatgtatgcggcctctcaaatggcattgttttcatattgctaaatttgtgaaatttagtatgattaataggaaaattgctaatggttttgttggataaataaataataaatcaaaagtgcttgagtcgatgaaaaatttaaattaagcggcacaatgcaaataattagggcttcgtttttttaggcacaaaaagtggcaaataaaattttttattaacgctttttcggtagcaaaacacataaaaacttaatcaaaagactaattttggttatatttcaattgt

SEQ ID NO: 30595 - DNA, 1324 bp, Heterodera glycines
tatataataagtaattaaatatttaattaataaagtatattcatgtacaatacgttattctatattgatcttcaactttcagtgacgttcatggaatatgtacgcgaaatacactcctcagaagcggaagtgaaagtgtaaaaatgaatataaaaatcgatatctccttctacagtattctttttgttttggtagctgccagaggcagagaaaagatgaaaaaagaagggggagagagagggatggacagagtcggagaaaagggaaaagaaagaaacatggacatagagggagaaaaagggaaagagaaagaaatagtcaactcattcactcatttaatacctgaaaaattattaggatagtaagactaaaaaattaataaaagccactcatttaacacctgaaaatttattaaaattggttgaatgcaattaaaggagatttgttaaaattttattgactttaataaagcataaatttacaaaaacaaatgattaaatttatttgttgtcagcgtgagatttaaaaaaagaaacattaaatggcagtaacaaaaaaagacagacgcagaaacaaaagaatgaatgggaattgattgtcctgtgaaggttttgtcgttgcattaaaatgaaatgcatttttagcacattaaacacaaacaaataaacataagcgataataatcttaaaaagcgaaatgcaaaaaacaaatatcaaaaagagtcattaattaataattaattgtcgtcaaaatcgttttgagtgttcgtctccatccttccgctggctcagtcctccaagtccgtctcgcggatgggccggcagcgctcgtgttggaaaatggagagcgcctcgcgcaccagaaaggcaccgaactcggagatttgtttgcgcgaccagcgcgaggcgagcccaggaaacgagccacgcaccacgttggtcagattggcaacaccttttacggggcgacatcaataatggcaatttcagaattgtaattgatttttaaaaatacatgccatgccagggatttggtacccgacatttccgtccccgatattcggggacaatctcgtaatttggattgtctaaatgggtgtcgatttgcattttaaaacccctaaaacgcgtttgtttgattagttaattagccctcctatttttaccaccgatggcgtcgataattgcaccttcgcgcacatgcgcctcagccgagtgaatgttgcagaacaattgttgcgaaatcactccctcgccacggtcccaaagagccaaaatgcgtttcagcttctcggattgctgaaagtccgttggcatgggattag

SEQ ID NO: 30596 - DNA, 1086 bp, Heterodera glycines
gtttgttcctaattcatggcacaaatgtctccatatcactcaaaataaaatttcaagtcgagttttcgctagcacctgcttaggtttatccaattggcaggggtttgatagtagtaatcggcacatttaaaccatttgacaaagaattaaatggttagtgaaggggcatactccttcaataaagattatcagaaagttctcaaagtttaagcttcagtttgataattattgattcattgcaaatatttgtttaggtcggtatgcgaaactttcatgtgcgaaagaaccattactactctccaagcatcaatttggacaaactgtggactctgtgcacagaacggacgcgcaaacaatatgcagaagtgaaggacaaagcgccggtgatcgacgtggtccgggccggctatcacaaagtgttgggcaaagggttgttgccgaaacagccgctgattgtaaaggtaagtgcaaatatggcagcattggagaaaattttgaaaaatggacaaacaaaacatttacacatatttgagggttgacctggaaaactgtttttactgcacttagaagggcttgactaagaacgaaggagggttgggggatgcgttctatattggaaaagctgtgatttcttacgaatattctattcctccctaacttcaaggccaaatgcttctcgcactctgccgaggaaaagattcggaaagtgggcggcgcatgtgttctggtcacataaatggaagaaagggcttgagaagaatgatgatgatggcgccccttgacgaggaacacctttttatgttgttgtctttgttaaagttattcctttcgaatttcttttttttttgtgcaagtgtagtgggagccaataaaccgtgcacactggccatttcttatttgaatccgtttaatgtactgagtctaatgtgtgcatgtttatgggttctttgccgtaatattggtttttatccatatatctttctgccgttaatcaccgctttttgacttttgctttagttttcagcgcgcaaatctaaaaatggcatctacccaggaattggcggtcatttacgctattttggcact

SEQ ID NO: 30597 - DNA, 1041 bp, Heterodera glycines
ccgatgtgtaggagaatacagcgttcctaaagaagctcgcttccaccagacccgaacaaaagaagaacgaattaatcgaaaacgccacagctgaccaaattttaggaatcgttgaaatttgtgcaaatatattgagttttagttttaaactaacgaacaaacaaaaagaaagttgtcacaattcgccgatttctatagagaaattgcaaaatcacgttcagagaaaacggcaagaaaaaggatacagcagggggagtggtatagcactgggggctatcttgatcccggtactgagtgtattagcccaacatttattagaaaaactaactcatgaaatttgcaaagaaaatgttaatgattcccgaggcggaatatttggctctgaggagtgcgataaatagtggtgattctctccaaaatgaaaaagcgagtttagacgcaaaaatatctcagaatttacaaggacccggcataatcgatgacctcaaggcgaagagacacgattggctctataaagaaagacgtacagtaaaggggatacttgaaaatagaccacagaaggtggtgattgagaatcatgtacccggtccgaatgttgcaccatatctgggcatcaataaccaattcaatccacaagagaccgaagaaccacggaaaataattattcctaggaaaagacttaaagagcaaactccggattcagattcagataatgatacacttgaggagataacaccggaatcccaaactgtgggatcctcaccaacattaaaaacacccgttccgaacaaaacatctattatacacccaacccttttaaacggtctttttaggtatgtaaaagaaaacaaagatttatttaaaattactgcggctggaaaggttcagtcgaatatgaatttgccgattgaaaacagtaattatagagatgttttgttgtatctcgcggggaagaaagatgaaacgccgcgcggtgcaaaatttctcaaagatcggttactgaaggatccaacagtaaaagatatgggttaataaatcaaa

SEQ ID NO: 30598 - DNA, 1434 bp, Heterodera glycines
  misc_feature (21)..(21): n is a, c, g, or t
  misc_feature (81)..(81): n is a, c, g, or t
  misc_feature (175)..(175): n is a, c, g, or t
  misc_feature (1396)..(1396): n is a, c, g, or t
attgggtcgtgaaaacatganaataaatcacgcttaaaatccttaattaagattgacgaagtggaaaagcataacaaaaanattgattttttgtgataagcttctaaaaaattggtctaaaaagcgaaaaattctcccggcggtgccaatcagcagctcggaccataaaactctntaattttcctaaaaactgtcttaaaatcgcaaatattggtcattttccggacaaaattgtcgctttatatgactgggtcccttttgtaaacttttctgttttactttattaattacttttttttgatcagcagtgtctatctgatggtaatgaacctgtgattaaatttatcgtatatataaatttgttgtcctattttttcgaatgaataaaaaagccaaaaggtaaaaaatggaatggcatttgcaattttctcatattatccctattttttcatcccaaaatgcttcttccgtccgcccatcccatcggtgttcagaagagatacgccgtgtcgtaaacgccgagtccggcgccgatgccgccctcattaagatgagacaatttgctgcggaagtggtagccccgctggacatttgccagcaccgttccgtccacctcgttgcccaacagaaagccgtacacgcccaactcgggcaccaaagtcgccttttggggctcagctaagggccgcaaagtgtaattctgagacaaaggaattgtccaattaaaatgccatttcaaaggtgagatttttgttacttcaacggtcatcggacgcaatttttgcattaaaacattgtcccctgcaacgagtaaaaaatgcattcgattttgccttccgaaatccttcccatgccatggagtgtttcccctttccatgccatggagtctttcccccttcccatgccatggagtctttcccccttcccatgccatggagtgtttcccctttccatgccatggagtctttcccccttcccatgccatggagtgtttcccctttccatgccatggatgtttcccccttaccatgccatgtgcaatgtttcgaccaaagaggcatccggttgattgtctggcgatggtgccgtgtccatgccgacctgtcgcagaatttgccggtgcaattcgctgttgcgccgcttcagactcaaaccggcgacggagccgctgttcacttcgacctgaaagggcaaattacaaaaaagaaagggataattacccaaaatgccgatatcattcacctgcttaatttcgtacttttcctcgccgctgctttgatccgtgacaacattcaacagataatcctgaattatttccagcaataattatgcaattaaattgctaattaaccgctctttggatgagcagtgttatcggctgtcgaatgccctcctncctcacttctttcacaattttccaccattttttgcgat

SEQ ID NO: 30599 - DNA, 1053 bp, Heterodera glycines
tccaagtgggttacagagttcttttaaagaattatatctctaaagtaggcacgtcaaagaaattccacctaccgtggagaggaattttcagagtagtgaacattgatggtgtaaaggtaacaataacaagctgtaatgccccgcaagcaaaccctagggttgtgcatatcaaccaattgaagaaatccttcgatggattaggtcctgcctgtactgttcccgaactcactgagaatgaaaaagatgcccttctcggtgcccaatctgaagaactccaaaatcagcctggttattctcacactcccaatcctaatcccgattttgcctcatctgaaaacccacaagtgctaaatgactccaatgttgcccctgaaacctcagaaaatgcgacaaatccccaatcttcttacggattgcgaaatcgcatgtcccttcgtcgtcctcataaatttgattaaattttattctattgctaggctcaatacttttgaaggttctaaatcatttcttattttaagctaaatcgcattaaagctattattctgtgccttcaatggagagcgtctctctcgatcctggtgaggagttccaggaggaattgacggaagaattagaagaggagttgctaggaaaagaagagaagtgggtcacggcccaaaattctgaaaatgaggtggaaggagaggaaaaggagaaggatgagggtgaagaagttgagttaaatgaggacgctgagaagaagaaaaaggagtgggctacggcccagaactctacgaacaatgaaaaggaagttgagaagagtggagagatagaggttgaaaagagtgaaaagaaaatgaagtgggttacggcccaaaatcgttctgaaggcttcggaaacggtggttttggagaacgaaccgaaaaaattgttgaagtgcttcttttggatccggagacgtcggcgcggataagagaatatgtggtctgccaactccaaagcgaaggagttgtgttcgtatacccaaatcacgtcggaaaaaaacaacattccgtacttcatctttcttccgg

SEQ ID NO: 30600 - DNA, 1932 bp, Heterodera glycines
cggcatgatttgccacataaatatggatttttcaatgcttttttcactgctttcgtcaaagaagcaaaatgacgtcacaacaaatgtagataatatgaatcaaaaaaattttctgacgccaaataggtaataataaattaaattactaattttttattcaattgaaaaaataaaataaaattaaaaaaacttccgacgatgggtctgctgctccagctgctagtactaatattatgcatgattcacacaatgagttgttacccggcatcaatgcgtaatcgttttataacggcaataaataacttaaaaatataataaaatcataaattttaatttacaaaaatgataaaattaaaatgaaactctttagtctattaataaatagaaaaattgtaaaattaaaatgttcaaaataagaaaaattaaaaatatagaagtttttatttcgattaatgcgtttatttccaagcgatcaatgtttttgttctgttttaattgtttggctgtagtttttaaatatcttgcaaatcttgcaaacctctaattagagcctctatggttcaaaataaaaaaacaaaaatatcatttataaaaatattaaatccgctaattctaactcagaatttccatgtcgttcgggcagccaacatttggtcgcactgatggaaaagtacaccaacacattcaatttggacatggccactgatcagcattcattttgctctacggcccaccaagccgtggtggaaataaaaaacgaactaatcaatccaacaatgccggattgtgaaagtccagcgggtggtggcactaaaatggtgcaacaaattgacacacatttgtatgctagtaatcgaaaaggtaaattaattaattttaaaaaattcttaaactatcaataattgggctgcgaattttatagtcaaatgacttttttttttacttttttggactacgcttttttctttttgggatttttttttgacttttgtgcatttttttttgcgttttatggatttttatggtctttttggctaatttacattacttttttgcatttatttatgccttttatcttttttttttcaatttttgtcgatttttatttacttttaaaataaggataaaaaagatttaatgaatttgggaccaaaaaataaatattaaaatcaattttgataaatttaaattcttcgctttatttgattttgaagccaatgatgaagagtgcgcgtacagtgtcggctttattagtgccatgttcgaatttgcctctgcagcttcggcccatgctgatcaatcaatatctgatttgaaggagctaactttgaaatttgatcagcaaattggcatcattggcgaactgtgcaattgccttaataccgacattggcattgtgctcttccgaatgccacgccagggcaaaacagacggtttgaaaattactaaaaaacagagggggagaaccagggctgcacgcaattacggattacgggaatcctgaggtttcccagaaatgacgggttacaaattattgggacatgtagggttcgaatcccacccccgcacccggggacaggacaggttttttggcctcacccccgcccccgtgacttagacccccgcaatcccgcccccgcgaccttcatccccgcgggggcgcggggatgaaaacgcacccctaagaatggcattttctgggaaaaatgcaaaaaatttgtacaattttgaatttttttaaccattttgacaaatttttatggaataaagtaaattttgctttcatttttaatatattatgcttcaacactaacagtcttctttgttatgagtttgatgccggttgacgttttcttttgaatttattttttttatgattaatagacaaaaacacccataaaaattgaccattcttggcataatttgtaaaca

SEQ ID NO: 30601 - DNA, 1011 bp, Heterodera glycines
  misc_feature (46)..(46): n is a, c, g, or t
cctggcaggtcccttgactggtagaccagaaaaaaagatacgccantttttccataattttcacgatcaaatgcgctgagaaaaaaattccagaacaattagtatcaggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagacccggaaaagagatagccatttttccaaaattttcacgatcaaatgcgctgagaaaaaaatccagaacaatagtatcggcgtcattatgctgagagtgcggttggaat

SEQ ID NO: 30602 - DNA, 1219 bp, Heterodera glycines
gataaaatacctagaacagaattttaaaaaatattacataattaaatgaatgagactgcgcgaaaatgactcgattagaaaaaaaattatatgaagccattagaaaaataattatcattgcttttaattttaatgttaaaaaaattagcgatgaaaatcaagccatttgcatcattatgttgagaacagtgcaaaataatccgccaagaataatcttattaattctaataaatgttttaaacatgagaattatacaagataatagtgaaattattaataattttaattgtatgagacatgggattattaaaataaagaaatatgctatataataataaaaacttaaaaaatgatataaccttttaataatgcaaacatttgttttactactagccaataaattgatacatattatctaaatataatgtctttcagctcgcaaataaaaattgaaaaaaattgctcgtagaatatcttctttttatatattcccggtaatcaaagaaaaatcgtaattagaaaggcaattaactcaaaattattttatattttgttaataaaacaaataaagaataataaattagaagaaaatgactcatctaagtaaaaggcaaaacatactaaaaaaatttcaaattcataaagttcataaaattttttatttcataaaattgtgcaaaataaatttcaatatacacactaaatataacaatattaacatttaatgaagcttaaactatttttaacaatcaacatcatcaacaaaataatattaaaaattaaatataaaccgattcatcaattgatttttatttagattcaatgaataaatttttgtcatataatttgttaattaaagttaaaaattaaaaaaattaagttttataaatttgaaaatgcgatttcttaacaattaatatcaaaattttttcttgaagctaactagatatggaaagaattcacacgaattttttaacaaataataatatatacaataaaaaattcatttactagcataaaccgcgctacacctaggtttctttttttaaattaattaataaaaaaatattaatttattaaataaaacaaagaaattgttgaaatcggcagatctaagaaaaatttatacttgaataattaactttcatacaacaaaagacaattcatacgacaaccttgagaaggagcaactcttggtagtaatataaaactaaaacct

SEQ ID NO: 30603 - DNA, 648 bp, Heterodera glycines
tttgggttcaacctaaatcaaaatcgtcggctccgaaaaccgacaatttgttccattccactaaatttctcattcatttaccacttcggcatttcgcatcgggaaacattcggccaatttgtgacggattttcctcgaaaacgccgggtaattgtagtcgaactcttcgccgctcctccccgggtggtccctctcaatatcgccgtacaatcgacgctttttgcagctgtgggctcatttggccacacagccgacaattgtaaatgggcaacttcaggtggtgcaaattcacatgggacttcagactcgtgctggcgttggccacgagcattccgcagtccgagcacggaatgaccgcacttcggaggggacgtctcttgcgcggattgtgagtctggcaaaagcaaagaacagattttcaccaaagctgccaaattttgcaatttttagcaaatcgacgactttttttattcttaaaaaagtatttttttttgcggcgtggtttttttaaaaaattttagacgacacgggaaaaattttgtaatttttaatgttatttgttagcagattttgattaaaaaatgaccaaattttgagtttttgggctcattttttaagaaaaaaataggtttttgggtgggggggggg

SEQ ID NO: 30604 - DNA, 1274 bp, Heterodera glycines
aaattttgggaaaaaaattttcaagaaaaaatggaaaaattttccattggcttcagaagcaaccctcaaaatttttcaacaccattaatgtaaaaaaattttacccaaggaaattatttttagatcctttttagaaattgtgcataaatttttattgtaaaagtcacaaaaaacttttttttactcccaatatctaccagttatcatacaaaaaggcaatagttaaactttgagatataaaaaaatcgtctagaataattatctcaacaatttgtcgggaaagttgaataaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccatttttttatgggccagcataataaagtaaacccaaaatgtaagtgaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaattatttttacatcctttttagaaatgctgcataaatttttattgtaaatagtcacaaacaaactttttttcactcccaatatctaccagttatcatacaaaaaggcaatagttaagcactgagatataaaaaaatcgtctagaataattatctaaacaatttgtcgggaaagctgtataaattctgggaaaaaacttttcaagaaaagctgaaaaattttcaatcgcatcagaagcagcctcaaattcttcaacaacataatgtaaaaaatattacgcaagaaattatttttagatcctttttagaaatgctgcataaatttttattgtaaatagtcacaaaaaaacttttttttactcccaatatctaccagttatcatacaaaaaggcaatagttaagctttgagatataaaaaaatcgtctagaataattatctcaacaatttgtcgggaaagttgaataaatttcagtgcaataggcatattggcacatacataaa

SEQ ID NO: 30605 - DNA, 1938 bp, Heterodera glycines
  misc_feature (33)..(33): n is a, c, g, or t
  misc_feature (1915)..(1915): n is a, c, g, or t
  misc_feature (1917)..(1917): n is a, c, g, or t
ttggaaatgccaatttgttactcaattagttgncagaaatttcctcatgagattcttgcctgtttgaagttttaacattcttacatatcacatatatacggatttgtgtcaaccataaaataatttttcattgttttgataaaaatattggttaatcgaaaattttttttttgcgaattagagttttaaaatttaacttacctatataccttttagttcaattttatattatgattttgtgtactgtagaattttaaaaaagttatgttattctgtttattgtgaatttatattaaagattttttgcattggttttccaaaaaaatcgttttagcgagtcactcatagtctggatgaaagattgggcgctatatgcaaagtggtcaatttttaattttatcaaaaagtaaagggggaacccttttgttttgtgaaatttttttgtgataaaaaaccatgaaaattgtgttatccggggttttagaggttgctgatcacgaatctgacatctgattcgaggtcatggacccaaaaaaccccagggaataaattttcataactatatattgaaaaacttgcaaaacaatagggtaccccttttgtttttactttttgataaaattcaaaattgaccaaaaccgttttgctcgactccccgtcttacaagaaacatgaacctgtaatgtttctaaaacccgtactcaggtcctcccagcttcagtcatggctttaaaaagcgctaattaccaacgtacatacatattcagtttttaatcactttagaaaatcatattaaactaaaaatgggacgtcgtcccgctcgttgctatcgctacattaagaacaagccttatcccaagtctcgcttttgtcgcggtgtccctgacccgaagattcgcatttttgacttgggtaggaaacgcgcaactgttgacgagtttccatgctgtgtgcacatgatatcgaatgaaagggaacatttgtcgtctgaggttaatgttaacatttgctgtaattttaagaaacgaatgattttctattttgcctcaaaaaggtgctacaaactaatctatcaaatcctatatacaatttgattttgacaatttgatgtttaggctctcgaagctgctcgaatttgtgcgaacaaatacatggtgaagaattgcgggaaggacggcttccacatgcgcgtccgaatccacccgtaaacatctatcggttgcattccaatatcattttgctttccaggttccatgtgattcgcatcaacaaaatgttgtcctgcgctggtgctgaccgtcttcagacgggaatgcgcggcgcctttgggaaaccccaagggttggtggcgcgtgtcggcatcggtgatatgctgatgtcggttcgtgtccgtgaccaggtaaatctcttcccttggctttcagctttattttctttttagcatcaagcccacgctcttgaagcattccgtcgagcaaagttcaaattccccggccgtcaatacatcgtcatttcgcgcaaatggggcttcaccccttttgaccgcgaagtttacgagaagcaccgcaaggaagggcgagtcattccggacggagtcaactgccgattcctcaagcaacacggaccattgacggaatggctcaaaaatccaatctgatcaattgtacgacggatatattcccttttatatgctttgttgattaaattgttggatctatacattcggattgggaatgcgtcaatatacaaaatgggcatgggactgcgtgctttctgtctacgacaacatatatgaaagggggagggtcaaccgaaattcttgcggaggtctgggggggtcagcgctttttctactcagcaaaaacttgttggaatttttagtggatttcctaagaaaatgcgggctctatgcctntntattgagtccaatcaattgac

SEQ ID NO: 30606 - DNA, 1195 bp, Heterodera glycines
aatttaacttttcattttataggttacccatttcactatttacattatgtcgattacggcaacaaaaaaattgcaaccattgctttatgaatcctacgaatgtctcagaaaacgtgccttcgacattgacaaagaattgcttgcttcgctgaaacggctcgacaattataagtttctaaatttttctgattgtgagattaatttattctttttcatttgctaggcgcttcaaatatttatcggaagccgaacgcgaaggaaggatgaaaatgcaggatggagatgaagaagatgcatacattttgtaccaccgagccatggccatttaccgtttgataagcgactcaatgactgatgcgttcaaacggagccgggtaattatatttttgttttcctaaacagaccacgaaaccttttgttgcaggatggtcgtattttctacgagacttctggtcgcctgctttcggatcttgaaaaggttgccgagagtttgaagcaacggttcggacagcgtcaaataactgggtccacacttgggagttctaaatcgttttctgatgagacgaaagttgaaggctcattgtcatctcaatcaagtccgtttcaaattttctttaaatttaagcttggaattaggattgaccaaaaaaaaccataatgttcagcatctttgataatctactggttatacagtatggaataaaactttatggtttgaataaaaattttttgtatctgtgacatacatgaaaagggggggaggggtccataaaatgacaaaatatataaaatccgaaaattttaggccacatctcttaggttgcattcttattcgaaacccacgaacttaaaacaaccacatgcaagatcattaaccaaaattaaagccgctttttcaaacctttttgggaataagtgtatcttgataaactatgtgactaataaagcatttttatagctgcccaacatgccaagaatatgtaattaaagtgaatgaaggaaaaaatattaaattgaatttttccatattgttttagtcaaaataagacccggggcacagccttattaatattttggctggggaaacaccaacatactttttttggggtgtcgaagaacggaacggcaatttggacctgtgcttttaaaaaaaatagcggataataattggggatctcaaaaacaaacttttttc

SEQ ID NO: 30607 - DNA, 804 bp, Heterodera glycines
aagaaaatcatcgccttcaaaaaggtgaggaggcgttaaaaaaataaataatcagaaatcgtatataaatgtcaatcaaataaccatataatctaaataataaaagaagaattatcgagtttcttaagctttcgtatatttaaaaatgaaaaaattatttattaaatttacacgaaattattgtttttgatttattttttatcccaaaaaaaacgaataaccacaaaaagtgccaaaattaaatgtcatcttaataaaaacaataacaaattacattataattttactttaataataatatttattcgtataaattttcttgtaaagttatgatttgaataaataaattaactaattagtccataattatgtcgcggaatggacaaaaaagagaaagggatttcgatccctttcaacgttcctctttggaacgttaattgatttgttggacaaaggaagaggctttggcctttcccttgtatgcttatgcgagaagagctttctcttcgatttttgactccctttttcaattcctttattagtcacaaataaatgtgtgaataaatggagaagggacgattaaatataaatattaaatagaagtgagaagaagtgccccaataggcgaatggtgcggcttttatagccctagagacgcgtgcgcatgcgtacgcgcatagagagagagagaaagaaagagggagagaaccagtaacacacaaaataaaaaatagagaaaaatactaaattaatgaaaggaaaaaatattaattattatcaaaatatatcatttgtcgctttccg

SEQ ID NO: 30608 - DNA, 1267 bp, Heterodera glycines
cattctcatcaattcattcatttttgctgaccaattgagcagcgaattgcgaaaggaaagctgaaaaagaaagcatttcctataaaaagttaaaaggctgttcgagagtctcgcttttggaggtggtcaattccagcaggtgttggttctcgaaactcggtcaaatttcactcactctcgaacagtttgaacaattacgactcccacaatttcactgacccttttcggcgttatcatcgttttcccaaatggtaattagatttcgtggaagaacatattgcccttcaatcgccgccgaaatccatttgacccatttcttctcgtcgcgcgcaattggagaacggacaagcaaaaattgactgaaactctttttgtgttttaacaactctgctgatttatcaacattttactgtttttaagtttcaaaactggatttaattttttgtttttgtaaatctcaaaatggccaattttatgtaaaattgctgaccaaaaactcccaaattttttcaattggctaccctggttttaatggtctaaatcttagtcgttccgccgttgaatgatttttcaaagcgaagtccgccattgagcgattgcggtaagaaaagagaggccaggatttgaaaaggacgatgaaattggcacgaggagaagtgccattcacaaatgcctaaacaaaggagcaacggtacattttttgagcctaccgtacactcgcctaaatatttaaaaagtgccaatgtggcaataaccttattgtcgatctatcataccgcctaactctaccatatccccacattactagaaaatgtttttgagtttttggctctaccgtacccatccccagaaatgttaaactacaaacagcacaaatttaaaaccaaaattgaccatcaccgttttgtattgttcaattctcgcaatccaactctcaatatcagagttatagacacggcatcgcaacactttaggcggcaaatcgttctccggacgagaggagaacaaccatttggtcaacgcttcgctttcgttcaacggcactttggcattggcattgccattgtcatgggcactttcaacggcagttggcaatttgggcaattcgcccttatcaaagtacactgattggattggtattttccgcggacttttatcgtcatcgatgcggaaaatgtgacggagaatggacggggcattctttcggagacggcgaaaatctttggatttgcaaaaaataatgccaccaaatgttttgtcggatcat

SEQ ID NO: 30609 - DNA, 976 bp, Heterodera glycines
attgcccgggagccttttttcctatgggtctcctttgccaaagcatgccaacatgcaaccacttttcttcccgctgcttccggtactgttccgtcttgatgaattttcccccgcctttcgctgattttgccattccggcaaattggccattgcaataccagccatcccaaatgttggacgtactccatgattgtagatcggcttgaccacattttcttttacggcaaccgcagcgccagcaattacaggcgcggcatttgtggcggcaggtgcggcataattattgaccatgtttttggtagcgttggcaaccgtaggaagcgcactgacaactgtctttgtacagttcactgcaccaggaatcacttggtcacttaaaaatagaatttaaaatgttaaaaaaagattattttaattattttaaatttttgttttaaaataattttagcggatgacaaattttatatttctggaaaaattcaaaaatttttatagaaaaattcaagttttttgctttatttaaagaattttcgtcataaacaaaaaaattaataaatggataaaaaaggctaatacaactagtcaagatcttttcgctttggtagtttacaaaaaaaaaagtcttaacgtctattaatctatcgtaatccataccgtacaactggggctaatgttgtcactgctctgatgcccaaatttgcagcactcgctaaaacattaatggtcgactgtccaagttgcttcaaatcattcccggcattttgatctgtcgcaaggccaaaagaaatgccaatgaataaaatgtcgaacagtaaatttagtttacttagcatctgaaaaattaaattttttattttatgattatgatgagaagataattaaatagctgctttatcaatagatttggttttttaaatttatgggtggtcatttttcgcattacaaattttaatgtcgctcttaaatattcttaaaa

SEQ ID NO: 30610 - DNA, 1037 bp, Heterodera glycines
actgacaaataaaatttcttttaattttgattattatttttcatcaaccccattattattaaaatatattgatagtgaaatatatgaacgagctggggaagcttttgagggaaaaaatatggggcgggccggattttaaccggcatctctggctttccggaccagtgttctaccagctctgaactaccgaccctgccttctccagcctctttgctcgatcatataggatcaattgttgcctcaattgatccattaatcttcctctcggggaagcttcttcttctctatctcaatggttttaattttataatcctggaccaaaaatagaactgctataaatcgaacaaatggttttgtgtggagtggagctgagttgtgagtaaaagcaccagcgaatgtgctagaagaaagcgccataaggaggacggacgatttgatcagcgtaagagaaagaaaatggagcaatgaatcaatgcattagtgagggattaattaacgagggattataattaattttttaagtttttgtttgatttttattttaatgttctttccgacgtgtttgaggcaatgttccgttatgatgccaaaaaggaaaagcggaattcggtaaaaattaaaacatagttaattcattattcgaataaacgaactgtttctggatccaggtatgtttttcttggattcagtccatgaacaggtctttttgtcggcaaactgcattttttgctgagctttgctaattgctactattgcttatacaatatttctgtcttgctcgacccttctttgccagttcctgtttcttatttttgaagagtttccgatttttaaaattattctttaatttttagttatattgcataaaaacacaaaatatgcaaataaaagtccccatttttatacgcaaatatataccaaaaagaagatgcttttccttctaatttagactacgtagaaaccaggaacaaaaaatgcatttttatttttgacagccctgataataaattttgctctgagaattcgtcctttatttt

SEQ ID NO: 30611 - DNA, 969 bp, Heterodera glycines
tccttttccttttcccttctcacaatgtgcccattgtccttccgcaaaaattcaaaatttcattttttacgaacatgcaaataaaaatgaatgaaagaaataaaagcgcagaaatacgcattacagaccaacaaattacaaattgtttttgtgatttcccacaaaataaagcattaaaagttcgtttgcttctctctttcctctgccttttcattacctggcatttttccacgccattcaaatttggccaatcggcgcctttaccttttcaattgccatgggacaaacaaacgccaccaaatgcccatttcttgtagaaaccattttgtgccaaacgaaataaagataccgttgaattttgttcaaattgtacagaatatgctccccttccccacgttcttcgatcgatcagttgggccatcgcaaatgtgcgactctcccgcccaatgtttgccccccccccattcatttgaccattccctttgacccaattttgtgctgatccgcgaccactctctctcctccccccccccctttcccctgctgctgtgtcctcccttttctttgcgtttgccttatcactgctcttcttctccccccccccccaatttcgcctccttttcctttccatttctctttcccttccattctttaccatctcttttctgtttgttttcccaaatcattcctttccttttcctttccttttccttggcttttcctttccttttccttggtttttcctttccttttccttggtttttcctttccttttccttggcctttcctttccttttccttggcttttcctttccttttccttggcttttcctttccttttccttggcctttcctttccttttccttggtttttcctttccttttccttggcttttcctttccttttccttggcctttcctttccttttcataggcttttctttccttttccttggcttttctttcctt

SEQ ID NO: 30612 - DNA, 932 bp, Heterodera glycines
caggcaatggatggctttcaatctgcaagaaattagattggcaataagtggttgtaaaaaacttttgggtaatgatttattttttgaagggagtcaaacaccctattagtgctttgctgtgccgagaaccggcaggcaatggatggctttcaatctgcaagaaattagattggcaatatgtggttgtaaaaaacttttgggtaatgaattattttttgaagtgagtcaaacaccgtattagtgctttgctgtgccgagaaccggcaggcaatggatagctttaaatctgcaagaaattagattggcaatatgtggttgtaaaaaacttttgggtaatgaattattttttgaagtgagtcaaacaccgtattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaccggcaggcaatggatagctttaaatctgcaagaaattatattggcaataagtggttgtaaaaaacttttgggtaatgaattattttttgaagttagtcaaacaccgtattagtgctttgctgtgccgagaaccggcaggcaatggatggctttcaatctgcaagaaattagattggcaatatgtggttgtaaaaaacttttgggtaatgaattattttttgaagtgagtcaaacaccgtattagtgctttgctgtgccgagaaccggcaggcaatg

SEQ ID NO: 30613 - DNA, 999 bp, Heterodera glycines
  misc_feature (978)..(978): n is a, c, g, or t
accagggatggcattccgaggcccaaaaaattttcggaaatcggaattccgggggtcaaaattttttcgtaaatcggaattccgaggcccaaaaaattttcggaagtcggaaatcggaattccgggggtcaaaattttttcggaaatcggaattccgaccccaaaaacgtcggaaatcggaagtcggaaatcggaaatttttgaaaaaataaaaaatataaccaaatattctaaatattttaataaggtaaattttatattattattcacaaagattaactcagggttttttggacaaaaatctgttaacaaatcgcattaaaaattacaaactttttcccggtggcgcctatcggcaccgccggacccctctcccctcgcccgttcaccaaaagttttttggaaaaagcgccgcaaaaaatttgttaaaaatctgatttttgatcccgagcgcactgaaatttacgatttaaagaaatttaggaaaattgggtgtgataaatttatttaaaatttggtgaattttattttttatttttaaaaggccatttcatatccctttcaaaaaattgttaactatgatcgtgaaaggaaatgcgtcagtagtgaaaatgcgtcggtgattaaaaacgagatacggtagtatgattgattgacgtggaaagaatgggaacaaatttaaagagttatgttggaatgataatttaaaaaaaagaaatgcaaattccaaaaatattgccaaaaagtctttcgaactaggatttcaaattcatccgaatctgatcggaattaatgccgaatttgtcagtgccgaaaaacggacgcatccaattgacccagcagcaaatgtgaatttgctggttgcggttatttgttgcaaagccaagccatcattttactctctcagcattccattatctcttaagtaccttttatttcccattgattttcaccccacggggaaattatttttatatnttttattcaggcacacaaaat

SEQ ID NO: 30614 - DNA, 2007 bp, Heterodera glycines
cgcgaagcgcccgttcgaggccgcgaagcgtccgaaaagcacaacaaaaattagaaacgggcgcaaagcgccgttcgaggacgcgaagggcgcgaagagcccatcttgagcctcgatgtggactaaaaacccataataattttttaaaaattcaaaaaaaaatctccaacgaattcgatcaatttgaatcgcttcacagtctaggtagcgaagctcccatagcgcgaagcgctttttcccagtctaatcacttttgtacctcttttaatcactgttgcacctcttctaacatttgttgtacctcttctaatcacttttgtacctcttttaatcaccgttgtacctcttttaatcacttttgtacttcttctaatcacatttgtacctttttaatcaccgttgtacctcttctaatgacttttgtacctcttctaatcagatttgtacctcttctaatcactgtcgtacctcttctaatcactgttgcacctcttcaaatcactgtcgtacctcttctaatcactgttgcacctcttctaatcactgttgcacctcttctaatcacttcacagcctaggtagcgaagctcaagaagcgcgaagcgctttatcccagctaaatagccgacggttcacgcacccgctagttatatatatgttatataggttttgagtttcgtttcaaaaactaattccggccggccgaaggccggccggaattagttttttatatatacgttatattgacaaggcaactcatctcaaaaactaatttgagaagaacggctaagcgcgcggggctgaaattttgcaccaaggggtaactcgagacggcgcatctgggaaaactataggttttttggtccgaggcccaactgagtaccagcggcttaaaaaccgactttgccgacagtctcactgttacgaaattttttgcttttgccttcagcgcttattggaccccaaaagcgaaatgccccaactatggcctacaactttgccagcaaaagttttttgatcagaccaaaggcctggtctggaaaaatggcagatcgaggcctactcattttggacacttcagtaccagctgaatgccgcgccagggtttgctcggaacgggtagtcgccagcggactttttgtagagctttcaaagggctatcgaaccatgtttaaaaatttcgaaaattttcaaaaattttcgagctaggcctaaaaaacgattttttggtttttgaattttatgattttttaacgaattttcccagaaaaacggagaccactttcaagcaaccgtttttcgagctctatcgattggtgacatttttagaaaattttcgatttttttccggaaatagaaaaaatttttggcctgagcgggacatttgagtcccgggcccataactcgtcgggggttgattttagcgaaaaattgtcttagaacttttttgtagagcattttaaatgctatcgaatggtatactatatgaagggaaattttcaaaaattttcgagctaggccccctagaaattttcaaattttttttggtgggccaaaatgggggtgaaaaatttttttctggggtattttgaggtgctgagcacgaatatgatatttgttgtttgtttcagattttttggaattttttaaaaattctttattttttgggaaatttttggccctcaggattttgtataatattggaaaattcataactcagtgatggtttcatcgatttaactataataatgctttaaaaatagagaaaattcaggagaattttataggatttatttggaatttctatctctaaaaataaaaaagatattccagaatatctggaaaaattcgaaatttcagaaaaaaattcagaactcggttctgaaaagtcactcgtgaaaagtaaaatactacaaaaatccgcaatgtttttctctataggataaattttatttcaagtttttagaaggttttttaaaaaagatacaaaaataaaagtgattttggg

SEQ ID NO: 30615 - DNA, 874 bp, Heterodera glycines
ttaaaaacgaaaaaaagagaaatttattttaactgtgctttttgcaaaaactggcaaaaaaaaaatgaaaaaaagcaaaaccaaacatttcatttttcaaattcatttttgaacgcaaaaactaaacaaaacgccacacaaattcaaacactggacacatgatacagacactcaactttattatataggatagttttttttagtggcgaagctccaaaatagtgatgaatagtggcactaaaaacgaaaaattttcgaaaaagaatgtgtttttcgtgcatttctcgtcgagttaaagccgcagaaaaaatagttaaaaaactaagaatccgatccctattgatatcatacgaaagcttaacacttttagaagcttttttaagctattgagtcgcgattagacaattgccaaaaaagttatccttttgctgattattcaatcggggattattttctgctgtgtgggaatgtcactggtctgaatgtgttgattaacaacaccacacaacagtctttgttgttctctgctgttggtcaatggttcgccaattggcgaaatcaaacaaaaattcattcgttcgttcatcgaatgcctttactgctgcctttggtgtttagtttttgcaataagaaacgtcgacggcacagattggctaatgaatgagtgaatggcaaattgtttcgtgcccaattcgccgattggagggatttgggtgggaattttgtgcgttctgttggtgcttttctttgcccttctgtccgttttccattccattgcataataatgcctttgcctttccccccccccccccccccccggggccttttcctaatcgttcgtcctttttctgctcatttacataataaattttga

SEQ ID NO: 30616 - DNA, 1717 bp, Heterodera glycines
  misc_feature (1692)..(1692): n is a, c, g, or t
cgcaaccccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcgaagcattggtgcgcccgagttacggtccgtaaaacgcgaattagaaccacaagttcgcgcctgcacaccaaaacctccacagccgagccgagcaagtaacgtaagaacacgtacaagtacatgatcccacgaagcaacgcacaagcagtgcattttatggtaacgaccctgaaccaggcgtgccaatggatgtaactccaatggcgcaatgtgcattcgaatgttttgtgttcaaggtttctgcagttcgcactaattatcgcagttggctgcgttcttcatcgatccacgagccgagtgatccaccgataagactagaattcattcttcaacagaagtgtaaaaaaataatgaaaaaaagaaaaagctggcggtgcccgagctgacactcattgagtcttaagccacgtgctaggccaagcacgggccctaccgcgtcgtctcatcacggccacggacgtagcagcaagcacaaacacaccgctagttacggcacgtaagaccgggaacgaaaccaccatccccagtcagtgtgttatgtgcctgccacaacaaccgctcaacgacgcacagacgccagcacagccgttaggtcgccccacgagcgtgcatcccacattggcgcagcgaaccaaccaagcgaggcggcccgccaccgacacattgccacgcagcagccatacacaggctttcacatgtgcagcactgagcggtataccacagctccaacgtatggaagcaccccaaaagcatggctcgtgaggcagctgccccgtaatgttgggcagcgtccacaagtcatctcgaacgacctgtgcccatcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccngtgttgagtcaaattaagccgcagg

SEQ ID NO: 30617 - DNA, 1502 bp, Heterodera glycines
  misc_feature (113)..(113): n is a, c, g, or t
  misc_feature (1431)..(1431): n is a, c, g, or t
  misc_feature (1491)..(1491): n is a, c, g, or t
ttttaccccatagttagtcacacattgttgctcttcatctgatcaatattccctctccgtaaaattcgtaggtgcaatcactgatcagccgcacttatcggtctcacttggangggtgctcgggattggctttttcttttacaaattatgtttgaattaggcaccccattatcttccaatttcacctcaatgataaacgcgtctatcagtgtgttattcggttgtcttttttggtcgagattagtgtacagttcggcctctagaacaacgtgaaaaacaagaagtcacaaccttccgcctcggcatcattttcccttgcgctcccctccgttccacactcatctgtcattcccgtcttaaaaaggcgagaaattcgggcttgttggcagaaatctcttgggaatatgtaaaagtttggtaaaattggaccataaatttggaaaatggaaattgaaggaggaagagaaaaaggttcaaattgggcgatgaagaagcgataaagtgaggggaagagggacgatgacggaacagaaatgatgcgattgaagggaaagggtcaaacggaaagtcaaacactaaacgcttttactgaaattgccaaaattgtgagaggtaattattctaagtgtaattgtacccagcagagggagagggagagacaaatgagcacaaatgggaaaaggcaatcaaatgacgtaattaacgaaaaataaacatacatacataaagttaggaggcagaccatttattagaaacaattaaatccaaattatcttacatccttagaattcgagcttctctaaacgaagcttggcttaaaactcgaagccgcagtccgaaacaaatacttatttttatgagatttgtgccgcctctaattttgaccaactgaatcaaactgacaacaaatagaaaaataaattttcgaattttgcttaaaaacaacggcctgggacttgagttatagcgtaataaaaatttgaaactcccacaagtgttttctgaaatgataaattgactagaattcgcttcgaaaaagattctcttttcaaaaactttttttagaaatcaaatttgttcggtttggatgggaatgaagcaagttatggctgatcatagatcatcaaaataaattgtgcaacaaaaaaggcaatgaccaatgtattttgaattagcacgcaaagttacgctaattatgctatttggcgaaatgattaatagtctaacactgacaccggaacgggccaactccgtctgagccaacttgagtcaatataactcttgaagttattgaccgaatcaaacaatcttgatatcattcgaaagctcttcacaggctctattagcctactaaaaattacagaaaatttcgaactataaaaaaagatagaaataaaaaatttgaaaattctgccttttttgcggttttanactgacaacttttttgagagctgattaatcactgagaaatagcttataaatatcttctanacatctaggga

SEQ ID NO: 30618 - DNA, 715 bp, Heterodera glycines
ctaattgttctggaatttgtttctctgcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaacggaatttctttctgggcgagtttgattgtgaaaattttggaaaaacgcctatctctttttctgctcaacactctagacaattccaaccccatttacggaatgatagcgccaaccctaatttttccggaatttctttctgggcgagattgattgtgaaaattttggaaaaacgcctatctctttttctgctcaacactct

SEQ ID NO: 30619 - DNA, 1350 bp, Heterodera glycines
agcgctcgtccttggtgcggtagcgagaaagtggcacacggatgtttcgtgcgcccacacccggcacaaggagaagcccacggaaggtgtgttttccgagcatgtccacggaagaggtgccgtcggtggatggaggagcacttcgcgcgtcagcacatgtggattcccaactgggaaaggattcaccttctaaaatttacattgttaaaatgcaaaaaaaaaaaaaaaattagaaaccatgacgtaggggtaaaggctgacaatgtcgatgcacagcacttcctcatcgtcagcgcacacatggtggagcttgaagggctctgtgcgccctcccctcaacgcgtcagtgcgggggtccagtgggcatggcgtgaagacggcttcgtaccgttgcttcagctcatggtcacgacgaaggcgctccttccactgacagccccacatcacatggagctcacatccatgttgatgttctagctcatggaggcgccgcattgttcgttcgtacaagtcttcggctgttcgtccggctgccaacttctgttgtcgatcagggaagcactcgggacaacctttttttttttttttttggttactgtgttttttttttttaattttaaattaccgtggtagaagcaacccatccattcgatggccaacggacgaaggggtggctcccgtcgccaaagaccgtccacacggtacccagaatcctcgatgtgcgcctcccccactgaccagtcagcgcactgcacctgggctccatcgttttccaactcaaagaatcggatgtagcgacgagattcagcggaagcacgtcgtccacggaggtagccgccttctggcgaatgcaccaaacggttggcggggagaaagcatcggcggagcgttgcgagcgcgagaccagcggccgtcgaagcgcagaggaaggggtcaaggccttgggtgtgttcaccgatgagttgacgaaatcgaaggacagattcacggagaattgccacatcgttgacgcagtacagaataagctgttcgcgtagttgaaaactggcgtccgcgttgttgtcgccgtgccatcgaagaaatttggttcttttttcgaccttcatcgtgtcgggcgaatagtgttctattgccggaagaccgttgagacgctgcagcagatgttggcgctgtatgtagaggtacggaaagaacggcttcaccgttgccagatgttgaggcagatcaaagctcttaaccaaggcatccaattcacagaagaagtagtttatggagtccttgaatgtaattcgtcgttgatgtcgaccacgaagcttcattgaatatattttgagcccagtcgtacagagt

SEQ ID NO: 30620 - DNA, 1189 bp, Heterodera glycines
tttacctttaaaatttcagaaaatttcatgagattttcaaaaaagttctggacaagaatttctgacttaaggtgatgacaataatttttttttataattaattggttgaatttgagcaaagttatgaatttatatatattacccattttttgttttcaaacccattgacggaatttaagaaacgcgccagcacgataaaatttatcggcatgaaatttaaaatcgatcgatttcagtgctatagagaaaaaagcagtccgaaagaatagttcgataaatttagaaagtcgaaaagatgatgaaaaaatcacaaattgttttgcctttgtcgctgaattttcttagtcccatttaggcaaaatcaaagtgaataatttgcaaaaatttcattgagagggaagccaaatccagttgcaatggtgaccatatggcattcaatcgcacataattggttgatgtaaaatgagggcagataagaagttggataaatctttaaaaattattaaaacctctcaactttttggtgtaaaaagaattaaataggctcacataagaatgcaataaaataaatatttttatagagtttgttcaatagaaggctaaaaattttgtgcagttttttagctaaaagctttttatgcgaaaaactttcataaattacaactaattttagtaaaaacaatagtaatttttgttgggacgatagattttgtacttttctaaaatttaaagttttgaatgcctttttgctcaaaacttttgtgaatttttctaattgagttttaaaaaatccaccaggttggcttaccccttttctaagacttttcatgttggcatacaaacggtgaaacataaaaaggttttccatcattttctgcattcttttgtcattctcttcaaaagattgtacaatttgcttgagaactttttttaaatcacaaattttttttatatttcttggaaaattccattacttcggcacgaactctggccgaaactccggcaaaacattttgccaactttcgaactgcttttgaaaaattgtttcatccaatccatcaaatctttttggctattcgctgctgaggacaacacaattttttcgcaaaattcaaccggcaaaattagcaaattgtctttccatttttaaattaatcactttaaaatttgagtatttttccattaccgt

SEQ ID NO: 30621 - DNA, 1151 bp, Heterodera glycines
ccgcaaaaaaataaaataaaaaaattaggcttagaaattttttaagaaaaaatcatagaatttcttataagaaaatttcaaaaaaaaattagaaaaaattttcaggattttttttgaaatttatgataaattagtaagttttttagaaaaattttccaaaaaatcactaaaaaattttttcaaaaatttttcattggaatttccatataaaaaaattctaagaattttttcttgaaaatttccaaattttttaaaaaaaatttttggcgaaattatgtcccggcgaaatttcggcggcgaaattatgtcccggcgaaatttcggccggcgaaattccgtccggcgaaatttcggcggcgaaattttggggtgcacccgcataaatcatgcaatgacagcgtaataattgcacttaaaattattttttaaaggttagctttaatcttaaaactgcataagtatcctattactattgtaattactaacagccttgtcaaaaagcgccaaatttccagcaaaatcgaaatccgtttccatgtttgggtccaacggatctcccataattaactctgcattgcgatcattaatgtaactgcgatatccattcaaacaatcaacagcaggcattccagttggacctttaacaacaaaaaaaaatgctttaaatacaggaaaaagtagtttgaattcataaaaccaagactccattttcaatttaggagtccaatcgacttttatgagcccaatcttcagtttctttggccataattctaacttggtcaatcaatacctacttttttaatattaaattaaagctatctaagcctatagaatttttgagtataccaaaattctgggctcgaagcaacagaccaaaaataatttttgaatatactcaaaaaaataagttaaatttaagtgtttctcgttgtattttttttcttgttgtcagtgtttgctcttttcttggatttatgaattcccgggacaaataagctttcttttgataccaagaatgtaggtattgattgatcaagtaaggaaaaacaattatgattggactctcataagcaatagagcacaaaaaaatcggcgctactctaaagaagggcggttttgaattttatcaacaacaaaaggggggagggacc

SEQ ID NO: 30622 - DNA, 1621 bp, Heterodera glycines
  misc_feature (1509)..(1509): n is a, c, g, or t
  misc_feature (1537)..(1537): n is a, c, g, or t
  misc_feature (1542)..(1542): n is a, c, g, or t
ctttgcctttttggacctattgaatgtgaaatgatattcaactaaaaccctttttaattgtttcgtagccggagcgtgaagtgtggcgcaatgggaggtgggaaaatggcaaacaaagtgttcaaaataactatattttaataatttaaataaattaatttaatactaagataccgtatttaattgaaaataaaataaaatccaatttattcttttaaacaattaatttaatttttgaaatagtaaaataaaaatgtttaaatttttaaaattattctattcttagttttaagggcaataaataaatttataataatattaaatatttcattttttaataaatgacccaataaatcttgaaattaaatttattgaattatttttcttttttccctttttccagtgaactctcttggcttcaacgactcctccaattgcgtgtgaagttaaaaaaacaaggcttaatctcttttacaaaaccaccatttttaaaggatgaaaaaccgtgaagctgttcgttatctgatcagattggacgagcaatggtccgccgttgcgttgcccgtcactgtgttcatcgactaccaagtgaatgaataatgaatgattgaatgattgaatggttgtggaacgataaaaaaacagttttaaatgcatttggtgaaatgtttgaggacaagggccccgagggcaattaattgatgacggggaaaactgctggccaaaagacaacaacaaccataggtcggcattgttccaaagctccaaatatttttaagctgttactaaaatttttttgtggctggatagagaaagcatcctttgattcttaagaagcgcttcccctttttttgcataaagtgagaccaaatgccgtgaaaaaatgccaaagtattattttctactacattaaaaacttggcattttctctcactttgtaaaaagggaattcttgaggaccaaaggattatatctctctatccatccattaaatttacgtaccgaagaaactccacggcggcccaagacacttttccttttttgagcagagcaatggcaactcgtacaaatggcaactcgtattttacaaataatgcctaacaaataaggtgcgtgagaatgcgtatgtgaaacacgcgcggcacttgggcaacggcactctgttggacggatggttcaccggcactttccccgtctggcggacgcccgacctccggacgcacgaactttgtgtgcgggtgcgtaccgctgcgtgactccggaggcccaaaaaaaactgtggaaaccgcggaattccagcctagcaaagcgacggaacccggcccggttccaccccttcttcggcattttgccgactcccggacaatccgtcagcaaaatttatttttaaacatcagattttatcaaaatcatatgaaaattaatttaaatcgctaaaaaagtgaattaaatgttttgtgttaatttatttaaaaaattatgaaagaaaataatttttaaaagaattanatgattatttctatagatgatcaattanattanattattaaggtaattactaattagttttatttcttaaattaaacatagttttcacaagatttttatcattgctcaaaaa

SEQ ID NO: 30623 - DNA, 950 bp, Heterodera glycines
ttttgaggggatttttaaattattcttatcccagaaaaatggctatcttttttttgagaaattttatccctccaaaagcgcttgcgtatgagacggagggctgtgcacatcgccatttatttcacagaggattttatattaagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtagagacggagggctgtgcacaatcgccattttatttcacagaggatttttatatttagaggttatcccagaaaaatggctatctctttttttgataaattttatacacatacaaatgctctcgagtatgagagggagggcggtgcacaatagtcattttatttctgagggaatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatac

SEQ ID NO: 30624 - DNA, 687 bp, Heterodera glycines
gtcgataaaggaaaatgcgatggcgatcaagaatacttgaatgtacaagaaacaaattattatataattatacaaaataatcattaaataaataaattataaaaatttgtaaatttatttatttattttaacgattatattaataaaatatcaattaatattaagacaagctataaaattcctgttttttatttgacataaattaatcaattgtaagaattaaaaaatatatacataaacaaatcagttttaaattttggtaaattgtttgcctaatttagtacaaaaaataactttaatgaatataaaataatgatacaaaagcctaaataaaaaaaataataagatcaataaaaaataaactataaatattctcatccaacaaagggtctcataatttattaaataaaaagtctcaaaatgcaacacaaatgttacctactgaggtttgtctccatttttaaataaaataaaacaacaaaataactgtcatatattaaataaagtacatttaccaaaaaatgtcatgttttctgaaagcacaatgagtaagagtctcctgcacaagaatagcaatttttaaacaacgaattttacacaaccactttcctttacattgtgatgcataataaaattttttaatacataattaatcaaaatataattaataagagtggaaagggttac

SEQ ID NO: 30625 - DNA, 942 bp, Heterodera glycines
  misc_feature (37)..(37): n is a, c, g, or t
aaagtccctctgagacgtttttgagcccactacgacnaagagatgattgctcaaaaagactgtagacaattttgaggagggaaaggcttcaactatttcaaacaatagctcagggggcaggggcattgttagctaaaaaagacacggtggcattctcttacgatagcggcacagaaacacaaaaacgaataaatgactaaaatcaaagccaatccaattactttttagttatttctttctgattaatttctgtgtcgtttaacattttcctaaaatttgttgctgtcccttaaaactttaggaatcagggaatgttcaaccctttctccctcagcccggctgtgattggctccaccctcagcccgccacggacagcaaacaataatgtgaatgattgatggggggaatttgaatatgcttttgtctttctgtgccatccctcccccatcatcgccactgttgggagtgggcaaaagaaattttttttctcaatttcgttggatgattgatagggaaatttgaatatgcctttgcatttcggtgcgcttctcccctgccaggcaccactccgttattgcccactgcgatgggagggcaaaaatggactgaatgaaaatgaaatttcttcgcaagtttagttttgattgacagttcagtgtcataaaaaaaagaaaatttgaaggaccaaacggaattgtcataaaaaattcaaatgcgaaggacgaaagaattgcgattgcaaaaaaaaaaaccaaaaataggaaagactagtaaaattttttgtgcgtttgtgcacaatttatgttgggcaaaaaacgaatgagaacaaaaaaactttgagcgtttgtgcactaattatgttgggcaaaaaatgacgtttgtatatgattgagtcgtgtaagacctaaatgataggcaaaaattttgcgcttatgcccaatt

SEQ ID NO: 30626 - DNA, 799 bp, Heterodera glycines
aagcggttggccgcaccaaaaaaatggatgctggacaagctgggcggcgtttttgcgcctcgtccaatgtgcggtccgcacaaattgcgcgagtcgttgccgctcattctcttcctgcgcaaccgtctcaaatacgcccagtcgtacaacgaggcgcgcatgatttgcaaacaacggctgatcaaggtggacggcaaagtgcgcactgaaatgcgcttcccatgcggaatcatgggtatgtgtgtcaatggaatgaaatttgaaaaattgggatggatcaaattggcaataacgaaaacggatcaacattggtataattgccttgaatagcttgttcatccagtagaaaaatgcgggagtttgattcatacaaatggtttataatacaaagtctaccaagcattttcgaaaaatgagttggggtaaatcacggaagatttagaaaattggccgggatcgaaacctattttgtattgggatttacatttccggtttaacatttacaaaatttccccctctgatttacccattgcaaatgtgccgtttatattcagtaccatacatacatacattatttttcctcatgttcagatgttatctcaattgaaaagaccaacgaaacttttcgtttgttgtacgatgtgaagggacgatttgtcatccaccgaatccaaagtcgtgaaggccagtacaaactgtgcaaggtgaagaagcaggcggtcggtgacaagcaagtgccgtacattgtcacgcacgacgcacgcaccattcgctacccggacccgcacatcaaggtttt

SEQ ID NO: 30627 - DNA, 1033 bp, Heterodera glycines
aatcacaatcagagaagggcgaaaaagtttcaaaatttctaatttttattagcttcgaacttcgggcaaattacccaaagtttcggaaaatacacttccaaagattgaaaacaaagtaatgaagagctatgggcttaagaactaagaatgacacttttttctagttttattatcatgtatttgttttgcaatattattttattagggaatattttgaaaagcttcgtgcttcgagctttgaaaacttctgtgttttgttggcttctatccgagcttcgccttcgggcaaaaattgggcttctccttcggctctgagtgctaagccgagcttcgcccgtctctgatcacaccccttcttaatgcgattaaattaatttcatttttttctgatttgatttcttaattcaggtgatccccgaggccgatcgacaggaatgggccccgagcaacacttaccgcggcattttccaattttgcttttggcgctttggccgttgggtcgacgtaatcatcgacgaccttttgcccaccaaaaacggacaattgctcttcgcccgttcaaaaacgcccaacgaattttggagcgctcttttggagaaagcttttgccaagtgagcgcagagacaaaacggcacttcagaaaataaacggaaaatgaaacgatttctgctaattatccatttcgaaaatttgatctttttcaaaaggcatttcacaaatttgaaataccctcacaattagagagtttttaagcattcctcctgaaagggctgtttgtttttcttacgccttcttaagattgtacggctgttacgagacgcttgtcggtggccaattagcggacgcactcatcgaactgtcgggaggcgtggcggagacactaaacgtgcgaaagtttttgcacatccataagcaacaaatccaacaacaacagcagccgatgttttccgcgtcgttcaatgcctgcggaataccgtacttggcatgggacttttctcagtctgccagatacgtagcggagtcgaatggcgcc

SEQ ID NO: 30628 - DNA, 1078 bp, Heterodera glycines
aataccagcccttctcaggtggacacatagtagccatcaaagccacatcctccacaccaattctcatatcaattcatgtggtaattttttgattttttataatacatacctactaggctcgacattttgaaagcctggacctgggtttttgaaatttgtttaaaaaaattgttaaaaaatccgataattgcttaggagcatctaaaagtatctaattgacaaatattttttaaatctattgcattatctttttgataacttggaacaataatatggtcattcgaaaataataaattcgaaaatattgtctacattttttaccaaacctggacctggatttcatggacaaaaaaatccaggtctggaaccagctcgaaatctacatgttacataaaataattattttaacaatttgctttctgtttcagattgcgggcggcctacacaaaacacacacacgctgatatgggtaattgcttttcccgcccgcgaaaatcgtcggtcgaccgagtgggcgattcggaccattcatccgtcacttctgtcgggccccagcgctacaacaacaatcgccgtcggggtcggcgccgttcatccgccgacagtccctcgtcggagagtcgcgatttgaatgtggggggcggcgaggacgtatttgtcgctggagggggaggacagcacacaccgcagcagaaattgtctggttcacagctcggctattaccgagttgggggacaaggtgggacattgctttaagattggtaatagatgccggaatttggtgggaagagacttggttccagaccaggcaggatcaaaattttgaaatgaatcgggacaattgcatacataaatttccagaaagaaatttttttcttaaattacaaatatttttggaaaatttttttttaattttcgggcggaaagtgaggtttctacaatataatggtagaagatcccggtattttaaaattgatgggacaatgggcctgaaaacgggacacctgttaaatccggaaatcgcgcggaatagtccgaagttatgatcctgtccgggctcttacaattactgctttca

SEQ ID NO: 30629 - DNA, 1310 bp, Heterodera glycines
aggcgctttaaaaataaatgcgctccctaattaacacttattgtttaatattggactttggagaatgtactcattgtaattttcttcgactgaatttgtctttctttacccatcacttttcacttttggcacgtttcactgtcgagacttttgacagccgaaaagggaaacggacaaacgcattccatccatttgatcacaaaaacaaaattatttaatttgtgcctttctataaactcaaaaaatgaagttgagagtaagcaaatgcatttttataaattttgtagcattttccaaggcaattagcaacaatttaaagaatgtcattgcatgaacgacgttcctttgacaagtgcgtttttgatttttgaaatgaagaaataaaaaagtgggagccgaaggggggaagggaaaattaaaaatgggaaaatatgggaaagtcgtttttgcgccagcccgagttttttgattagaacatttttcattgtcgatcaattctgacaattttggtatcattcgaaagctcttctcaagctttattagccttttaaaaatcacaaaattttctagaagatagaaaagttattaggaaaaaacttaaaacatcgactttttgtaatttttgttggatttggttgacaatgaaaaaaaaacaataaagggagttcaaatgttccaaagtttgttcagaaattcgccgttgcgaagttcgctgcgaaagcattgcgcagcgaacggaaacggaggaaacggcggagggaatcgacagaaatcgccggcggggcgcaaaactgtcagtttttgctcacaaaacgcggagaataaaaaagtggtgtccaatggtaagcgacacaattaattaataaaggtccgtaaaaatatttttgagattaaattttcaaaaatgggcaaataaatgatgttgagggtactgcagtgaaaaattttggaaattttaatgaaatttattaagaaaatctattacaatttccaaaaaattgcccattttccttaaaagatccggtattaataggaatgagtgacgagaaagagcaaattcaatttattaattatccctttagtggccgattgcattgcgttgatgcaggcgggcacagaattggtgagtgatgggagggaaaggagaggacgagggagagatagagaaagaggggaaataatggggagagagatgagatgagagaggaagaaagagagagagataagagaagagaaataatgggaggagagagagagagaggaaaataatggggagagagtgagagaaagataagataagagaaataatg

SEQ ID NO: 30630 - DNA, 810 bp, Heterodera glycines
aacctatcggtttaacccagaacctattggatgggtccgggagtgaacctaaacctattgaagagtttttattgattaataaaaaataaattaaattaaaataaaataaattataaattaaaataaataaattaaaaaaatttttttataatttaaaaaataattgaataaaaaagctaacattcattctctctctatctcttctgtctctctcactatctttcttttctttctctctatcactctctctcttatctctctctctctctcactctctttcttttttctttctctctctctctttttctttctctctctcactctctctcttatctctctctctctcactctctctcttttttctttctctctcttatatctctcttttctctctctctctcttttctttctctctctctctcattctctcttatctcactctctctctcgctctctttcttttttctttctctctcttatatctctcttttctctctctctcttttctttctctctcactctctcttatctctctctcactctctcttttttttctttctctctcttatctctctctctctctcactctctctttttttctttctctctctctctcattctctcgtctctctcactctctcgcttttctcttgctctctaataccacacaaaaatataaataataataataacaaattaattcaaaacataaattttacttaaaatctaattgttaaaataataattagttaaaaattattaaatacatctcaaataaacaaataaaaatttaaaaataaatgaaaaaaa

SEQ ID NO: 30631 - DNA, 1502 bp, Heterodera glycines
ggcggtggtttcggtgttgttggtgatgattcgatctgagaagttaatttagaaatagatgttgtagatacggtagttggtacagtggacttctttgcgacatttggctcctttggtttagctgccagaggtggtggtattttagggatattctgcgccttggtcgatgaagcaggagtcggaatagttgatttagatgctggagtgggtgttggagttggcttcggcacagccgctgttttggacggagaaggcttcggggccgatggagcttgcttaatgggtggaatgggagcgggaggcggggttgttttggcagcagtaatagtagatgtcacacttggcttttggggaggtactgtagcagattttggagctgcctgttttggtgcctttggcgcttcagttggaggatgtgaaggaggagcaagtgttggagccggcggtatcggttgcttagcggcagaaggaggggttgtttctttgactttgtcatcctctttctttgtctcatcgaatctggggggagactgaggctgctgctgctgtgattgttgctcatctgtctcatcatatctcgggggagagggcagtgaagagagatcatcaattgttgatctcttgaggcgcttggcgtgtggaggcgagccgagcactaccggtttatcgaagtacccttcttcatgcgcaagcggcttaagtctaactttttcttgactcttcaatgttgcttgtaaaaaatccctgagttgctcaacttttttgtgcgacgcctgtgggacaggtactctgatgacacgctgtcggtcctcatcaacggaatggagattggtgaaatgaatgtcaatccattggtcatccaatgtaccaattgtagagtgccatgagtagggatagctgatgctatgcagcccacaaacccacgacccactaaaatgtagaggttttggaagacgtaccctatatttgttcggttgattgtcggggtaatctgatacattactcggcaaaaacacaaagaaggctaatcgttccccccccccccccccctgtttcccaaaatttttggaagaagcgcgccgcaaaaagcgttttaaaaaacaaaaaaaaaagtcgtcacttggttttaattgcaaaaatttaatttttttgtgaaaatctgttaataaatcaaaactaaattacaacattttccggcggcgcctattgcccattcaccaaaagttttttggaaaaactcgccgcaaaaaaattgttaaaatctcatttttttgatcccgaatgcactgaaatatacgctttgcttatttcctccccaaaattgttaaaatcaataatgggaggtgaaaatataatatttaatatatttttaatcgaataaattgtaaaaataactgatttgaagcaattttgcgaaatgttcttatttttaaccctaaaatctatttttttggacttgatgttctgattttgaaaaattttcgatggaagccctggtttaa

SEQ ID NO: 30632 - DNA, 1692 bp, Heterodera glycines
tgctgatctttcccctacttagggaaagattcggcaacaaatgcataagttttatctgcattcttaatgggatgtgtgagcgatcaatttctgcactcaatgacctttgtgcgaaattggacatgtttgattcgcagcggcatcactgtggcaaacaaggaagatgcaccttaatttttcacatttcaatgtttttgataaatatttgattaatgtggtttattggttgttttccccaaatattttgccgcatgtacacatcattgcttcatttttgttttcagatgccttcaaaacaagaagttaaaagaaagaaggaacaagagcggtaccaacggcagatggagaaatctgtcagccctggtcgctcacccgtcccagacgggggtgcagatgagaatggggtggcatcgccccggggcttcaacaccccaaatttaagtgctttgcaattaagcaccccggcttcttcaattggaagtaaaagaaggggaagacccccgaaagccggagcggagtcaatcacgccttcgcaaaataatgtgtcttcagttgacacacaatttacatcggccactcaaaatgttgagtcgccgcctagcaaaatatggaaggtcgacgaagttgaccgacccatgtctgctattgaagcaattgcttcaacgcctatttccacgcaaagaagccgtggagggcggccggccaaaaaaagaggcggtccaggcaggagcaaagcaaatgattccatgagcgagcgctcgttaatggaccatagctctgaagctaccacatcagtggcccttttgccaactgtgcctgaaaagataaacttcagcacagtgcaaattaatttcgctacatcgcgaaattttgcctgtaaaatttggaaatgggcagcaatcggcctttacgaacgtgatggcgaaacaccgattgccccaagatctggcccaagatacattgagacctgttggaatgatatgacccagtttctcaatgacggctttgctgccacatacttggcatacttggcaaccatatcacaacgaaaagtggtcgttgttgacccaatggtatggagcaatggcctggacagagtcatgccttacaaaaatatgacatttgggtacgaccctaatgttccggcagaagttatacttttgccagtacatttccctggacattggactctcattgtccatgatgtgcaatttggcactcattttgccgattctttgcctaccacatatggcaggttggatccgcaactgacggataaaattaaaaatatcatttcggatattttgccgtcaacagtgttgaccggtattgttaatgccataaatctgacggtccaacacgatggaaatagctgcgggtactttgtgtgcctgtatgccgaatcctggcttatgaacaatcgcacatttgttctgcctgatttatccatcaattatgaaaaaaagcgcattttatggcacattaacgagctgtatggctctgataatgtgccatatcatccaagggaaggggtgccaactccttgcccaattgtctatcggcatacggatgaagcgcagtcgacatccaaggccgctgagctaatggaagttgatgaacatgatgatataatgatcatcgaaccacagacaagtggacagggcagtgatgccattctcacccaagcccaag

SEQ ID NO: 30633 - DNA, 1024 bp, Heterodera glycines
ccggcctttaatgggcttttgctggcccattcttctcttcagctgggagcttggcattcaagtcggcacggcatgtcctccccttaactaaatgtttaaaattatgttaaatgcattcacgtaaagttaaaatggaccattaatagatttattaaaaatttaactattagcaatgcctaatttagtagtagataagattaaaaaaaagatttattatgaattattctacatgttcttaatttctttcccataccatggcatgcatgccgttgcaggtcacttggtggcagttttgtgaatggataatccgcttaatatgtgtgcttataaaaggttttatttgacggctttatctcccaaaaactaaaaaaagcctttaacaagaccgtccgctgcggcgtacacttaaataaggcgcatacgtttgcagcgctgatatttgcggcgtcaagcggcgcccagtcaaagtgatatttgtggcgccaacgcttgcggcacccctcccaattgttgcgcagaactaaatggcacttagatttaacagctttttctccaaaaataaccaaatattttatgtaaaaatggtacaattcgcttttctaaaattacatgaaatattcacaaaaaaaaatgtgttgtaacaattttcactgttcgtctcagtttttcgatatttttcaaaattttgtgaatgaggggagggggagggggggaccgttggtgccgatatgcgccgccggaaaaaattcagaagatttggctaaatttattaacagatttgccactaataatattttaggtgctatgacgccactcaaaaacaatcaaaataaaaaaaattttgctatacttttttaatacttttcgataactctaatgtaagtgttttctattatccttcaatatttcaaaaagtttcgttaagtttaaagaaagttatgaccaaaaatgttcaggaaaacttgcatttttgagtttcttcggccataacttttttttgaaagttaatgaaatttttttgaaa

SEQ ID NO: 30634 - DNA, 1190 bp, Heterodera glycines
gggaattactttacgccgaaaatgctcactgtctgcgaattcctaagaagataattaaagataaattagataagttttaaatacaagactgggataggccttcttgcacaattcctttaagtccgcgtcatcgaaaaaataaaaagaattgttttggcgaatcattattcatgtaatacattcttcggcctcttccaatgcgttttttttgatcaccataaaattgtcaatttgcttttgatcctaaaataaatttttaaaaatatttgtgattaattaaacctttaccacgtccttttggctcagattttccttgtttttgagttgagaaaattcatgtttatgcttaaactccaaatgcttccacattccttttgtcgacccatcggttcgtgccgttctttttccacatagcttacaaattgctccatcggtcaaatttttgttgaaaaacttccaaatctcagacattttctgttattgataaactaaataagaaaaatttgtcgttttcctaaataatagtaaaagacaaaattagcacaaaaaataagctaggtaaagcttaaatgcgaaatgtaaaagtaaaaaatgtatgaaacataaagaaaacttggcgaaatgttcatcagttcaaatatttaaatcttttttccctttgactccaattttcttcactaatttttcactcagaccccattcttaccagtacttgtttttcccggttcccggttgccctaccgggaccgggacctgagcttttcaaaacccgggaccgggaaccgggaccgggacctcggatgaccgggaattcccggcccggtcccggtcccgtggcactctaccaaaaacttctttagttatttaaactaccaatttgtcgaagaacacaatgtggccaaaatgcacttttaatctattaaaaaaagtgattcgcttaaataatcattaaacaaattattgccaaattaagggagcgattggagcggatgtgtttgcggtggtggttgtagggcaaaatctggatctggtatagttttaagaaaaaaaaggttctagtcggttttatggtcccatgtcatattatgcgtcccatgaatgaccatacacagtttcttaggccataacttttttcttacttggtcaataaggaattcttggtattaaacaaaagcttaaggtctatagaa

SEQ ID NO: 30635 - DNA, 1366 bp, Heterodera glycines
  misc_feature (1340)..(1340): n is a, c, g, or t
aattttacgattttgcacctagaaatttttttttgatttccggctatattttgaaaagaaaaaaaatttaatttaaaagaaatgatcaatttattatttctaaaaaatgtttcattttcttccaattttccaaaaatattttcctctcaaccccctaaaatttagtgtttcgtgccaaaatccgaaactatatatttaaaaaatagaacagtaaattattcttttttatccatttatttgttttttggagcggggggcagtaaatgttttcgggttcaattctctattctaaagacgaatttaatttctcggtttatttttgaggccatggcctcagctttcggtcaagtctcggaaaatttcaacattcaagccgcatgatgcttttcaactttccgtattttaaagagaaaaatcacaaatcaaatcatatgatgaaaattataggataatgagaatagccttttgtagttttgacgctagattcttggttttcccgccgtctgcactcctgcacgaaacaacaaaataaattttgcggttttttagccaaatttcgcctattttacgagatctggatgcattcacaaggcacatttggggtaattaggcaatagctgaccgaatcagaaactctttgaatggcgcctgaaatctgtctgctaaaaacgaattttatccgggaaacaggggaaaaggcaaaatagtctaattggcatgccattcccattgatttttacaggttcagaaaaattggtatttaatttacccttactttgcctattccaaatcaaatttttcagttaaattccttatatagcggctttttattaaaaaaatttcatcattgtttatttttttgatggaaaaaaatttttaaattttaatttcactctctaatcatcccttcttaattgtttgaccaatatgttctaatttccagaattccattaatattcttaattttaatatcgaaaattggtaatttttgtacaaacatacgccaaaaattttccgttttcgtttttattttatctccaaaataaaaatttcaaaaaacaaacaaatatttttcgtttaaaactattaaatcattaatttcttgttatattcaacattttatgggagtctgagcacaagagatcgaacttccttctgtggcagctatcaaaaatacattccattttatttatagaaaccaaaatatttgtaaaaataaataattgacgagcgaacggtgccgaaaaacgccgccgagtcaaaatttgaatttcaaagtgatttgttaacaaattttggaccagaaacaaaattctagtcatttttgagtgaaaacccanaaaaaaaaaaacaccaaaatcctaat

SEQ ID NO: 30636 - DNA, 1376 bp, Heterodera glycines
  misc_feature (113)..(113): n is a, c, g, or t
  misc_feature (142)..(142): n is a, c, g, or t
ttgagcatataaaccttacttttttttgaagacttttcttcctttttatttttctatgctttttttcaacataaaatttaaataaagtgcaaaaaaaaattttttaataattngaaaaaataatttgttttactttttgttntaaaaaaatcatggctcaaacgagaactgatcaaaatttctcctgatcagtgctcacccaccattgctcccccgcgccaacttacatgatcaattttttaactttgcttctcattcctcccatatctttgctactcttaattctgagttttcgcttttccttcagctttatccctttgtttgttgttttgtgtccattttgtgaaacatgtcttaattcagttttttcaatttaaaaatataattttaattgctgtttttcttgaaattgagccccctcaccaggggctttaaagacataatttaattgccgtttttcttgaaattgagcccccgccccaggggctttatatttcaacccctttcaaaaagtgggcttttcaggctaattcagcagggggggggggaggggggaaggtttttcaataaatgcaataacttacattttatgttgacctcccccttttccatgtcgattattttttcggttgtttctaaatcaaattataagtttttaattttaattttctttttaacaatttgttttctcactttttctgctgatgtgctgcttctggtgcttctgctactgattgatgctgatttactaaatttgaaatttaaaaaaattcaaaaaaatatattccgccatttttgccattacctccaagtgaattggtgccaatgtcaaatttgttgttaatcggatggttgttcatcgccatttgttgcatgatgcttggattttgcacaaattgtgacgacggtattccattggcggtcgaaagagcgtttgacattccgtcggaaactaaaaattgaaaatttaaattaaataggatctatactagagcccggaaatttcaaatttgcggatcctgttgcaggattagaattcaaaaatttttgcaggaccggcccggccggattaatcctgcaaatcctgcatttaaaatttgcaggatcccgcgcaggattgcggatttttggaaattttgaaaaaattttaattaaatttcaaaaaatttccaaataagaaaaaatacctgatattttgaaaaagaaatttttaggggctggcgggatgcaataaaagggcgtctaagatttttcgaatgggtcagagggtaaaaagagatcgggaatcaaatctgttaatggtccataaatttgactattttttgcttttcaaaaatgcttttttttcggcgaaattttttcataaactaggaaca

SEQ ID NO: 30637 - DNA, 983 bp, Heterodera glycines
aattgtcgtgctcgcggatcagtgtttgatgccggcaaaagcacctcaaacaaacaaattaattaattaaataaattaaatataattttaaaaataatatttaaaattaaataattcaatataaaaaataaattattatttttttgataagagtatagaagtttctttgcaattaacacattttagatgattattaagaaaaagaaaagaaacattctaaaaaatcattactaataaataaatatttactttttaaatttaaaataattaaattttactgtttattttctgaaaatatttaattttgttttggacataaaaaataaaattaggaattcttttttttaataataataatgtttcgaattttataaatttttattaaatttactggataaaaaaacgaaatttctttttaattaaatttaaaaataagaaaataaataaaatttgtttattaaatcgctttaataaaagtaaatttttatatagaaatgatagaaaatgtgtgattgtgtgatgatgacctgctcgaagatgacgagtaagtcatggtccaaaatttgttgcagacactcctcaaaaatggacaaaacgcgtgccaatccgcacgcgcggaaagcggcttccaaataggcgaaaaagcacagcgtttcactcttcaacgcctccacattgccttttaattggttaattaattaattaataattaaataaataaattttaattttatttattattagtgctaaaaattttttgtaagaaaaatcgctgaatttgtaaataaaaatacaattaaattttatggcaaaaatctaattggaaataaaaaattttaaattatgattttttggaaaaaaaatcttaaaaaagcgtcaatgagcataaaatgccatgacaaagaacctatttattcttaaaataatgttttagcttctaaaaaattgtttaatccggaaatatataaaattttcataaaatc

SEQ ID NO: 30638 - DNA, 1391 bp, Heterodera glycines
aaaaatgccaaatatggatggaaattggacataaatcgcgaaatatggaaaaatatggatatagaaatccgtcatagaagcctcaaaccaagctaaaaacatgtttttcgtgcgttcaggccctcgaggccgattcgtttttattatcccgattcgttttttttgtttaaaaacttcattttcaatgaaaatttttatgtattacacgctaccgcttaataaaacaagactcagcgctaatgaattgcagtctaaatgattctgacccaattttcatgtattttaataacaatgtaaaatttaagcatcttcaaatataaaagttaaataaaaatataaaaattcatatgaattaattcatgatatccacttctccatcctctgaattaacatcatgcgagttttcatcttgcacttcattcaaacccatttcttcaaagtattgatcaacaagcagcccattttcatccaaactttgttcaagcaaaagctttgcatcttcttcaattatcatttcttcagcttcattacggtttgacggcggattgaagccaaccaaatgtccaattcttccataataattagacatggcttcaacaaattcatcattgccgtaatccgtgttcaaagaagccaaaatgtccgccttcgctgaggcaattcctctgtccaattcaagagttaattcaagcgggcgagctggcaattgtcttccttcatcaacggccactgcggtttcttcttcagcatgacttagttcctatcatttacgatacaaaagttagagacaaacaagtacctgaaaactcgctatccaccggccgagcaagaaaccaggctggtaaaagcgttgctgtcgtccgtggtaagactcagcatggttgatggttcgatgccgaacaacgtcaaaaagtgcaaaaaagtgcagccctattctgttgttgatccatgtgttgttctgtatatttggtgttgtctaagtagttttacatttatttacgcagtaatcgagaagttcactcaatgcgccctgttgtaaagtttccaatggagagtgtgtgatgagatggcgcatgagttgaagcgaacgggctaaatagttgggaggacagaattgtagagccccaattttgcgaacaaggcgctgaaactgaagtccatttggttcttttgagctgtacatttgcataaatcccattgattgaggtcggcgatttatcgcttgcttcacatgaaacgcgcacatttttggtctgacagttggaaaacatcgcaaaatgcattccctgacgcagattcgtagtcaaaatttgcttgggaaacctgggagcaaatcaagcagtttattaaacgggaattaacattaaaaggccgggaattttgtccaattc

SEQ ID NO: 30639 - DNA, 1240 bp, Heterodera glycines
gcacaaaaacttctggaattagaaattggcgtccaaatcttcatagggaaaacaaaaactgaatctaattcagaattcggccacagtgcaatggcacaataaaacggagacattggaattggaagcggaggaggggggagagggggaggacagcgacgaggaaatgtgaggagaaaatgggcaaaaaatacaaaagcattgctttcacttaagcatcgcccagcacagcgcacttgtgcccctgcgcaagtccaagtcggcttttgccgactttctccgtccgtcccaaattggcaattccaaacaatcggccgccttcgcctgcccaataatcattaagaaattgggccccgaaaaagaggacgaacagcaacaaaaggagcatagcgaagggatcgaagaactgatcgatttggcccgtggcgatgtcctccgttttcgaatgtcccatcacttgaaaagctgcgcctcgccaagtcgaagctgctgctcctcctccgcttcttcgctgtctttggacggacgcacaatcagtcgatggtcggcacccgcggcaaactcagagaaagagacggagacggacgatgaaatgtgcgagtgggaggaaggagaagcggaagcggaggaagaaggtgcggatgaaaaggaaataatattgaaaaagggaaattcaggacgaaaaagatcgagttttgggatgtacggaaaaaggagcggtggaagttggtcagcaccaagcggactaagcaaagggagaggaggaaatggaggacaaaaaagggaaaggaggaagagagaggcggagagggaagaaggaaatgagagaaaggagaaaaaggaaaaacggagggaaaaagagaaatggaagaatgagaagaaaaaggaagaggaggaagaagcacagagaaacaggaaaagggaggaagaagagaaatggaaggaagaggagaacagagaagtgactgaggaaaagcataaagaaccaagggaagaggaagaggagaaagaagaagatgaacagggacaatccgacggagaagcggaagagaacgcaagcgaatgggacaaaattggaggacaacaccaaaacatgaagcatttggaaatcgatgcgaatggatggcatttgcatggaaaagcggacggagcggaggaaatgatgtcgacatcgacggatgaagaagaatataacgacgacgaagagaatgaaaaaaggattggtaagaagaaaggatgatca

SEQ ID NO: 30640 - DNA, 1301 bp, Heterodera glycines
ccccgctgaatttttcgtcccttttccctgcagccatctgttcttcctcaacagttccttgttctgtcggatgagtcgttcgatgctctctctgagtgtgtccacttcttcgcaatacgtccccacgtccctttgcaattctttgattcgttccttttggctttgtgtcatttttcgcagttccaccaacgcttggatttgctcgtccgccgcgctttggtggcagcccattgggtcggagcaatcgccgcaaattgcacttggcgaggtcgagatttgctcatgcattcttttgttttccgccttcaacttttgtacctaaaaaagttataaaaataatgggaaactcttttaaaacgctttttactcatggcaacaccgaactgaaatcacacccattttgattaaaggaacataaaatctcaaaaattgtcattttttgatgaatctgttaataaaatagggcaagaattttcagaatttccaaggcggcacctctggacccaaaacattgctttaaagataggctaaaaattttgtaaatttttagacaaattctatttaatttgatggcgctgaatttgggtaatattttagatttgaggggggtgaaaaaccaaaaagcgataggaagaatttatttttctgaaaatgtaaatttaattttggatttcttttatttgttcaggctttctctatataaaaaagcgaaacttacaattttgcacaattcgtcaatttcttgcttgtaattctcctccaaatccatgaaatccttaaacaaaattggaaaatgttttcccattttctccccactttctccaaattgtctttgtcccgaagtcgttgctgcttttcctgttcaaaccgttcaatggtcttctgcaggtccaccaattcggaactttccttgtcattgtatttggccagagcttccaaagtttcaagcgcagaaattacctatggaaaagagaatttttacaaaataaaaagaccaaattaatttcgaacctttctcacgaccgaatcaaacggttcgtttccaaactgttccaccagtttttcaaagtcgcggtttatcgactcggccaagtcgtacacatcgatcacagtgatttgcttggatggactgctcgcgtagtaaacggggctttccattgcttattatttatttttggaatatttttgttatggccaggaaaatagtcgatcaaattgttgccttatttcatttgaatctaaaatttccaatagcttggtatccaatttgtgatgactaattgccagtcaatgatagatga

SEQ ID NO: 30641 - DNA, 1269 bp, Heterodera glycines
cccagtgtttggaatgccagagatttgagtcccagagattgaaattctggtgagttgagtcccagcgattggaaagcctgagaattgagtctcagagattgaaatgctggtggattgagtcccagagattggaatgtcattgaaagttggtgggttgagtcccattgtttggaatgccggagattttagtcccagagattggaatgccggagaattgagtcccagtattggaatgctggtggcctgattttcagtgattggaatgtcattgaaagttgttgggctgagtcccaatgtttagaatgccgcagatttgagtcccagtgtttggaatgccggagatttgagtcccagtgtttggaatgccagagatttgagttccagtgattggaaagcctgagaattgagtcccagagattgaaatgctggtgggttgagtcccagtgtctggaatgccggagatttgagtcaccgagattgaaatgctggtgggttgagtcccagagattgaaatgctggtgggttgagtcccagagattggaatgccaatgaaagttggtgggttgagtcccattgtttggaatgccggagatttgagtcccagagattgaaatgctggtgtgttgagtcccagagattgaaatgctggtgggttgtctcagagattgaaatgctggtgggttgagtcccagagattgcaatgccatttaaagttggtgggttgagtcccagtgtctggaatgccggagatttgagtcccagacattgaaatgctggtgggttgagtcccagcgattggaaagcctaagaattgagtctcagagattgaaatgctggtgggttgagtcccagagattggaatgccattgaaagttggtgggttgagtcccagtgtctggaatgccggagatttgagtcccagacattgaaatgctggtgggttgagtcccagcgattggaaagcctaagaattgagtctcagagattgaaatgctggtgggttgagtcccagagattggaatgccattgaaagttggtgggttgagtcccagtgtctggaatgccggagatttgagtcccagagattgaaatgctggtgtgttgagtcccagagattgaaatgctggtgggttgagtcccagagattggaatgccattgaaagttggtgggttaagtcccagtgtttggaatgtcagagatttgagtcccagagattgaaatgctggtgagttgagtcccagagattggaaagcctgatgattgagtct

SEQ ID NO: 30642 - DNA, 757 bp, Heterodera glycines
agaaaatgtaacctttgccattggtgcgttttgaaacagtcccaaacgacttgaatcttcgcactttccttttttgctgttgattctggacccccaactgtttttcgagacgcaccacgccgattcgatggccgcagattcttcaaaggaggttaaaaaaaaaaaaccctggcattttctctcgcatccaacaaaagccggactagaagcaacacggtccagtacttcctttctacaagaacttcctctttctcttcttcttcagaatccccactgcaattcacttcacggtcgtacccacgcagaagtatgtttccaatttcttcgcgcaaagaagacggaattgatgaaaacaggtttttgtggcgtcgagcaaaagagtcgccaaaacaacgtagcccacgaaaaaaatgtaaggagacatttgttattttcattttacctagaaaatattatacaacaacttttactgaaaacaatataaattataagtaaacaatttttataagcaatgtgtatttattaaataaaagattaaagagaattgaataaaagtaaaaatttaaagctttcctaaagctataacaatataaatatgaaaaagataaatttcggaatgaagctataaacattatgccaaacgagcggtaaatcaaatatatttaaaaaataaaatttaaaattttacttgataaaggaaacttaaaacattacgccaaacgagcgttaaattaaatatattattttatatataatt

SEQ ID NO: 30643 - DNA, 917 bp, Heterodera glycines
atttcgcgccaaaaagcgaaatgcgaaaagcaaaatgcgaaacgccaaaaaatgcgaataatgcgaaaggcgaaatgcgaaacctcggcccatccctgttatgtacgacatattatatgattaataattacgaagttggcgaccgaaaagacggcgcacaaactcaaacaaatacgttccttggaagcccgggcttgttggtaagtatactcaggaatacccaaaacagcaattttcacttaaacaattaagctaatccctggcacacctatatgcacccaataaataaaattacggtagttcggctgtttgcatttctcgctgaacagcggacaactaaaaacttgactgttttttttttacattcattttccaagcagtttgtacaatggagtttgtacaaaaaagtagagtgccacgggaccgggaccgggccgggaattcccggtcatccgaggtcccggtcccggttcccggtcccgggttttgaaaagctcaggtcccggtcccggtcccggtagggcaaccgggaaccgggaaaaacaagcactggtaagaatgggggggtctgagtgaaaaattagtgaagaaaattggagtcaaagggaaaaataaaaaatttcggctgtttgcatttctcgctgaacagcggacaactaaaaacttgactgtttttttgtttttacattcattttccaagcagtttgtacaatggagtttgtacaaaaaagtcatgaaaacatgtttccaagagtttcggggtcaccagtgatcacgaatccggcttctattttgattagttccgaaccccgggcgtgattttgaaacaaaagtcgaaaattcaattttttctgaattttggttcaaactcttaaatacacggaaacaaaataaagtcattaatagggtgaggattt

SEQ ID NO: 30644 - DNA, 1152 bp, Heterodera glycines
  misc_feature (63)..(63): n is a, c, g, or t
  misc_feature (96)..(96): n is a, c, g, or t
  misc_feature (1139)..(1139): n is a, c, g, or t
aaaaaatattacgcaagaaattatttttacatcctttttagaaatgctgcataaatttttatngtaaatagtcacaaacaaactttttttcactcncaatatctaccagttatcatacaaaaaaggcaatagttaagcactgagatataaaaaaatcgtctagaataattatctaaacaatttgtcgggaaagctgtataaattctgggaaaaaacttttcaagaaaagctgaaaaattttcaatcgcatcagaagcagcctcaaattcttcaacaacataatgtaaaaaatattacgcaagaaattatttttagatcctttttagaaatgctgcataaatttttattgtaaatagtcacaaaaaaacttttttttactcccaatatctaccagttatcatacaaaaaggcaatagttaagctttgagatataaaaaaatcgtctagaataattatctcaacaatttgtcgggaaagttgaataaatttcagttgcaataggcatattggcataatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccatttttttatgggccagcataataaagtaaacccaaaatgtaagtgaatttaaattggtcatgtgagatgtttagttttttatttgacccatccgttttctgggaaaaaacttttcgagccccccccctctggcgatgttctttctaaattgtttgttcaattcacttgtccaaacatgagatgttatcagcccaatttggaactcattatgcattcccaaaccatcacttttagcggattagccaaaccaaagtcccaaacgacgccctttctttctttctttctttctttctttctttcgcttctttatttgcaaattccgtccgtctctctacggcttattcacccccaagacattttcattgccaganttattatagtcct

SEQ ID NO: 30645 - DNA, 1826 bp, Heterodera glycines
tttttaattaataaatattcttttgattgtttactcagttattcattagacaaaaaatacacaaaaaaatataataacttaatttaatttaaattaaaaaatttaaataattgaaaaaacactcacagaatgaaaatttgaacattttaagaaaataccttatatattttgttttggttagttcaattttaacgcttctttaatacatacatagttttaccattcttttgagtttatttaaggattattttatataaaatcctaaatcaagttaaaatattattttttaataacgaaatgaaaaaagataaaaataaatataagtatttcaaaaattttgaatttcaaatacaaaaattgattacccaatgaatttagaaaatattaaaaatcacaaaaatttaaaatgttattaaaaaatctgtataatataaaaatcattcaaatcaattttcctggacctgatggcccttgctgaactcctggataaatttgacgtggtcgttgtagcggatcggcaacatttggcacggcatggagcactggcgttggcggttcctaacacaacaaattttgatatttatatataaaattatcaaattttattttgtttatatgctagggtattagaatttcttaaaaatggctggtcctaagtcacacaaaagcctcgatccaagaatttatgccaaaaatttaatgccataaatttgttggtatccttacaaatgtttcatgctgattattattattgttgttgccattgccattgccattgaattgtccattaaaattgttgttattgttctgctgttgttgttgtggttgcaagttgtattggccaaaatattgttgcggctgttggggctgaatcggtgtgccaaactgtgccgcatttggcgatgggactggcgttatgccgccattgcctccaccgtcgctgccaccgttgatgggtggcgcaaatgtgaacccattttgtgcttgttggggttgaaattgttgagcctgtagaataatgaaaaaaattattacttaaaagtggacggaacggggcccttcgggattttaacgggataatccggctcgattttatgtgggaaaaaacagggatcggtagccatggtaaaaccgtaccaggtattttcgacagggattggattcgacagtagttgatttcgacagtacttttaaattaatttctacatatatgcattattgtacatatgtatgaattaatattaatatacaacttgaataataaattccgaattaaataaaataataaataagacttgtatgattcttttgtcaaaagatttttcgattttaattcatctatacaaatattcctgctggactgtagtcaaaaaaacacaacaaatttcttagataaggttctcgaattgtgtgcgaaaatctgctaaaaatgccgcgtttgagtgccaagatgtaaatctgcatgctcctttatcagaattcgaaaatcgcaaaccattctggcaatgtataggaaccattgcttatcattttaaatttcaacatttcgatacttataccatatagaagaagttttttttaaaaaaagctttactgtcgaaatcaacactgtcgaaaactaatagcaccggtaaaacaatgtttttatccccgacatcctaaaaaaaattaagactttacccaacaattaaatatagcgtaaaatttgtcaatttctgaaggagtgacacaagcgacggtacacaaattgttggagtttttaaatagatttatacataaaaatcaggtgttttttttaatttacacactttaattggaatatgcgt

SEQ ID NO: 30646 - DNA, 1992 bp, Heterodera glycines
atgaatggtaagcaaaatatatatcaaacgatttctcacggcatgcaaaataataatacgaaaggatttttggacaaaaacggaattgaaaaacttatgagtcccctcaaaaaactccgaaaatgacttagataaaaaaaaactaggtacgctaaaagcaaaaagcctataaaatcacgaaaacaagttggataaaaactaaacctgtttgtaaaccggttaagcccgaagaaaattttcaaaactaccaacaatacaataatttaaattttagttcggcgcataaactttttccggtactgtttattttgctgcccattcatacgtttttacctattggacagttcatttcagtcccaaaggtatttcgttttttcagtccagagtgtttaattttcggggatagtttgccgcaaaaatctttcggattaaccgagtggagtcaattgatattaaatataaatagatattttcagctctaggctatatgatcgtcacctatttctataaatttgaaaaattcttaatttattcacctcccctgaaatagtttagcggaatgtcttatgccaacaaattaattaattaatttttttgtacaaatattgtttacaaatcaacattacaaataataaatcagaacaagatcaaatttttatcaatcacatctagtctaatttttgaaaaacatcaatttcttccatcctttctaatcaattttttccatcacttccttataccacttccaaatgccatacaaaaaatatagtgagtaaatgcatccaagatagcaagcaagcattactattttcggactttcggtcttcgtgccaattgcaaacagcgctaaaatcagtcctaatttgacgagttttgatggaattccacgtctgtgtcggcgctgtgccaaaacaggggcatttgtattaattaaataatcagaaagcgccaaactttctttggcattttcatgcttgatggaattttcactgttcaccaaactcaggctggtgagcagaagttggaagaaatcacttggcaacggtaaatgggttttcaatgctttcaattgtttgatgggcatttgatccggcatttctttggctaattccatcatttcggtgccaaaattatcaaggggtgccgctttttgtggaaaatttgttgaatttgttagttgctgaattttctgctctaacatggccaattgtgccaaaatttttgggccaagtgtctctgtcattcgaatcagttgggcatttgtcacttccttttgtttacaaatttgcaaaacaatttggccaaactttttcatttcctcagagtattcatcaattttgtcattttgtaaatatttgtccaaactttgaattgtttcgcattctttttccaccgcccaattggccaactcgctgaaaagtgatcgattttggttaatacagaacagatgatttatttaatcttggtgttcttttagaggatgaaagtgttattttttgtgaaaaagtggatttacaataaatttcaatgcttctaacattgaaattaactttggcatacttttttttcttgttgggaaatttaccctggactagttttaaatttatagagtaccaattgttaaaatatttactgccaaaatttttacccataaaaaatattttttaataatatgatcaagtttcttataattagcccatttaatttttgagatgataattattattgtcaagctctccttgtggtcaaacactaatttaagtaaattatcattttaaaatggttatatttttatacttgtaaaaaatatttttatatttctgacttaattttataagaaacataaattttaaaaaagtagaaatcagttggcatgcgaatgacttgaacctctaatctataaacattaatgaaggcactaccgatagaccagtgatcacagtgcctgtgggagaataattggtttatttatttatctcactaaatagtgga

SEQ ID NO: 30647 - DNA, 1299 bp, Heterodera glycines
  misc_feature (10)..(10): n is a, c, g, or t
ttacatatantttttgaattttatatccaaattaaaaaagaaaaaggaatttgatggcaaagattgaaaagtttttccgaatttgctttttattttgttccaatttcaaaatgggccgaagaaggcgaagaagcctttgctaattacgtcaattgtctatttggaaaagaactttttgggaacaaaattggatgagagataatctttaaccattggggggaatttaaacaaaaaaattacaaaaatatttaaataaaaagaaataaaagaccaaagaaaagcataaattttctataatattctgcagaaaatatgcgaactgagcgctaatacaaattggcactgaaattgatactgcggcggggattggccaagtccaatccaatttagggccataatcctttcactgggcaagagattaatgagaaaccaaagaatggcatcagaattaatcatttaggcgcaaaaatggccaaaattggtcgaaccgtggagaaaggatgacggaagaagcgaagaagatgaaggaggaaatgtgttgacgaaatgggagtaactgaggaagagagggacaaagcaaaggggggggggtagagagagagagagagaggggaaaagaggaggggagagtatagcatatttaataatattttttgccagcttatatactaggaaaaagagtataagtcatgtatgatgcgttggcaaacaggatgtttgccatttggcagacaggaagttgccaatttgtctatttacatttgttaattttttgacgattgatttttctctgttttggtttttttgatgacttttcatttgaatgaataaaatgctatttgagatggtagaaatttaaaaaaacgtgtgtttaaaaacaattatttatttatttttatgatttttattgaaaaatagccgatcgtaaaaaaaattggccctggcgcaccccccccctgcgccgatcgtacatcgtatggggtcggccctggcgcaccccttgtacatgtatgaaatgaattaattgctcaaagggggaggggacaaaagaaaacatataccaattagcaaaaaggttttgtttgtttgtttttttgctgttgtgatgccaaaaatgagttggttgacagtgtgtaataagaaaagcctagacggaggaggggggggggggggggggaaagaaggcaattggtagaagaagccgggggcaccaaaaatgggggggggggggggagcaaagcgaaaaatggtgccgtaccccccttttgccccgggggaaatgctttggctttctctccc

SEQ ID NO: 30648 - DNA, 1700 bp, Heterodera glycines
tgggacgtggagagagaaacagagaggggggagaccgttgaaagaaacaaggcgaaaataggagagagaggagagagccacagaaagagagagaggcggtaagagagaaagaggagcaaataaagggagaaagagagatagagaacgagagggaaagaaagagggcaaaagagagagagggacggtgagagagagaaaggagtcgagagaatgaagggaaaagaaaaagaaagcgttatgcgcaaaaaccaaaagttaatgggccaaaggcaacacagcgatcgcgctccctattttaatgagttttcctaatttgagaattttatatcaatttgtcataaattataggaacccccccccgcggggtggtcgacggaaaggagaagagagagaaggacaaatgcatcaattagtgttaattaaactaaaaaaagatgtccgaccagaagagacccagtgacaaagaactaagtggcggcgcgcggtgcacacacaaagatagtcccccaccagatgtttaaccgttaaatggtttagcgactaattagttgatgacattagccattgggaaatttcgatgccacccaaaaatcggcattttgaaaaaattttattggccttaggcaatcaattctaaatattattatgctttgtgtcggtgtttgttggcacccgccaattttggcacactcccaaaacgaaagcatcattaacggcgcaagggaagaaaaagcgcattaatgatgcgcaaccccgtactaattgggctataaatttataattaggcaccaaagtgttcattttgctaacaaatggccgtgtcggcgtcgaaaataaatgttttgtgctgctcttcggcggcgggtcaccacccatatttttgtcgttgcttttgatgttttgttgttgaatgttttgtggtgcttcgtctgctgttggcgaatggaaatgaatcattcgcataatttcgtatgttttttccggaaaatcaattcgaaaatcaaaaaataaaatctgttttattgtatgtgtaaattgatggagaaaagaaaagtggaaaatttgaaaagccataattaaaggaaaatgaaatttttaataaaatttatttggcaaaataaatggcataatgttcgtaaattgttttgacacttaaaacatctaagagatgataaggactgccaaatatttgaacaatttcaaagttttgtccctattaaaggcaaagatacctaatttttaaataaagcaattttcaattccaaatctcataaatttgaaaaaaagacttggaagccctttgaatgttgggcggatttgatacagtacgcaatgtgtatggtaatgtacaatttaaaaaataacatttaataatcgagaaaagcaatgaataaaaaatgaaaaaatacccttatttgttaaggaaaaataacaatttttttggggggggagagattgaccaatcggtggaagggtgatcaatgacaataacactactgtctgatcacagaatgataggcatgaacggaaatgaataaatcacgaatcattcggatgaaaggcgacggttcgccaacgccgccgcgcaaatgcccccgggcgttgtcagccgaatggtgagaatgaagaacagtgttggcaccgggagaagcccacctgtgcaaaaaataatggggaatttctaaaatgaatagttccca

SEQ ID NO: 30649 - DNA, 1096 bp, Heterodera glycines
ccgcggcggattgagttcgcgcatcaatcacatataacacagcgaacaacagaaggcaaagttgacgtagaagaagcattttaaggctgtattttccgataaaattatttttgataatacgaaaacacagaaaaagcctcagtgatacagtatttcagcgaaaagtactgtagcattatgtaatgtcgacaaaaggccaaaattgtataagtgacctcacgctcagaactttcaagaaaattttgagaaattaccgaaaaattttgattccctgacattttttctactgacacattacattttccgattacgggaagtaagtagatttttagattattaaatccagttttaaaaaaaaaaaagatgaaaaatgtgttatacaatatttaggtaagtgagcaaaactaaaaaccaccaaaaaacttgtttttcgtgcgtttcaggtcacagggagctcaagaaaaaaataggtaataacataaaaattggagccctatttattactattatcattattattttatttaatatacagaaataataaaaaattaaaatgattaagtttttcttatcactcactcaatttttgtcccgcttttatgtgctctttccctattatttgttccgtgtgccaaacattctgtcctttgtatttatttgtagggaattcatagtttttgtttttctgttttatttttctcgttttatgatatgaagctgtgcattagtgataactgataaacaatttattacaatctgaaataaaaaataaattataaaataaaaagaaaaagaaagaaataataattattaaataaataaaattataaaataaaagaaagaaagacttttaataaagtaattaataatcagaaaaattagcgattgctaattgatcgtttaaaaacggaggagagctagtttatcgactttttttttggagtggtcgcagagcgaaaaaaccaatcaaaccggaaaaccggtgaaaccggacttttcgaaaaatcaccagttccggtttccgggccggcccggtaaaaacctgtaccgggcccggcccggtccggtctctactattttctaggtttttattttt

SEQ ID NO: 30650 - DNA, 975 bp, Heterodera glycines
  misc_feature (9)..(9): n is a, c, g, or t
  misc_feature (917)..(917): n is a, c, g, or t
  misc_feature (924)..(924): n is a, c, g, or t
  misc_feature (951)..(952): n is a, c, g, or t
tgttaatanagcgagattaaaccaataaaaggaaggctttattaggtaattaattaatcattgtgttatcagataattgttttccatttcttgtcttggcctgtgaaactctttgttgaacttttttctgtgtcatttttgcatcttaaatattttatatgttatctgattttatattttctgcacaattccacacttttttcatacattttgagagaagttacaacttttggaaatgaaacaaatcggacccttaaaaagctcatttaccacaaaaatccataaatacctaattgatttcggtgagtcacaccaaaaaattccattcaatttattaaggggtccggccatgtaaatcaaggcctttttttgctttttgaaaccgcttttttgcggcgcgcattttcaacaaaaaaaaaaagatttagctgcggtgtcgatagacgctgccgcgattttttaatttttaatgcaatttgttagtaaattttgtccaaaaatgacctgtttttgcgaatttgagccaattttttttatagaaataaggtttttaggggccggcagtataaataggcgccgcagctgaaaaaattgagtacaccctttctatttggtttattattaagcaggaattggcatgcttttggatccattttgagaatgtgtttaacacgactaaacaccacacacacctcgtggtcattgaactgtgccgcccattggtgcccatttttattgtgcccgatgttccgggctgttcctcttggtcttcttctgctgctgctgttatttgtcttggctcaaaacgaatctctccacctctgcttgtcggtggtctctgctggagaatttaaatttaaatgtgttaaaaattttcatagcctatggccgtgagattattttgcccgaatttaacnaattttnaatgaattcatgttctacaaattactnnttattttatgagtccaattaatt

SEQ ID NO: 30651 - DNA, 2027 bp, Heterodera glycines
  misc_feature (101)..(101): n is a, c, g, or t
gaaacaatgcagcatcagccagtggacccccagcaggccagagaaaagagagcaccagcccaacttcatcgcttcctgagtcgcgtgccttgaatgcatgnagagcggaaattggcggagggcaacagcgggctgccgattttgtggtccacatcgaactgtcgctttttgtcagcgaccctttgaggacactcgtgtggacaaacgtgttgtggcggacaacccactgcaggcgtttgtggattggctcatcttccaactaccagccaaatacgacacatacgcctactcacactttggcggacggttcgacatggttctggtctttcgcgagctattccggatcgggttcaacccggaaatgctgagacgggtactcaattaagatttttttttctaaaaaatattttaaaaatgtcagggcaacaaaatgtatgagatgaaggtacgcaagcagaagaggcgcaacccgaacatcgtcttccgtgactcattcaatttgatgccgtgtgcgctggcggcactcatcccctcctacggtctggacgtcgaggacaagcccttcttcccccatttggccaaccgacccgagaactacggccgtgagattcacccgacgcccgaagactacttggctagtggaatgatgcccagcaaaagacagaaatttgacgagtgttacgccgcgcatcgccatgagccctttaaattggatgaggcgttagcgaggtactgcaaaaatattttgctgtaacaataattttgttctcgattttcagttattgcaccaacgatgtggaaatattgatggcagctctggtcgcctttcgccgggaattcttcgaaattacacggcgccaagactacgttgatggtattgataacaaggagaaccacgacgggattgatgtgctgcgtgagtgcatgaccatcgcgggggcatgcatgcggcacttccgcaccaaccacctgcccgacgagcacttggccattgtgcccgagcgcggctatgacaacgcgcagaaccaaagcctgctcgccttacgcttcttccactggtacgccaaggagcatggagtgcaagtgcagacagcccacgcggctggaggagagaaacgcattgggccctactccttggatgggtggattgaggcggaacgacgcgcaattgaagtcaatggtaattgagttaattatttttcatcattattataaaatgggcaattttaaggctgcacgtggcacgggtgcaaaaggtgttaccccaacgacaacatgctgctccccaatgggaagactgcgggacaagtgcgcgaacgggatgccaagcggatggaatttctgagagagatgtcaaccgaatggacgtctactgggaatgcgaaatccatcgatgctggagaggagcaaagaaatgcgcaaggcatttgacgactacgtcgatgatggcccgctggtgatccgcgacgcgtttatgggagggcgaactggaccactgaagctgctgcgcaaggctggaccgggagagaaaatctcctattatgacttcacatcgctctacccgtacataaagtgagcacagttaaagttgtaacaaattaacattgtttccttcacagcttcacaacccgttaccctatcggacagccaaacgtgcatgtgttgaaccaggaagtggattggcgcagtgcagcggacaacccctaccctttggcactgctcaaagtgtgggttgtgccgccccgacgcgtcgacgtccccgttctgccagtgaaagttggagagcggctttgcttccccctgtgcatcacttgcgccaaagagcacccgacaggaggagtggacaacgactaccactgcgagcacaatgacagacagcgggggtgggtgagcacgtgcacctccattgagctcaacgaggcgttggacgagggttacctcgtcacaaaggtcttccgcgtgttggagtatgagcaaagtgacgacaagatatgcgcccgtacatcgctgaatttatgcccagaaga

SEQ ID NO: 30652 - DNA, 1322 bp, Heterodera glycines
  misc_feature (1306)..(1306): n is a, c, g, or t
  misc_feature (1308)..(1308): n is a, c, g, or t
tttccgaattcgtttggctttttccgtgcgtcgggtgccgcgactgtgaatttcacttgaccttccgttggcccatcgacgcgtacttttcgaatttgtccctctgtcagatcgaacgtttttcgcaaataatcgcgcagcgaacttagcgaaagtgcgcaattatttccccatatttttccgttttcccaattttacttttccatcgtccgaaaatggccttttgcgttgatcacaaagccaacctttgcattgtttgtttctttttcatttttactttttaagctttcacttcgattctttccgtcgcttttcccttccgccgattttccatcgtttcgcatttcttttcgcattcgcttttcaatttaaaattattcgcatttcctccacagccggcaaacagaaaggccttagggaaaatgaacaaaatcagtgccattgttttggttcgctttaattgtttaaaatttcgcacttcgcatttgtctttctgcgaatcgtaaaaatatcgaagctccgaacggttttctccgcacttttccacggcatttccctgatggacgggcaaaagacagaaaatggctaaaagaaaagcgcaaaaacattttctcatctccccccccccccctccattatcattattgcctttttctctctcattttcgtcgatttgctgttctccgatcgcattttccactgctccgttgccatcatttcccccccgtgggcagcaaatgccctcgggcgtcgtttcggccgatggagaatattccgtcgggcggatgcattgaaatgcggcggggcattgggggagagaaattggccgattgtcggaattcaattggcatttttggggcaccaaaagtgccgaatttaacaaaggctttaaaacattgccgcagggagacggttcgccttttgagagccgcaatgaatggtgagcaaaacagagacaaaaagctcattttaggccaaccctcacaaacaaaagcacaatgaggccgcaaaacttacaaattggcacaggaagacaagaagtgccaaattgggcgacagaatcgggcggaaactgttcgatttccagacaatctctcgcccgaagcagacaaatttgaccaatcggacattgaattccgtcacaggggttgcgacaacggcactcggaagagagagggcatccgtccaagtcgaattcgacgccgaaggggcaaacagtggtggaacatttgcggaaagggcacacttttggggctaaagcaaaatcgaaatggaacgacacaccccaaaaccatacgcactctcncnaaaagctttctcct

SEQ ID NO: 30653 - DNA, 1207 bp, Heterodera glycines
ggggagcaaaaatcccacccccagaattaaagtaccgggtttataggggaaggtatttccggaaaggattcggtcttccccataaaatttggggcgcattcgggttcgaggggattcccccgaaaacaaaaaaatcgatttttttcaagggtccgtttgggggtactcaaacaattatggggagcaaaaaatccaacgcagaattaaagtacaggctatagggaagctattcccgaaggattcggtctccccataaatctgggcgcatcggttcggggagactgccccgaaaacaaaaaaatcgattttttcaagtgtccgtttggggtactcaaacaattatggggagcaaaagtccaacgcagaattaaagtacagactatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcaaggggactgccccgaaaacccaaaaaaaaattttttggataaaaattatttaaaggaactcaaacaattatggggagcaaaaatccaacgcagaattaaagtacagactatagggaagctattccggaaggattcggtctccccataaatctgggcgcatcggttcggggggactgccccgaaaacaaaaaaatcgatttttttcaagtgtccgtttggggtactccaacaattatgggggagcaaaaattccaacgcaaaattaaaagaacag

SEQ ID NO: 30654 - DNA, 1481 bp, Heterodera glycines
agaagagggggacattgtgtagtagagaaacgagaaataagaaaagagtaatcgaaaagctgagaaggtgggagagagcgaaatgagagtcgaaaatagaacagaaggaagaaagatgttatagacactaggtgaaataaagtatgggtatgctaaaaaataaaattaagtcgttctcattctcgatgtgaaacagagaaacgataataatggagagagttggtgggcatgagactgcagagaggagaagcccctggggggaaagggaggagaaaaggtctttgtccgttgttggtctcgcgttgttgtgatgttggtgagtggcacggacggaggatggattgggaatgaatgagtgaggtgatgtgggagagaaagagagaaagggacagcacagagacagagaatagggacaatgagagacagcgagagaaaatgaggagatgaagcttagatttctcgtaggcttttccccttcaaaatttaggaggggacggggggcggaggtttccctcctccctcttcctatctttgatcattttagtcattaaaatgccatacgatttgaataatttggcactcgacgatcgtgcatattaatatgaataatttttcgttccaaaattcaatggcattttgaatttaccacaaatgtcaaattcgccatggccaaattttgcggacaggccataatgaattgaaacctttcgagaaatttgattttaaacagattgccattttttgcctaattctcttccgattttacaaaaaacgagttgtactgtgtcgtccgtccattttgcaataattttcatttttttttcaattttttgtaattttcgcattccttcgcctttctttccccccgggggctgtgctgtcttttgaaggtcaaacatccacgtttttcttcgtccattcattgaacactcactactcactgttcctcttctctcccccgttcattctcttcctcttttttcaaatttgtctttgcccgcgcgcgcaaatttgcgcctttcgacaaaatgccaaacaaattgtgccaaaaacggagcggcgtgggtctaaatccctgcacacagagataaaattagcatttttaaagtataatccaacttaaataaattcaaaaaaaaaactttcttgtacaatgcccgaaaattgcttaaaaattgacttttcaatgcaacaaattattattgttttttgttacttcaaaaaagaattgaaatttattttcaaccattttaaaactatttttgttcaattttccttgaagaaaaaaagtttttatatttaaagttgttaaacaattttggtttctattttcatctttttttgccattttatcactatttgattacataatttggagtaataactaaaaatccgcggcttttttgtcacaataaagtttcaattttcaaaatcgccctttttgaatattttcttctccccaatttttcacatcataaaaa

SEQ ID NO: 30655 - DNA, 1763 bp, Heterodera glycines
ttcgcttttgccatcgaaatgcgcgtccaccagcgcacttccccgtggcgaaatcagtgccattttgaggccgagttcgctatggtcaaaatgagggaaaatgtccatccaaacatcgttgcatacccagctaaaaatgtgaaaaagacagttaaactgtctaattaccagagggctctgaggtttagaaaaatgaatattgggcctagaggtgccattcttttcctgcggatactcattaatgccattaaaatgccaaattggctcacattttcctcaaagttcgcttcattttctttcgtcccccaaatgatggcatagaggggcagggcgatttctgctgttttcctcttttttcaatttgggatgccattgaaaattcaattaaattcgcttaaaaaatttaaaatagaaaatttaaaatcggaaaccggaccagtgatgccatggaatttggttcactgtttaaattcacgatttgaaaatatcttttggcgccatgaaaacattttgccaaattaggtagtggagagagagatttagatgaattctgccgatgacaaaaaatgaataaaagtgtatcttgaaaaattgggccctcctaacccattgaaacatttttattcgtttattattaatttattaaataacgcaaaatggaaaaaaatgcatttgccacattttttccattacttctttgaaatttgcccctatttggcactcgaaatcgcatctgtatgttgccagttagagcacatcttttgtatcagtcacagattaaacataaatgcataagccatttggtggtcattaaaaagacataaaagtttcgtcggatgcaagagcagaggggcagaaaactttttcacagattttgagacgatttttctataaaaaaattacccaacttcgcctagggcaaaagaaatggacaattaattggtcagtcaaatcggcaaaaattgatgaacaaagggaagggcacaaaacgttgacatttgctacctgcaaaaaataaattaaaaaatgtttatattttaaaataaaatttcagaatctcttcaaagtttatgtaatacattgttgtaatgtaattttattattctttcttaatgaagtgattattaaaattttatgttaaagttttattgctgctaatttttgccggttttcggttctgtttcgattcggttaaaccaccgtccactaccgtagttgctagtgaagtagtagacaattttatttcctttaatttcctattttttgatttaggataaggcaaattgtgctaattgcctcaaaaatgaacaaaatgtaaagcaattataattttaataattccgaattcatttaatttatttaacaaaaaatagtttccacatttttagttggatttgcaacgacgtttggatggacattctcccatcttttgaccatgctcaactcggcctcaaaatggcactgatttctccacgttttgatgcgttggtggacaaacatttcgatggcaaaagcgaattgacaatttggagaccaatcacaatttgcaaagatgctgttgcagcagtgccgaacttagctgtgcttatcgaccaaggcattcagacaatttcgtgccatttccgttgccaaccattcgctgcccaaaaaattcgctttaacaaccttggattggagaatacaaacacaataaaaagcaattcttttgtcacttccttttcgggaacttggccctttctgtgaacgctttttcttcgggccaa

SEQ ID NO: 30656 - DNA, 1077 bp, Heterodera glycines
ttgctgccttttctcatttctgcccattttctcccaacaaaattaatttacattaaatttaatttcaaaaaaaccattaaatgccccacaagaaaatgggaaaagggcaaataaaaccattttcttggctcatcagacaatttcatttatgcttttcctcgacgtaataaaagtgtcatttggatgagagggaagcgtcgacggctttaaaaacattaaattcctataaaattgaaattctaaattttatatttcaattttcgattttttgggctcttgagacgctataataatatatttaaatttgatttcccaaatatttaaaaaaccaattatatgaaagaattcaaaaaaataaaaataaacttaaatttaaattattttatatggcaaaatttttctaaaaattactccatcaaataaaataaattaatttaaattaaaattaatttttgcatttaatatggaaaattttgctttaaaattaacccaatgttttttcatatatatatttttttttaattttgcttaaaaattaatccaatattttttcatatattatatatttattcccaaaacccatgacaacaatttgtttttttttaaattttaaattgcaattaattaaattatttttccaaaaatgtttcagagtgcttccgccacctccgccgccaactcatcagtgttctcgcgacacacagcaaacaaatccccatttggatccacacccgccggatgctcctgtcgagccggtgatcgcatttggcgtctgtgttcgatctgttggcgtgttcaaagcaagtttttcaaaaatcgggacaatagctaaattttgaaatttttgctttaaagacatagaaatatttttgaaataaataatatttttgaaatattatcgtttttcctaaaatagaaagccctgaggcttttatttttaaatccccctcaaaaagagattttatttcagggggatggctctaattagggggagggctctatttttcaacccccttcaaaggggaggctttagttcaggggggggggggggggttctaattttgggggggggggggg

SEQ ID NO: 30657 - DNA, 1442 bp, Heterodera glycines
  misc_feature (1390)..(1390): n is a, c, g, or t
catttcacgttatttaataattgaaaaaaatttcaaaaaggtattattttagactttagattttgaatttttatcaaaaaccaaaggggggacccttttgttttgcaaaatttttttttgataaaaaatcgtgaatatactttttattcgccataattgtactgttaatgtttaatgttcatattatgagtaaataaaacaaattttttttcaaaaaggaaaaaaatttcaaaaacgtccttcttgtaactagcgccaaatttttgctatctatcgatgtatgaatttctccttgaaaagttgtgacaattatttttcgggattttgacgggggatttacgacatccattagcaatattagcaccggcaacattaaagtgtcgatttgctgctgttcctctctcttttctcctccttcttccgtcgaatttttccttttcctctctttctcctccgtctctcctccttcccaaatgctattttcctcctcttcctttgtttctccatttccattaaaatttgtacgaaataaaaaataatttttcaaaaaacgttcgaattcgggttaggggttcgaaactgcgcaaaaagatcaaattcgtactcagtcagcgtctcaaattacccttaaaattgctttatttttggggtttccctcttttttgtgggaccaaatgatcttggcgattgccaaagccatttaaggtataactcgtcgaacaatcaataaactcagcaatttgcacactaatcattttataaaaatttttacagaaattatcggtctacgtcagttcggccccgcacggttcggccccagccatgtttttggactataacttttttttttctttgtcaaccaaatctaacaatttttatatcattcgaaagcccttcagatcagggctggagcgcgaccgcgatgcgcgatccacggcgttttttttgcgcgatccgcggtcgcggcaatttgaatgcgcggtgcgcggccgcggttttttctgtgcgcgctccagccctggtgtaaacgtagttttatatattatttgttttaatcttttaatttagccccaaaaatggaaaacaatcaaattataacgaaacaaaacaacaaaaaactcgaacatgaaggatgcctctatgtcttccatatgttcaatgccgaccgtgacgtaaaattttggcgctgtgaacatcagcgtgatgaattcaagtgcaggggacgccttcacacagcgctcaatgatgtcgttctgaagacaattggcgaccacaattgcaaccacagtgtggcaaatgtcatcacacaaaaaatcgtcactggcataaagcggcgtgccgctgagacgatggaaccaccagcggcaaccagggcgcacacacttcagcnaattgcacgccagtaatggcgacattccacaaagatgccacaaaaagtgaaa

SEQ ID NO: 30658 - DNA, 1935 bp, Heterodera glycines
tcaaatccatatgaatgacgacaacaagattagcaacctccctaaacacatattttgtttgtagggtcgtaaattatatggattaacatattttttctgctcaaatgataggttctttcaaaattttttaggcgctaaaaataaaagccgagaaaataggcactaataactcgaaaagtagcttaacaacatccccaaaaaaacatgtttttcgaggccacggggagttcaggaaaaaataggcttttgcctaaaaatattagccctaattattagtacaaaatttgaaatgtatttggtttgcaattgtgaagctagaatttgataagatttggcatttaaaatccatttttagctgttttagtgtattttttaagtctgctttagtaaagattgaatttataaatacacatccactttttggaacttttgagagtttaaaacttataatttgtagtttttagtccatatttggcccatttttgagctttttagtccatatttcgggcttttttaatccatggcatttttggtccatataatttacacgcctattttatgcttcgaaagctatggtgatagcgcaaaatcacttttgcttgattgccgtacgcccgtagaagctggcggacgcgtacggctgcgactgatttgccgactggcccatatggcgtttccaagccgacgcaacacgctgggatagagaacgctgttgccgttcccacgccgacaatcgcctgcagggggaaatattttattgaggaaaaattaagggggcctaaaccttcaaaattttaaaaagaatttctcataataaattttattattttttaacaactcagaaatccaaatttttcagcaaaaagtaaattttttttaagttttttaagcgaaaacactaaaaaatttgtaattttttaaagtgcaatttgttaacggttttttgggtcattgtccaatgagccgtcctttttgttgaccaagaccgcttcacttggctgctcgtcatcctcttcatgctgaacaaaaaacaaaataaatggaaaaaatgaaaaagaaaaacaacagtaattttagattttaattatttattaccatgtcctttttgtatgtttcgaacaattcgcccatcagctctcttgcgacaatgggtccagaatgaccttcgatgaaccgaaaaagcaggatctgtaaaaaagaggcggagtgtggtgtcgatcgcaggattggaatttttaattttggcttttttgaaaaagacaatttcggagttttctttacctctctcctcttacgaccgacgaatttttttctcacaaatcaggattagtccatcgtagaaagtttggaattttgttaagaactaaggaaaattttttgtatacatttcacatattttcatatttacgatcgacattttcgctgacttttttcctttcactcccccccccccaccaacttcttacgatcgactaattgtaagagacccccatgcacagttatgtatttaagtgatccaatttttaaaattctcaagtgggataattgaaatgcatatgcactctgccttcataacaaacacaattcaccccgtctttgcgccgcgcgtgcttggcaaagtggttgatcagccggcgaacgcgtgtcttttttgagtatacaatttctctgtattttttctgtctgagcatattgcgcacagtattctcttgagtccagcaggggaatagcaacaggacgaaaaggtaataaacaaagttaaatgttgtcagaagtgcgactaggccaaagctccacctatgcgagatatatggtagaaaaatttcaaattttttgtatgcaattttgcgtaactttgggtttaaagcgggaattagatgaatcctttatgggcaattttacttatttataaatccaatatgtcagcttcatatc

SEQ ID NO: 30659 - DNA, 1248 bp, Heterodera glycines
taaatttggaaaaaaattaataaaaaatttcgaaaaatttcattcgacacatttaaaaatgcatatattactcgccccactcattaaaaatattcccaaaaaagtaaaagcctaaaaatctcagccaatgtcactaagagaaacataatacagacagatttacccaattattcatcgctcaatatcaatctcgaccatgttgttttgttcttttagcacgaagtcgctcatcgcgtctttaaaccacatttcccaatcagttgaactgtcaattgaccaacgaatcaacatccactcctgcttgcctttcaaaatcagttgcaaatgttctctcgtaaaaggatttgtgtccacaaattgtgtcaattcgttcggttcaatgagcgcttgtgttaatccgattatgtactcgcaaggcgatggcgatctggcacttgcaaaagcctaaagatttcttcttatatacggcatgtgaaagtttcaaaaaaatctcttaaattattaatgttcggaatccctcgggaacttcacgggattgcggtcccgaatagaagttttcagaaagagtcaaagtctgaaaacttttttcactatggctctaatttctaaagaatttacgaattaaataccgttcgaaattccaccatgctgactaaatcttcggtatggcattttaaaatttttggcgttgaaacacccgttgacggcatgtgaagccactcgtacaacgcattttcggcggaatgtgtggcatcgcccggccacggaacctcaggaaaaagattatgcgcttcaatgattcgaagatttggacaggagactaagactgtgccggatatatgttgtctgatgaaatcaatccctttttcatcggtgcacattccgtatattttgtccttgaaaatcgatgaccaaactccactgaatagaccagcaatattttgtgagacattctcaaaattgataagcattccattttgaaaaaggccatcaatttggtgaaggaatgctacaattttttcatccaggcacctgcaagaaatggcatttaatggaagcttaagcttatggtttcacattaaggtaattcttctaaagccggagatgtccccgctgattggcggaatattttcaaagtcaaagtcagtgcttttccggggtccgacattcacaacaacgggctgacttgcatttccataacgacgaattttgattgggtttgccccaattcccaggcccatgatgaat

SEQ ID NO: 30660 - DNA, 1583 bp, Heterodera glycines
gtataaaaatgccatttttctcctcctcttcctcattccattctctcattcattctccctatattttccggtcaatttgttgctgcaaatgtcttcagaaattttgtacgtttattgttcccttttttctgatttttcgcatttattttgcttaaattttggccagaatttgtgagattttattaattcattaatttccccaaatggttttcagttggtctgccgtgtttcttcagctgttggtcgattgtgccatcattctttggatcttttttggctatgtcaaaaaacgacgacgccctcacaaaaaagaaatgtaaaaaatataaacaaaaattagaaaaataataaaaatttgcaatttttcagctttatctgcggcgcctgttggcttttggtgttcgattttcttgcgccttctcagctcggccttggaattgcactgattagccatcgctttgacttctacgtggatgaacacttcaagacacgcaaaggaaattgtacaacaaattgattatccaatgggacatcgaagaaatgggacgaagaaaatgcaaattgtcaaatccgatgaaaatccattgccaatcccgcaaaatccgttgcccaacaaagtcatcggattcagacgcattcaaattttgtagaaattgattaacttggaatttttcgtctaaattttttgattttcagttacatcgatcaaaatgtcatcgcatttctccaccattttcaccgttttttcgccttttcttcaatatacttggtcatcactgaaaatgttcggattttagatttttcaataaaatttccaaaaaatcgctgaaaatttctcaaaaaattttttttcttagaattttcctatgaaaaaactttctaagattttttttcttgaaaattttccaagttagcaattttttttaaaaaaaaatttctcggtgggggggggaacgatgcggggggaaatgaagtgcaccccttcctgtgccaggacaatgggagatcctgtcctgtcctgccctcatgtcttttaatttttttttaaatttttctaatctttaacctcccccgccctctaatttttaggatctttcccgacttaaccgcgacctgtccaaagtgatttacatcgactgggacccgcaggcattccagctgaacccggagaatgtgctgcgagtgcccaaatgggagggcaacatggacgacacgacattggcacgtttctcccgcattcattcattttttgaaaaatagaaaaggcaaacaaacccacatgggtggagaaccgagcacaaatacatttgggagcggagcactccgaaaattaaaaaaaaatcaaacttagaattttttaaaaaatcctaatgatttttttataagaaattttctttaaaaaaagtttctcttggtatatattcttacaaaaaaaaaatgaagattttttctgaaaattttctaaaaatgaaaataaaaaataaaaaattttggccgtgaaacgacgggggaatgaaatgcacacacctcaggacgaggaatacatgaaactaataatgcttttcccgttgattaattatgag

SEQ ID NO: 30661 - DNA, 1721 bp, Heterodera glycines
ccctaagaatcgatttttcaaaaagcaaaattcaattcctggccataatttggcggacgagcgaaaactttttaggcttaaaaatctccaaatgtgtttgatttacaattttgcaaccgaaaaggataaagatgaggaaattttggaaaattcattcatttatttatatgtttttccaatttttaggcatctttttagcaactattttggccttttttgagtctttagcacctattttggcacttttttagcaactatttaggtacctatttcgcgatttttagcacctaaaaatccgttccctgatgatcacttactttttttattgaatgattaactttttgtttgttttcttcagttaaacaaaaaattttgaaaattttccctattgcatctatcagtacgaatggtcagggaacacgctaataagtttttttctaaatttcatttctcataggtcgcaaaatattttaaaacaaattaaattgaatttaaaaactttaattattttttaaacaaaaaattttatgctgactcgaaaagtccttcgccgtcgaaaagtccgcgggagcgctggaaactatggaagagagaaataagaagtatttgaaatttcaaaaaattggattagaaaaatattcgtaattcgcaaaaattttagttaaagccgtgatgtccaactttcagctggtggaaaaattcagcacgaatagctgcgagtgagacagtgtgaaaacagccttagcattaccaactgaaaaagacccaccacaaactcaaaaaatgagtattctttggacaaaatctgccgacgaattccaattttctcatgaaaaatgacaagtgaatcacactaattttcattttaatcattgttttggagtttggaaaatgtttattattgctcccaaactcacaattgcacaaaaacatattataatattcataggcgatgaaaatgatgaaagaaaaacaaaagaaaaaaaatctgaaattaatttactctaacatttttgtttacatgaaataaacaaattcatgaaactaaaaatattcatttaaatgtattctcggaagaaagcgtctgaaaatgtttgtctcaacattttctaaaagggcattaaataattcagaaaagcatctttttgctggctaaaacactgataagggaaattacattattcagaaaagatcttcatcaaataattttctaatgtttttatggaaaaatgccttgggaatattttgtttgaaatcttttttctgtataaaaataaaatcaaatttccacaaaagcatttttaaattaattatttcgttaaaaatcctccaaagttttatgtacatagcactgttgtttttaaaattttgttttttccagtaaaattgttttcgttttatcctatgaattttcaaaggaaagtttttagaaattctattttttctaaaaaatgagcaaattccaaatcgtcaccgtctccatgatgctttttttcacaatcattgccatgaacatgttcttggcgaccaatgcccaatgtacctatgacgctgcaaacgaaagatgtgtgaatcattggtgttctggtgtcggcggttgcattttgcagggcacagaatgctcttgcttctttaaggtttagcaaaaaatggaaacaatttttcaatgaaataaagccagggttcggattcgtacttgaatggcaaggacgtcctggaaa

SEQ ID NO: 30662 - DNA, 1188 bp, Heterodera glycines
ttatgggcagttttttgtagagaatttccatttgatggtcttttatataacgccctttttgatggtttttataccatttgacgtattttgcatgcaattttctcagtgtgaaatttcgagattcttctaacgcagccacattaatttatgctaaagcatttaagcaaaacccaagacacattgtttagttatactttgaaccgattttgttgctcaaacgtgtatttcgatgaaaaatgagtttccgtttttttcgaaatcgggtcaggggatcggaattggccaaaatggatgtaaattcgtgatcagcttccccgaagaccgccggaagggcacactgggaacaaaggaaaggaggtcatcataataacaaagaagatacttatggtaaagccgcgcacgagcaagatatccatgtcaggcctgagcacgatccttttggaaaatttcgggatcatgacccgacaatactgtttccagctcaagaaatcgtcctgtctgccgagccagcagactgctaaattcgggtcagatgtgcattggaaatgcctaaagcactgaaaatatcagtgccaattcttttttattcctttttcttccattgctttcttccgcatatttccccttcatcatctttcttgcatttacaacaaaaaaaaagcacttttatgccttttgcttagtccccccccctctcttttctctctctctttctcttttctctctctctttctcttctctctctctctctctctctctcttcgctctctctctctttctcttcgctctctctcttttctctatctctctttctcttcgctctctctctctctctctcttttctctctctctctgtctctttctctcttttttctctctctctctgtctctctctctatttgtctctccctccctctactcgcattttaccatattatggtcattagcattagcatttggctgacaccgccgtctctcatcaaagccaacgccaaaagcaaatggtaaatggtgctggggtagtggtgcattttcagtacataaatgagcgaaatttcgaggcttgaaaaggcgagataaaagcgaatggcagacagcggggaaatgagaagcaaagagcggataaatagtgtagtggaagggtgagaaagagagagggagggaaagatgaataagagagagggaaga

SEQ ID NO: 30663 - DNA, 933 bp, Heterodera glycines
cgccgagccccaaaaacttattatttcataaaaaattggctcaaattcgcaaaatctggtcattttttggacaaaatctgtgcacaattagagtctaattttcaaaattttttgcggcagcgtctatcagctcccctggaccccctttttctaaattttttttttgtaaaatcataccagaaaaaaagacggtgtaaaaagcaaaaaaattcgccgacagagaaaaaataaactcaaaaaattcacggtcacggtcatggttaccgtgaatttcacgggttttttggatcacggtcacggtcacgattcacggtcacggttcacgggttttttcagtcacggcacacctctagccctcacctcgtttgagataaagattatttcgcatttttttcttatcgatgtttccatttgtgtcatttactccgtggtttagtcgaccgacgaaaaagtgcaagaatcaagcacttgagatttatgcacttgattttaacctaattattcgatttaattcaaaaatttaaaataacctaatatatattatagtaacaaaaaagtcgttgttttactgaagggagttttatttaaggaccttttaaaaaaagttttgggtttttctttaactgtgtttttaaaccacccgattcgtacgggacagatggggagagaaggagtggacgggcacttggcccaatccccccccccccgatcagaatgaatagaacaaagagaggggaacagattaatgagaaggggggcggggcgagcggggcgagaagagtcaagagtatggacaacaaaatacaatgtgatgacaatcatctgccaccccaaaaataaattgcccacaatttaaaaaaacaaaacaaaaaatgaaaaaaatcatctttttttttggatttttgcacattttttggggttttttttgaaaaa

SEQ ID NO: 30664 - DNA, 1291 bp, Heterodera glycines
  misc_feature (32)..(32): n is a, c, g, or t
agcattcgcttacccttccccgatttcatccntctccacccccggcgaatgtcaattctgttccactgatcaaagaatattcttccaatcgcttccttttcccattttgtccatttgctttcgtctcgcgcaattggacaacggaccaacagaaaacggcagctgaagtcagtccttttcaacgtcaattgttcccgagtcgattcattggtcagatcaaagggcacaacggaagcaaaaggcgaaggaaacgaaaggtaaacgatggaattggcgggagaagaagcattggcaaatgcctaaagcatggagaaattggttgagaaatacgaaatgataaaagagccaaataaatcaattcgaccgaactcaccgctttgaaggcttcaatctttgacgccaaatccccgtcatccttgttcaaccagcatcgcaacacttttggcacatcgtccatgcggggagtgaaaagccatttggccatcgcttgtccatccgacgccatggcattgtcatcggccggaaattcggcgaaaagatcgtcaacataggagacaatgcgaagagatggacattcgttgagaattgacggcacgaattggcgcaaacggcggtaaattgtggcggataatccaatgccatcgatgtttttgctgagcaatggccaaatgttgtgcaaaatggactccaaaattcggtcactcgtcgtatcgatgaacaaattaagcggacaggaggcgaaaagtgggcgaaaacgttggagaaaagcgatggccttgccgtcgatgaaactgaaaatggatgggaaggactgcttgaatttcttgcataatcgtcaattttacgagattgtgatgcgtttgaagccgctgacattgtgtggcaattgaatttgcggaattgccaatggtaatccaacggaattgacaattttcagtttctttgtgccattcttttcaattttgcgcccaatccccatggatttcagtgtccagcgccgcgtctcgaagtgtttgtcgacgatgttgtcaaatcggtggctgatcattgctattccctgtccaacttgagaaggtgcaagcaaattgaacaccgccagccaactgttgccggagatgaaactgaaaaattaaattgaaaaaattttaatttttgggtttttttttacattttctttttgtgaggtcctcgtggttttggtggttttttgaagatgtcccaataaatccaaagaatggcgcaacagccgacaaacattggcacaccgaacagactaaaaatgaaaaggaaa

SEQ ID NO: 30665 - DNA, 1271 bp, Heterodera glycines
ctttgaatccggatgatgagagttttgctgcacatctgtatcagtgtaaaccatattatactgaaccggaagaagcaacggaaaagggagttgggccgatcccgaagggaccaaggaaaattggggaccgaaatatagaagaatcagatgaggaaagtgagaaaaacgagaccagaattgcatttttgaataccagaggagacggggctacgaatgaagaagaggaaatatttgccgagcctttgtacttaatggaaattcaatttgaaaacaatactattctaacctacatcgatttttcggacgattttgaactttccataatccctacaaatcgagtccagggacattggcaaatattttctgaagggcaaagaccatatatttcggcctggttatttgagacaaatttacaaatatttgtggaagaagctgatagaccgtacattgggaccgaaatgagaagattactgtgggaaaagggcagagttatgatagaggatagaatggtaatattttgggaagagtttggagaaggcgaatttgcatgggaagaaatggtcttaccaaatttggaagtgacacaccaagactttggggaatacggagacgaaagcgtggaaattaattgtatttgtttggaaagtaacagaggaatttcaagaaatgcgcctacttttcataacaaatcattaaaatactacaattcacaattttctattcataatacatcattttcccaatatcattcgcctaaaaactccaaaaatttacagccagaaaaattatttttacaaaatatgtctcgtcacgaaccctttatccccaaaaatcctcgtaaagcccgaaaccaattgtctcctacgccacctccagtattggtgtccatatcatcagacgaatccgaaaatgaagacacggaagaacaacccgaacaacagtcggaaaaacaacaaactgtggacggcattcagcaacgcccttataatcccaagcttcatgaatttgagaggagcaacgttcggattcttaattctgttgagcaacgccgtgcttctgaacaacaaaaagtggtagtttcctgaaaaagcaaccgaaagccaacgggacagggaaattcgagaattgaagcagcgaattctcttactagaaagtgaaaatgctaaagaagagcaaaaagcagaagaaaaagctaagatagataaggaagaaaaagcggagaaagatgccgaagagaaggaagaaaaagcgaagaaagatgccgaagaaaa

SEQ ID NO: 30666 - DNA, 1042 bp, Heterodera glycines
tttttatttttctgtaaatcggttaagaagaataaattaatggtattttgtttaatttaatttttgtaaattatttgttaatgaaaagctatttttgaatatatgggttaattaatgagtgtcatcaaattttgtttcgaccgtcgtgttcatcctcgtccctatcattctttggcactctgtccggctaattcatcgccgccaaattcaaacgggcaaaaccatcatgccatgaacagtcagcaggccaagaagagaaagagtaacagcctgaaatatttttgttttcatattttcgggagattaagagcataatactggaaaaaaatttttaaatgggttcagtgtcattaactcattaataagtgccattgtcagcttttcacaaaaacataattcaaatttgaatttttactttttgtttagtgccattgtcagtttctcgaaaaaaacacatttaaaatttgaatttttgatcgaatgctggttactgttctgatttattcaaaacgaatttaatatttgggacaaacaaccttgccgaaaaaatcctggaactataatttttaggattaaaaaaaatgattaatgcatacatttttgacaaccaatttggtcatcaatggatttgaaaatttaattttctccgggcgggggcctatcgcatttattttcgagaatttttcactcactgatgaaaattttttttacaaacttcttgcgaaaactcaccgccagtaccaacgaaattgcgggaccgcctccggggccttcaccggtcgccgctgtttgctgcacaaaacacggaggactacaattgcatgggttgcacttggaaggcgaacagttgattggaccattgttgacggccatcgacgacggtgccggatttggcattccatgtgacggatttggcattccatatgccgggtttggcatcccatatgccggatttggcattccatgtgacggatttggcattccatgtgccggatttggcattccatatgccgggtttggcatcccatatgccggatttggc

SEQ ID NO: 30667 - DNA, 1790 bp, Heterodera glycines
atattacaccattccctcaattaatcgactacctctgtgatttttgattcaacggtgacgtggacctcgacctagacgatgatcttgacctcgatcgactccgtgaccgacttgaactttcgctgctgctctcaccagatgtggagccggaggatgatgctgaggacgaagatgagggcggacttctcgatttcgacttttttgactcactaaacagagaaagggaggttgtctaccatttctgaatcattgaagacttatgaatccagagttacacttccatttgatatgcagtttgcttttttccccttctatgtgccaatgtttttttgtgtctcatcgcccacctctttttcgttggctgtggtggcacatatttgttggtgatcgcgtcttcaaatgtcttccccttctccttcagttccgtttccaacttcactttctgctctctcttctttatgtaatgctccaacagtccgttaacttcccatccgtccgcgtcgcggacacaatccactggtggtggcggttgcaaagcgatgtaaaagcggtcaatttcgcgcatcaactgatcactgggtgcttcgggaggcgggagacggaggtctttctcgcgcaacgattcatacttagaaatggaattactcgtattgaaaaacaggagtgattgaaactgactgtgatgtcttcgattccgatcagggggaccatcatgccagcgggcagctcataatacggagccttcggaatgaggtcgaccggtggacgctgttgtggaggagcgaaatgagccattgggggaggcgccgcgccagtgggcggaagagggggaaaaggcgtacccatcgacgaaggcccattgccaaggcacggctgttgatgcacagccggactgtgtggtggagggttaatctcaagcagtgatgggattttgtgcggcgaatttgtggatggaagaggaattgtctggtcgaagcgcgttgagcgacgacgcatctgttcaacgttctcccgctcggcagccaagcgttttcgttcattttccgcttttcttcaatgatcagatttaggcactttgcacgaaataaaattctgtactcaaaacacatatatacctagatgtatatatataatttacatggaaaattggtgttttagtcccttaaatatttcttttttcgaagaatattgagtaaatttacgccttagccctcattttccaacctcggcactctctcaacgctttctcccgttctgcgactttcgtaagcacgtgctgctcatattctttgtgctgtttggtgtatgcgccgagtgtgtctgcaatttctttgtccacttccgcagccaattggtgttgttccgcgacggtggcggtctgttccgccaacattgtcgcggagggatttcgcaattgtttgtagcatccgtcgtcgaaatatttgtgcccctcccaaacaccgaccaatttctccaatttgtccacgaatgtgttattcgaggccgccattggactgctgcacgcgtaagcgtacaatttgggcacgtagcgcgaaagcatttgacgaatgctgtccaactttttacgctgactaaaaaatatggaataaaaacgaaaaaacaaaaacacgaaccaatagtgagcccaatcattgatcagataaaggacatggagtcggaaggagtcagaagagcgccgttcacgaacccttaaaaatttacaaatatttgccgagtaaaagtaattttaaaaatgggcaaaagctgggtacaacaaatcgaaggtcaat

SEQ ID NO: 30668 - DNA, 1190 bp, Heterodera glycines
aaaaatggggttttgaccaattttattggggaaaaaaaaggcctttacaaaaataattcccccggggagaaagggagtgggaaaacatgatttcaaaattttcaaattttttctagtctaatctacttcaaaacggttcagaattcaaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaatgttttctagtctaatctactcaaaacggttcagaattcaataaaaataacattcacggtgcgaaaaatggggtttgacaagtttattggggaaaaaaagactttacaaaaaaatacacctgggagaagggagtgggaaacatgatttcaaaatttatcaattttttctagtctaatctactcaaaacgggtcaaaattcaataaaaaaaaattccccgggggaaaaaatgggtttggacaagttttattgggaaaaaaaaacttttaaaaaataatacccc

SEQ ID NO: 30669 - DNA, 1190 bp, Heterodera glycines
  misc_feature (50)..(51): n is a, c, g, or t
  misc_feature (53)..(54): n is a, c, g, or t
  misc_feature (56)..(57): n is a, c, g, or t
  misc_feature (61)..(61): n is a, c, g, or t
  misc_feature (64)..(64): n is a, c, g, or t
  misc_feature (94)..(94): n is a, c, g, or t
  misc_feature (96)..(96): n is a, c, g, or t
  misc_feature (107)..(107): n is a, c, g, or t
  misc_feature (110)..(110): n is a, c, g, or t
  misc_feature (120)..(120): n is a, c, g, or t
  misc_feature (125)..(125): n is a, c, g, or t
  misc_feature (131)..(132): n is a, c, g, or t
  misc_feature (136)..(136): n is a, c, g, or t
  misc_feature (141)..(142): n is a, c, g, or t
cagcgttagagcaatgggaggagtcggcgttatttcttttaaagggcatnngnntnnctgngangaagaagaagcccccttttgaattggatgntntgaagaagtanaanattatttggntgatngttggnnggtntaaannaattgagtacctcacggcagagaatgtgcggggcaatgaaaatgggactatttgttgggccagctcattagttattttgtagctcccttcctcattaccgtttgtcggttttgcaacgaaattttgtggcacttgcctccgtttacaccaaactgtggcccctcgtgcaacgaaacatggacaacaagacggacttggtccatactttgttctcttatctcagtgaaaaatacaccgttttcgacagagtacgttttcattccccactatgttttgttctttctactctttgtttaggaccgaaatgttggtcttatgaaagtgttaattaacgtgtgccgcgaaaatgccattaaacgccttggcaatgtttgtccacccatcccttcgtttcctttcactcatttttcactatgcatagatttttgtttctctccaactcgacgatgtgaatcggatggcacatttgggccaatcgctaccagcaaataacgacgaaatggagaacgctgagcaaatcattatgcgtcttcgtcataaatctccctattttgtggccagaatcgacggacgcactcaaacagtgttttttgaggaggaggctaaaagcagcaagcaacaaatggcagcacagctgcaaagcaaagtggacacagcaatggccgatgtgattactcttgccagcattgtccactcttatgaagatgccgttcgacttaacaccaattagtaagccgtggaagcttcgccactgggtcggtcattcattcacacaaattttagtgtggaaaaatgcgctgcacaaaaggagaaattgcgtggcgcgggtggcaatgggggaggaagttcgtcgtcaatgactttcgacgacgagggactctttggtggtgggtcgccctgatgtgaaataatggatttccaaaatgatcggattttaagataatcgaaattgttttttttaatttgttttgtgtaatatttggaaacacaatggacaaaaaagaaattaaagaacgaaggcaaagacttttcattcgaaatagcttaa

SEQ ID NO: 30670 - DNA, 1257 bp, Heterodera glycines
atcaaatgaataattggagacagaaaattagtcataatctcgtctaaaatcgatcaaattttataatattgatatttttcgatagccctaagtgttttctattatcctgcaaattttaaaaaaaattctttaagtttaaaaaaagttatgacctgagaagctcaaaaaaccaagtttttttgaacatttttagtcataactttcttgaaacttaacgaaattttttgaaattttgtaggctaatagaaaacccttaggcctatcgaatgatatcaagaattaaaaatttagatgcttttgagcaaaattatatcaaaaaatattttcatttgatggttttttgactaacgcccattatgatggtttttgactaacgtcatagcaccgccaaaaatggctgtattacgatgcgttatatagatatgcaaaatttggtgtggatttaccaagtgaattccgtttttctctattaacagagataaagaaatagtacgccaaaatgagagatgtttttttctctacactctattgacacatgtctcgttacttaaaagggaacccacccgaactgtaagtcggaaaatgcatatgtgtgatataccattggatagagcagggtcgacttctattgtgaatttttaatattacgtccccatagaaagaaattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttgtcttttgaaataaattgtgaaaaatatacgaaaattattttagcttttaattatgctgtacaatgcttttaagccccgccgtgcggcggctcccattttgtgcactattttagtttttaaaattggttccggactttttggctttttgaaataaattgtgaaaaatatacgaaaattattttagcttttaattattcagtacaatgcttttaagccccgcagtgaggcgggacagttccaaaattttgtaccacattttactgtggaaagtccaagtaccttattggacaactacgtgtcaatgagcacagtcgcctttggccagttgtggaacggaaaaatgggaatatcagatggggagcgctcttttctaaaaattcctcttttcgtctaaccatcc

SEQ ID NO: 30671 - DNA, 1199 bp, Heterodera glycines
  misc_feature (104)..(104): n is a, c, g, or t
atccgttttcagaaaaaatgccttgtggtgaaaacaatatttcaccattccactcccataactttgtgagttcggcacggatcgagaccgggataagaccatgngaaagagcagctcgagctctacaagaaggtatggaaagaaaaaatagttatttctgggactttttcagaaatcagaaataattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaaataattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggaggaagccattggaaagagcagctcgagctctacaagaaggta

SEQ ID NO: 30672 - DNA, 862 bp, Heterodera glycines
  misc_feature (301)..(301): n is a, c, g, or t
tgaggtgccctaataacgtttcgtcattcctattttcatcgttatcataacgcaaaatcaaatttttgagcgctctgtcattttccacatattttttcttccttgtttcagtcaggccccttgtggggtccaattcaaatggccgaattctgtttcgctgatattcctcctcctctttaattccgtttatgaatctttaaaattaaagtctcgagattagagctcttaaaattcactttgaagtaatcactctcaattccactgagccaaccgctgagtgtgctcggcccatgcacgtttntaagcggggcaaacccaaacttgggtttgcccgaccgctatcaagttttttttccgccactcatatccattctggtaaatcaaaacaactcccttcgttgtgtgatcggcatgatcaaaagtttcccattttagtatgaaaatgaagaataggaaatacagttttaagttgtgcattttcaaataatagtggagaaaaagcgaaaagcccaaaataatattcattattacgaatagtagttttaacattgctttactacggccgcattccgtcgggcaaatttgtttttgttatttgatgctttactacggccgcattccgtcgggcaaatttgtttttgttatttgatgctttactacggccgcattccgtcgggcaaatgttattactagttgaaggacggagagagatgggaggggtggggggggcatcgaggaataatgatgaatgagtttttttcacgaaatgcagaaaattttaagttgcgctaatgtttcgaccagtttcgtttaagtgaaaaattgctatataaatatgagaagaaaccctacgaattaataa

SEQ ID NO: 30673 - DNA, 876 bp, Heterodera glycines
attatacgaatttattaaaatgacaaaatgtgtatttttaatagtttttttctgttaataaatcgatgaagaatatgaaggataattgtaaattttcattgaatatggaccagggcttaaaatgaacccgaggaatttaactcgaagtcgtttaatacgaactgggaaatcgaattaaaaaatgcttccataaaataaatcaagtattttttcatttttaaatgcgcaaaagttttttcgaaatttgaatacaactgcttgataatttttttttgtcaccaaatcacaccaaaaagcttgagatggtcaattttcgaagataatttcatttcaaaatcgaaaatgggaagggcttggtgaacaattggaaaaattatactgttgatttacctaattatgctgaattgttaaacatttatgatcaaaagtcgcttgagagtcgtaggttaaaaatagacttaaaactttttcatgaaataattttaggtaaaataaatttacaaaataacgaatccttttctttttccaaaaaccctgtaaaaaacgaattcactataagaacagcttattgctcaactaatgttagatacaactcgttctttattcgaacctctcgtctctatagacttttacctaaagagacgagattactaaatcctaatgagtttgccaaacttcttgaaagatctgatcttaatttgttgatttctttgccaccccagctccaaaagtgaccaattgtttgttttatttgatattattatttctttatttttcggcgtcacgcttttgcgtataaatgattgattgattgatattggcagtttttagtgcctaaaaatgagaaccaattattattgtaaaatcacactcaaa

SEQ ID NO: 30674 - DNA, 1637 bp, Heterodera glycines
  misc_feature (62)..(62): n is a, c, g, or t
gacatcaaataatagcgtcaacgaattgacgccgcttgctttttaaatcaacgatttgatgncattctgtttcaatttaaacttttgcctttaaatcaatttttttcgttggtatcaaaaatgtgttcaatgtatccattttttaaccgaaaatattcccaatttactaatgggtgtggaagcagagatcggcgcggttggtttttttttcgacttttcgaatattaaatattttcataaacgcgcttgcaaatctcaaaaaaattctgaaggcagtacataaaaagtctaaattattttctaggaaattgaaacagaaatctttgataatcaaacgtttcctttgattttaaattgaaacaggttgtttgatttgacgtctaatcaatgatttgacggaaattgaaataggcccctgggctaccagtggtgtgaaacgcacgaaaaacaagttttttttctggttgttaagctatttttcaagttattagagccaaattctaagtttttatttttgagcgaaaaaaacaatttttgaaaaactttttttttgccaaaatgaatgccagatttgagcttaacgaccttgaaaactccattgaacacgctttcaatattgatggaatttaaaattatgtattttctgtttctatttttgctttttttttgttaaaatgttttttagtgaataatttttttttttgatttaatacttttctttttgttattaaccttttattttctaaatttgcgtattttgacttatttttcttttaaattttttgtcgccaaaacgcgccctgggaaacgacccccccccccccccgactcggctcaaaactcaaaagcactaatacggcacggaactgtccccgtgcgaatacgcacgaattccggggatttgacaataaataataaatgattattatttattcttttttgtctttgtgccttttcgtggctcagttggtaacgctttgcgttttgaatcctttgcgaaggcaatgatgaaaaattactcgtttaggagccaattttttttgtcgaaaattttttctccacaaatcagtttttcttgactaaaatttttgattttacaaaaaaaaaataattattatatgtgcaaacaaaaaaaaatggttataggctccgtgggaatttttgaaattttagtccgttctttgttaatacataggttttgcgccataatggtcaattgtctgtgttttttaacatgactttttgatggtttgataggcgccgtcggagggaaaaattaattattttaaataaagttggtttagagatttaaaaataactgaatatttttaagaatttcaagaataagaataaataatgttaacattcccaaattattacccctctgcaagggcgtagccaggaccttcgtttcgggggggcccaactcaaaaagtcggctcttaggggtgtattttttcgtttttgtaaacctcaatatttagaggtgtattttcgtgtttttttaaaattgaattgattgcattagacgcgttcaattgtaaatgatatgttttttttcatttcataaactcgtttgttatttttacaaaaaaaattaatataatatttaaaaaataaataaattttttttcaaa

SEQ ID NO: 30675 - DNA, 1434 bp, Heterodera glycines
gaccggcggaagggagcatctgatcagattaagatattaattgagcaattggcaagaaagtacgcaataaaagtgccaagactgaacgacgtcctccctcagaaagggtcttcgaacagttcttcctggcgccggtcctttggctgcggcagtgcctccaattcgttggctttttcctgacgaaaatggtcaatgtgtgagaatgtgtgttaacttggatttgatccctggagcatttcaatttgtataatcaatcgacccaattaactaataccaattagttaattagtccattcattctcctttctcacaatgttaatgggttgccagctccgcgcgctatattcgtgcttgatgaggtaacagtaggatacaatggcagtttattatcattagagtaaaaagtaggagacaatcgcaatctattggatattatagtaaaaagtaggatacaatcgcaatttattaatattatagtaaaaagtaggatacaagcatgtgatctacgcctagaaaaaaatggtgtaagttaaaatcgtaactacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagcaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagccttaaaaaaatggtctaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattacgagcgctaaaattattagagtgccgaaaatcgcatgtgatctaagcctagcaaaa

SEQ ID NO: 30676 - DNA, 1174 bp, Heterodera glycines
agaataactcgaattcgttacttttttcaccaatcctcccacgaaccaatcattggctttttggtcgaaccaaatcaaagatacgaaaaaatttttaaatatttttttatagtcaagtcaggcgagttcccccccccccccaacagtagaccaaccgatgccagccctgtcgtcgtcgccattgttgccatcctgcgccgttgcattgccggcagcgcatgcgccgtcggcaatggtggcgagcggttaatagcgtcaacaaagcgatgatgcggcaaaatttggtgatgaatatgctgttgttgctggggctggttgtgaagcgacggcacgggactcgcctcgtcctcctcactgatcccagccgtgtccatgaacagtttgtgcaattgggcggcatggaattgggccgaacccatcgccggactcgccaacggcgtgccgagcgcaccaggactgaatggacataaccaaaatgagtgtgccgaacgggaaattaggcatccacgatgtactcccataagtgaactaattgaattgaaacccatacattttcaaacttccttattccgattagcaaaatttaaaatttccgggattctgaaaaaatgaactaatttcccagaaaccttccgtatcccgaactggtgtcgcattcataaccgtccgccaatgctcccgacgatccaccgctcagacgacgaaactgcaaatgcaccaaaattcgttcatttcacgtaagtttttgccaatctcaaaacaccgcaaaattccgtatttctttttatttctgttttaaacaacttcaaaaagtgccagaccgtgtgttgcatgtccaaggaagtgccattgctggcgaacttatgccgctgtgtgtcgagcagatggaatggcggacgcttcgacagaaattgcatggagtacaaatggtcagagccgacacttgcagatttttgacgaaattggcctaaattgttggcattttccatttctttgttggcaatcccaacatattaatgagatgccgcccaaaagtcgaattttgaaaaccgaaaaccaataacggtgccaaacaaatatattggttaggttctaacccgaaaatctatgaataccttttacctaagctaaattttcattatggtttcaattctgtcaattcatttgccattat

SEQ ID NO: 30677 - DNA, 1507 bp, Heterodera glycines
tttaccttttaccgtaaccgtttactaaaaatttatatttaattctttttataaaaccaattaaatactaaaccaaaattagtctaaattcaatttgtatagtaaaacaaaattatttacataaaatagttttttaatttattccactttttttactatttccgttcatctcggggaaagcgaatgttttagtggacaaattatccacaaatgggcaaaacggagatgaatcaccgccacttttagcattggaaaaacagaaattccgatgctaatatgttcatatgtgagcaaaatggacagaattatggagccatcagcagtagttggaaatgggcaaaagtgattcaccacttttgtcattggtattcaaaaagccaatttctgtgtaaaaaagcagcggacaatttgctgggaaattgaggcggggccgccgcaaacggacggtcggacggacggacggccatcgacggacggtcggctttaagccgaaactccgcccaaaatgagcagcataaatagcagattatggctccagcaaaatcataaccgacttcaaatccttcaatccaaaagcgaaccaatcaaaaattccaaatggccccaagtcacaagctgttcttccaattggtcatcctgcttgtcgtggcatcgcatgacatctcgaatggtaagtgagaaaaaaattcaataggtcaagacttattgacacgaaataattttttttggaattcatattttaattgattaaaaattaatctgagttttgttgtagtcaaaaagaaatatgcacttttttaggtttaagcctaggaattcttgaattggttttatggtttgtatgtgttggttgatttggcatgaatgtctccaggccaaagctaaccccggaccagccgaacctagcatctcggaaatcaacggcaaaacgcggaaagagaatggaatcgaggccgactgatcgaaagcacggtctggcgaccaacggacaaagcgcacacaaaaccatagccaggggtgaggtctgaggcgactaatgtaccccgcctcaccgaaatcaaaaaatttcaacgaaaaaaattttttttaaataattgttttaatttgttggttttgtgcaaatttataataaataattgttagaagacgccaaatttttggggtttcaaattcctttccttttatgcctcaacctaggattaaaataagatctgtcatgatttacagtaggtttgcaaccccgacgtcggggttggaaaagtcggggttcgggctgaaaattccccgactaaatttgtcggtggtggctggagaaatttaaaatgtcgggggcagacacatttgtcgggggacgaaattttcataaaaagacggaaaaagataaaagaaaaagctcctgaacaaaaaagtcttaaaaacgaatttaaagacacttccatcttatttgaagtgcaattgacgactttcgtaaaacaccgacatttcggggtcgcaaccctaattttta

SEQ ID NO: 30678 - DNA, 1680 bp, Heterodera glycines
attagtaagcatttgtagtgctccgatacgtattctgcaaaatttggtgagccgctgatcaattacaaattatttatggacgatcaaattttttgaatttttcttaagtgcaaaagtggtgggtgtcttacagcttaacaaggcccaattaagcttatttccagaaaatctcgcatgaattctcatttttaaattttttatagatttttaaatatttggatatttttttggcttaccaaaacttcatcgaacctggctctttctattctcattcaaatcgctccaaattttttttacagcttaactaggcccaattaagcttatttccagaaaatctcgcatgaattctcatttttaaattttttatagatttttaaatatttggattttttttggcttaccaaaacttcatcgaacctggttctttctattctctttcaaatcgccccaaattttttttacagccacgaggccgcgaagcggccgagtgagtaccttgggcgcaggaaaattattaaggaggagggttcattatttatttatttttgcaaaattaattcataaatttttttcagaaactgctctgaaacgcaccaaaatttatttacaagttgaataaggcactctgactcttatattatcaaaaagggagatgaataaatattttaaaaatttctaattcctttttaaacaggccgaaaaagtttaggcttaactttttcagcgggtttaaaaaatctagaaaaattagtaagcatttgtagtgctccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaataagtaagcttttgtagtgttccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaattagtaagcttttgtagtgctccgatacgtatctctgcaaaatttggtgagccgctgatcaattacaaattatttatggacgatcaaattttttgaaatttttttaagtgaaaaagtggtgggtgtttgcaaaaaattttcaccgggtttaataaatctaggaaaattagtaagcttttgtagtgttccgatacgtatctctgcaaaatttggtgagcccctgatcaattacaaattatttatggacgatcaaattttttgaaattttttaagtgcaaaagtggtgggtgtctgcaaaaaattttcaccgggtttaataaatctaggaaaattagtaagcatttgtagtgttccgatacgtatccctgcaaaatttggtgagccgctgatcaattacaaattatttatggacgatcaaattttttgaaatttttttaagtgaaaaagtggtgggtgtctgcaaaaaattttcaccgggtttaataaatctaggaaaataagtaagcttttgtagtgttccgataggtatctctgcaaaatttggtgagcccctgatcacttggggagatttatggacgatcaaattttttaaattttttta

SEQ ID NO: 30679 - DNA, 1733 bp, Heterodera glycines
  misc_feature (1675)..(1675): n is a, c, g, or t
atagcttccctatagtctgtactttaattctgcgttggatttttgctccccataattgtttgagtaccccaaacggacacttgaaaaaatcgatttttttatttcataaatattttttcagaaaatgctctgaaacgcaccaaattttatttacatgttagtttaggcactctgatgctttttctatcgaaaagggagatgaataaaatttttaaaaatttttaattcctttttaaacaggccaaaaagtttaggcttaacttttttttcagaaactgatcagaagcgccccaaactttgcagggatactgaaaggaaaagaattaacctgttttatcacattagcttgtcatcagtttttataaaaaattttcaaaattctgcgtctcctattattttatttttttttcaaaattttgaagggcgggggggtgtgcttagtgtatcgtatgccagtcgacattgccaacgagatttccaactatgtgtgtagacatcgcttagctataatttgggcgaccgatcggttagcgcttctaattgtccttcaggtcagagcgcaatttcagactccaaaaatgacctactacaactgaaaatgcgtgagaaagttggatttctcttctcgacatccatagaaataatcaggcaatgtattccatggagaaccatccagaagtggagattcttggtatcatgcgatacctctactagcctaggtatgacctgcaaagcaatattccttttgttgcttaaattatgaccagaaaacttcaaaaactgtttttaaagcattttgggccatatattcataaatgttttttaaacaaatttttgctatttttttaaattaaaatgttgagagaagctccgatcagagtttggaacaagttccaaacgacaaaaccgtgctaaaattatctcttctttaatctacctaattaattttactttgttgatttaaacattctcttctgcatcagttagtcagctaattatgacgctgaaaacagaataagccatgatctgccattgatccgctttgcaattgctattgtttttggtgagatttttttttttaccaatatttagcaaaacaaatactgttgttctgttcaggtgcgatcggtttcagtctgaaattcattttcaaacccgtagtaagaggcttttcctgtggcgacctgtccattaacctcccgtcaattgcgaaagagaccgtccctctcaaatatttctatttgatcgccattcctttcacatttcttatggtgtgttgtcgttaattcaaacacgaacacagattttcatcttgttcagatcacaatcggcgaaatgtgcctgcacatggacccggatgaacgcctttgcttcaaatctgcgtgtcaatggaatttcgatcggaggctctgccaaatggcacgatttatttgtgtgcttttgttgttttttcgtgtcaaatggaatgtagtttaaatgaacaactttttagcaatttggctgctcggcattgctgttgacctgttttgcgtcaacctggtgaagctgtcggtgggcggattgcgacccgacttcatcgagcagtgttacccaacggacttgaagtacaaatatcggggtggacggctgcagacaaacaacgactcgacccatttcttctacttgtacacctgcncaaaggctggacgataacaaacgcaaaatattggactccccgtcgcagtttctactca

SEQ ID NO: 30680 - DNA, 1218 bp, Heterodera glycines
  misc_feature (9)..(9): n is a, c, g, or t
ttttcacanaattcacttcgaatgagtgacagccgaaattgggcgaaagtaaactcggccattttatttgcctcgtcgggtcgaaaaatgccaaaccgtccgaattgactgacagcgaaattttgttggacggcaaagaggggccggaaaatttggttagatggaaaaagctgtaaaaaataatgaattagagaaaattaaaacaaaaattaaattataatgaccgtgagaaaatggcaggccaatggacgcgagcgaattcaatcacttggcatttaacagaatcgacagtcggcacaatgccatccttggcaccaatcttctgaacatttgctggttcattaactttgtgccatttggcatttgctcgtcacccttcgaaatgtgtgcattatcagttggacccatcgctgccgttcaatttcgaccatttcctcgtctctttcgtcctcattttcctcctcctctttcaatgtgccaattgggagcacttcgtccaacttttcctccatcaatttggcgtcaaattcgtcttggccgtcttaattggctttaatcgttcgactgatcaattaattaggtaattaattatcactaatgtcaatgaaatgttgttgcgccgccaaagtgacgaggtcatcttcctgtgaagcgatgagaaaagttgcagcaattcacttgcccattttagcgcaccttttcgcattggtattcctttgagtgaatgccgcccaaaatttgccgaaaagccaattcaatggccaaagggtcgtcggattcacttaaacggaaagtcagtcgtaaaaggaaggcttcatttgtcaggaaatgatggcaacgcacctttggtgggctctaaacaattctttcttaaagaaaattcgccaatttttttcgcttttcgtctcaagcgatgcaattgcgtcaatctgtaaaagataaattgcttttttggatttagttttatcgaattttaccacgcattcggagccaacgcccaaagaacggataaaacggcgaccaacggcaagaaaaaggccgaagccaaacgcatctttgagacaaatttgttggcacaacatttcgcacaattcaaagggggtcgattgcgagtccgataataaaaaacggattaaatgaattttaaactgaaaaggaaaacgaacgattggcagtgaaatgacacggccatcggtcaaatgaatcggcacaaacatt

SEQ ID NO: 30681 - DNA, 2121 bp, Heterodera glycines
  misc_feature (1531)..(1531): n is a, c, g, or t
  misc_feature (1570)..(1570): n is a, c, g, or t
aaaaaaatttcggatttccatataatttgcatccctaaccattacaaacccaatttcttaccagtgtatttttattcaagggctttaagaaataaatataatacaggttaccgtgccacaaaattttctttttttaagaattttacttgtaaaaaattttaaaaaagccatgcttttggccaccaatttctcattccgccgctgtttcctccaatttaaactcggctttccgtcccttttttgtctccgtttcacttcgctctttttgcttgccattgtctccattttgtaccttcttcaaaactccaatgataccaaaagcatttcaaaagcgagcaaatggacagtgttttcgcttgaaaatggccatcaaaatgacagcaacaaatggacagtgccgagcacagaatgccaaagagtgttcggcggtgacaaagcgttggtccagcgattggtgcggcacagacgcaaaattagggacccaccgccgaacgaattggcgatgagttgtgatgcgatttgggcacggcatggagacgaagaattgttggcacaacagcgatgggacaacgacaaacagcaacagcagaacgagaggaggaggacgacgaacaacaatggcacatccattgaaacgacagaattggaacggcaaatgccaatggcattcgcgcgggttgtttacacagtgagttgcaccggcaccggggagcagttcgtttcccaccccctcgccccgaaaaatttttcaaaatttttttgttttgttaaattttcatagttttttttctaggaaaaactaaaaaaaatttgaaagaatttctccaagaatctttttagactttttagaaataatttttttacataaaaatcaaaagtttcccttttggttttttctggaggcgctatgtttagaatgccggttttttctagtttgatgactttttaaagaatgggcggcacttggaatttcaaaatgcctgttctttgctctgttcgaagcttttatttttttcgggaacgaaacgcacgcaaatttttctacaaattttcacagtttccgatgggcccattaattgtgtaaatcatccgattgctttcctccccccccccccgaaggactatctgttcctggagactgaactgctcgtccattacgcgcccaccaattggtactgttacgtgttcgactccaagtcgtccgccgtcttccaacggcgagtgcgccaactcgcctcctgcttcccaaatgtgctcgtcgtggaccaactgtttgacatttcccagcaacggcttcaacatgaacacggcggtgatggaatgcgtgcggacgctaagtgacgagcgaaaagcggtggaagtattttggtgacgctgcaggtgaatgagccggacggaggaggaaaaggggcaacgaacgcaatgggcggggaggacgcgtcgaatacgctttcgaaaaaaaaatttttttttttgaaattattcggcggaattaaaaattgaggtttttgaaatttcgcatcaatttctntaagccaatggctgagaaatattctcaaccattaatatntaatttacatcgaacaatttctagtaaaattccaatttctaattccaactttttccatgaaattaaaaaaacatatttttcgattttttcgagtcaaattttttttatttgtttatgcaccaattgttgaacgcgtacaaacacagccactcatcacacactgttcagaaccatgacgtgcaggcgaagaccaacgcggagatggcgcagattttcacttggctgggaggggccaacgacgtcgaagtggaactgcggttgggccacacgcggaagcgcatcgaatattaccaaagcaaattcaactggacattcgaggcgctccatttgttcaaagatggtcagtttggtgaggggaggggacaaaacaaacaaagggaagggtcaaattccgcaaaagggaaactttttttatacctatgccaaaaaatcggaaaaaaaacttaaaccaaaaatttcttgaaaattataaaatgcaagaaaattcttaaaaattaacgaaattatgatattgcggctctatgttttaatattttagatttattatgtga

SEQ ID NO: 30682 - DNA, 914 bp, Heterodera glycines
aaataatttaattggttaattcattttttatttgaatatttctttatattttattacttgaatgatttgttgtgccccattttggtcccaatcccaacggacaatttgtgccaatggctcctcattcgacggattggaagaagaagcattgccaatgtccgtgattttcaatgcgggataatcggttgtcaaaaattcactaaaatatgtaagtgattaatatagaaaaaaaaactcatgtttgcttaattatatgctatcaatttggttgctttttaatgaaaaaaataattttgtaataataaatttttaaaaaatgaaattacagtgcagcaaattgggtaatttcctcaaacgaacactttccagtgaactgatcagagaatttaccgatcacttgttcataaacaataataaattcgtcaaatatttccattgaattactttaactttaaaacgaattttatgaattcaattaactttgaatatagaaaaaaaattttaaaacaaaacaaatttttcaaaacttttatggtatttaaaatgtaaaaaccttcaaaaatatggaaaacattttttagaaaatgcaaatggcggcaccattttaagagagaggaatttattgaataaaagcatttacaaacaattaaatgttttataaatccggaatgaatttgggtcaacaaaaacctcagcagcagagcattttgggtgatcagtgcggtgctgggacgtagtcaaaaaccatcaaaatggacgttagtcaaaaaccatcaaaatggacggtagtcaaaaaagcatcaaatggaaaatttttgacagaaaattattcataatttcgcataaatggatcaaattttataatctagatatttttcgatagccctaagtgttatctattatcctgcaaaatt

SEQ ID NO: 30683 - DNA, 1538 bp, Heterodera glycines
tattcagtaattaattccaatgttgaaatgaatgggtgaattatttttatattcaccgcaacatcagtgaactgtttatagaaaaaatttgtccttgaaagtctgaaagccataattcatttaagccaaaactatggacatcttttaattaagagcacacaataattgaaatgaaaacaaagcacaaattgctgtgggttgcataaattatgattcagacaaattcattcccaacgagattgagcttaagtgatttatcaataatttttataaacggtatacattctgtaattaattccatttttaaatgaattgatgaatttttttgaaaattgaccgcaacatcagtgaacaatttatagcaaaaatttgtccctgaatgtctgaaagccacatttcatttaaaacataaatatgcgcattttttaattatggatacaaaataattgagttgaaaactgatcacaaattgccattgggttcataaatacgattcatacaaacgcatttccaaaacacgattgagctccagagatttattattatttttataaaaaacagatattcagtaattaattccatgttgaaatgaatgggtgaattattttaatattcaccgcaacatcagtgaactgtttatagaaaaaatttgtccttgaaagtctgaaagccattattcatttaagccaaaactatggacatcttttaattaagagcacacaataattgaaatgaaaacaaagcacaaattgctttggattgcataaattatgattcagacaaattcattcccaacgagattgagcttaagtgatttatcaataatttttataaacggtatacattctgtaattaattccatttttaaatgaattgatgattttttttgaaaattgaccacaacatcagtgaacaatttatagcaaaaatttgtccttgaaagtctgaaagccgtaattcatttaagccaaaactatggacatcttttaattaagagcacacaataattgggcgggagggaagtggggacgaccgcaattgtcatatttccccactgttccgagactcccgggtgtagagtcagcagatgtgtgtcaacttgtccactgttcgtctccagctccacccacgccgtgatctgcatgtcccattcgaggcaagtaaactcctcaaaccgtcgttgtcggtaccgccgcccatctgtagaagaggcaagaggctgttggaagtccgcaggcgttctgccagaaactggtgctacgcatgcaaaacgagtgtcccgggcggttgttcagctcggccaattcgggaatgaccgtctcactccggattgagttgcacatgttgccgcggcatgacccagccgatgggcaccgcttgaccgccgtcgtaattgcgtccggttgcccaattgatcagcccgatggggtaacgaactccccatgccacggctttcgagagcaacttggctcctgacaaaaatcgcccaaaaattgagcagaggcaagcaatgatgccgagcaaaattgcggctccaa

SEQ ID NO: 30684 - DNA, 1808 bp, Heterodera glycines
ggagaaatttttaaaaaaaaattaaatttatttcatttagtcatggatttacacacatgcacatgtggtgtagtggtttaactttctacctttcataatttttcgcctggggtcaatttccccacttggatagaatattcctcacattttctttaccattattttaattaaaatattaattttaaaaaatattccaacttttttctttcatgttaagcatcctaaaaacccaaaacttaatcaattggtcatttttttacaaattctgttaacaaatcgcattaaaaattacaaaatttttcccggcggcgcctatcggcaccgccggccctccttgtcccccaaaagtcttgagaaaaacgtgccgcgtaaaaagcggtgttgaaagcaaaaaaaggtcattgatttacattaatttacatggccggagaccccttcgcaaaattggaaaattggccgctgatcccttgttttgcaataatctgaattttgaggtctacatctgaattttagtgttctttatcctgaatttgaaaaaaaaacttggtcaccctcaatatacatatacttctgaacaattctaatgctaaaaaacaggcactcgcgcgaaaactgaataaaaattttgtatttggaaaattttgtccaaaaatttttacgttggaaaattatggtaccggtaccggtaccggtttttgcagtaccggtcagtaccggtaccggtttttttacaattaccgattaccgctcaactctaatttcaacttaaaaaatgaacactgttgaatttgttgttctgcggacaattatttttgctcatatgggcaagtgaaaaaatttaaatttaattaaaaacaaaaatattatttttacagtttcgccaggacttagtgataaagcacaaaaaatgttatccaccgaagcggagaaatttgctgcacttttaatgagcattttgcaggtgaatagaaataaatcacatgggtattcaaaaaatgatcaagaaaaaacaaatgtttaaattgaattcattttttccaaactttcaattccaattcccatggctttcgtctctaaattcttttccgttccgttcggactaattacggtggcgagggcggtgcccgacggtacgtggaactaatggcactgatcgaattcgttttcaactcgggcgctaaacaccgcgaactgctctcttacctgtccattgtcgttgatccgaacttcgattcggtgatgcccccgtgctggccaaagtgtgtaccaaaggacccgtcgaattgcaccaattattgccctattggaattgggctgaaacatttatcaccacgcgatttgggcccatttttcattgatattgcattaaagccgctgaatatttacatacctttcggtcattgacttttttctgcgtgcaacggtaaattcaatcacacaatttgcttttaggaaattagccatttcttaagtcattacatatatccgtttggatttacattaattgccatggtgttcaaagccgaaagactgaactttgccacaagactcgaacacttggcgatttggaaaacgaaaataaaatgaaaaaattattttcttctatctaaaatagccgaaataaaattatttttaagtttaccatttatcattttaacataagatattagaaaacatattttcaaagacactttaattttctgattggcccaaatgcttgacaattgtttttagaaaaagcttctcactgagagcagtaaccttttaaatgataccaattatatgatttaaatttaaaatttgggaaa

SEQ ID NO: 30685 - DNA, 1001 bp, Heterodera glycines
tcctgggaaatataattttaaatcaatgttttcaattgtaattgtgttgtaaatttccggaaaacgcgcaaataaatctgtcgttttacaacggaaatacgcgttttaggtggtgttttacaattgcaataatatctcctgggaaatataattttaaatcaatgttttcaattgtaattgtgttgtaaatttccggaaaacgcgcaaataaaatctgtcgttttacaacggaaatacgcgttttaggtggtgttttacaatggaaataatatctcctgggaaatataattttaaatcaatgttttcaattgtaattgtgttgtaaatttccggaaaacgcgcaaataaatctgtcgttttacaatttgccggaaatacgcgttttaggtggtgttttacaatggaaataatatctcctcaatgttttcaattgtaattgtgttttaaatttccggaaaacgcgcaaataaaatctgtcgttttacaacggaaatacgcgttttaggtggtgttttacaattgcaataatatctcctcaatgttttcaattgtaattgtgttttaaatttccggaaaacgcgcaaataaaatctgtcgttttacaacggaaatacgcgttttaggtggtgttttacaatggaaataatatctcctgggaaatataattttaaatcaatgttttcaattgtaattgtgttgtaaatttccggaaaacgcgcaaataaaatctgtcgttttacaatttgccggaaatacgcgttttaggtggtgttttacaatggaaataatatctcctcaatgttttcaattgtaattgtgttttaaatttccggaaaacgcgcaaataaaatctgtcgttttacaatttgccggaaatgcggtatttcgcaaaaaatactaattataaattcataaaaatggttccttaactttttgatagaaatggatgtcagattcgtgaacagcgacctcgaacccccccccccccccaggggaggcgt

SEQ ID NO: 30686 - DNA, 1751 bp, Heterodera glycines
  misc_feature (1713)..(1713): n is a, c, g, or t
  misc_feature (1718)..(1718): n is a, c, g, or t
gtaatttagggtctatttaagggggataattactccggaaaaataaagataattgatttattacatataaatgtaaagttgaaagccaaaataatgctggaagataatttttggagaattttgatgagataatacaatgaaaaagtttatgtaaaatttaaaaaaaaaacacagtaaaaattaattaattttttgtgggatattattgcgatttaaatcacaaactcaaaaaataaataaataaatgaaaattttgagcaaaaaaaaaaaagacgacaacaattaacgagaattgactttctttgtgtgcaaaacaagcaaaagttatgtatttgtgggcaacggttgatgagagagagagaaaggtaattattttgaattcaaacaaaaaaaacaatgatagaaatatttaaattgtttttgttagggttgggacccaattgtccgatacccattttgaccctttactttatttgttttctcctttaaaataaatattattatttcgataggaaaattggtcgaaatttcgaaatataaattgtgtgcttgttcggaattggatcacgaccaaaggacatatctaacaaactccgattccggtcccgatttattgaagtgagatccctatcctgacccagatgaaatgaaaatccagacctccaattttcaatcccgacgcggggaggggataattaattgaaattctaaaatttgccactggcaaattattagcatcattataattagtaaattgaattaaaaaataacctcgcttaaaaatgaaatcaatcattgttaatttaattacagttttaaagcaaaattgtttgtttaataaaaaggaaattttttgaaatcaaaattttatctaaaaataaaatcttaaatatcaaacacaaccaactaaaagggaagcaagcgaacaaagatggaagaacaaataacaataattaaacatgacaaaatttatgaccggcaaaattttgggtggtctttttatgctttaatttacaaaatattttattacaataattaaaataaataaaataataaatattaatacaaaaataacttaattaaatgaaattttgcctatttatccatttcccaaggtcactattttctcttttttttaaaagaaaacaatgacgggaaatattttctgtttttttatttaaaaaaatttttatttgtcaaaataatgaaataagttaaattttatttttggaaaagagaataattaaaaattcattagtcatttaacaattaggtagcataattacaatgattagatagcgtaattagaaaatagatagcataattagaataattcggtagcataattagaatatattataattagaatttatttaaaaatatatataaaaaaaagattaattccgaaatttcaacggcattttttttattggtgtaaagtttttttttatgtttgccatttgttgctgagcaaataaaccaccatcaaaaggaggggattttctcgacgaaggtcacaccaattgctgttcccgagcccgccaattgcgcaacacaaaggcactctcagcgggaccatttttcaatgattttgggcaaaagttgacattttgtgactatcggaatgctttttttttgtttcatttaaaacggtttcaaagcttgttttaaaaattgaaaacatataaaaaaaattcaatagagaaaaattanaattntctaaaatttattttcggatgaaaatcaaaaaa

SEQ ID NO: 30687 - DNA, 1557 bp, Heterodera glycines
ccaagtgcagtttgccctgggtgagcatttggcgtccgtcagccgccttcactgtctccgcacattcgacggtcaccgtgaaaatggcatgggaacgactgctctgctcgttcatgcacgtccgtccggtgtgccctaaggcgggaaaaagacaaaattatgcaaaaatgggcttaagaattagataaatcgttaataaaattattattttttattgaattagaaatataataagcaacattaattagtgacaaaaaagcttacatctaacaataaacttttatttttaatgaattttttaaattaatttcactaatgtgtcaaaagatgttatttcttaagtttttcaagctatttagattaattagaaactatatttaggacatgggcgcagatgacactttatcaaaaccttttacaaaaatacgtacctatttaaaaaataaataaaaatttgtatatgcattaaattgccaattgattcgagtgaaataacccaaaaaactaaaacatttgcccaaaaagatgtccaaaaatataattatttttgaatattctgactgttggcgttgccgagttgcatgatgcgtaggcactgctccgcgctggccaccgtcacgttcagcaaatcgcgcacataaacgccaatgtcggccctctctttgatgtccagccgttgtgcgcctgcggcgctttgcttggccaacaaatcgcgcacctcctcgttgtaaatctccatgtaggagatgcggaccaagaagctaacaaaaaatgacaagaggatttaatcaatgaaaaatctggcagacaagttttttggtgataattaaaggggggagtgattgaagataatgataaggttgttttggtcatgaatatgcaattacttttggtcatttttgtttttctcaaaaaactttcttctttgcaaaattaaagggtccttcctctctttatcaacgaaaaacttcaatttctttgaccctcaaattgactttttgtcgacccctaatctaaacaattgccaaaatatgtcttcttctgggcatttatggccaataattaatgccaatgaggcagaaaaaaataaaatagacagccaattttagtaaaataattataacaaacttaaaaactgactgaccgtttgtcctggtggcatttggcgatgtggtcaaaaatgtgcgcaaacgcattttgcgtcactccgtccgcctgcccttcgccaccggcgccactcattgtgtacgttttgccggtgcccgtctgtccgtaggcgaaaattgttcctgaaaatgggaaataaatgccaaatgtcgagaagaaacctcaagtttggcaccaatcaacagaaaaattcagcggatattaaattccagagggaaaacaaatcaaatctgacccatctattgtttttgtgatgcaaaagatatggtaatactgccgatggtcccccctttttggaatataaatttttgttctaaaagtgttaaaacatgttaataggggttttagggtcgctgatcacgaatctgacattcattttgaccaatttcg

SEQ ID NO: 30688 - DNA, 1769 bp, Heterodera glycines
attagtaagcatttgtagtgttccgatacgtattcctgtaaaatttggtgagcccctgatcaattacaaattatttatggacgatcaaatttttagaaatttttatttatttttgcataatcaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttatcttttttttcagaaacttatcagaagcgccccaaactttgcagggatactgaaagaaaaagaattaacctgttttatcacattagcttgtcatcagtttttataaaaaattttcaaaattctgagtctcctattattttatttttttttcaaaattttgaagggcggagggggggcgaaggcccaccacgaggccgcgaagcggccgagtgagtacctcggtgcatgaaaattattaaggaagagagttcattatttgtttattttttgcataattaattcataaatattttttccagaaaatgctctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaattttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccaggcgaaccgatgcgcccagatttatggggagaccgctgtggaggggaatagcttccctatagcctgtactttaattctg

SEQ ID NO: 30689 - DNA, 2405 bp, Heterodera glycines
  misc_feature (27)..(28): n is a, c, g, or t
  misc_feature (66)..(66): n is a, c, g, or t
  misc_feature (2318)..(2318): n is a, c, g, or t
  misc_feature (2326)..(2326): n is a, c, g, or t
  misc_feature (2393)..(2394): n is a, c, g, or t
taaaaatggagaaaaatcaggagaatnntatgggttttattgggggtttttatcttctaaagaaanaaagtatttccagaatttctggaaattttcgatttttcagaaaaaaatttatatctcggttcagaaaagtcattagggaagagtaaaatactacaaaaatccgcaattttttgctctattatataaattttatttcatctttttatcacttttttgagagatgttacaaaaataaaagtgattttgggattcgggaccaaaggggggtgggtgcacatgatttttgagtgggaaaatttttccatcaaaaaccatccaaaaacatgtctttaggggttatttgggccgctgatcacgaatacgtgatcagattttacttttgacatagtcaagacctcagaatccctgtgtgatttgggattctgaggcatcatttttggggggggggcgaagttcgagtccggacggtgtaaattattttctttgtattttttgggttaattttcattacttttaataaatttaaatgtttggttttattaataataaatttttttagtttaattaaattattttttgatgaataatgattttcatttaaattatttattatatttaatcaaagaatttcagctattattttaaaatttaattgtaaaatttttttcatttcaatttaaataactattcaattattatacatttcataatttgtttttcattaataaaaagtgtattatattttaaaaaatgaaaaatataacacatcgattttttatctattttgaataaaaacaattccttaattaccgtaaatgctctatttgaatgcccactttctaatcactgttgcacctcttttaatctctgttgtacctcttataatcactgttgtacctcttctcatcattgttgtacctcttttaatcactgttgcacctcttctaataacagtttacctcttctaatctgatgtacctcttctgatcaccgttgtacctcttctgatcaccgttgtacctcttctaatcaccgttgtacctctcctaatcactgttgcacctcttctaatcatttttgtaactcttctaatctctgttgtacctcttataatcagatttgtaccccttctaataatgctgtacctcttttaatcactgttgtacctcttctaatcactgttgcacctcttttgatcactgttgcacctcttttgatcactgttgcacctcttctaatcactggtgtacctcttctaatcactgttgcacctcttctaatcactgttgcacctcttctaatcacagttgtacctcttctagggcgcgaagtgcctgcccaagcccaataaaatttgaaaacgggtgcgaagcgcccgtctgagtccaacaaaaattgaaaaacgggcgcgaagcgcccgtctggccaaaacaaatttaaaaaacgggcgcgaagcgcccgtctgagcccaacaaatttaaaaagggaaacgaagcgccctttacctctatttgatcaatcccaaattgcttcggatccaacaattactccacaacccataaataacgggcgcgaagcgcccgtccgactcaacacaatttaaagaacgggcgcgaagcgcccgttcgaggacgcgaagggcgcgaagcgcccgtcttgagcctcgatgtggacttaaagcctctaataattttttaaaaattcaaaaaaatctctccaaccaaatcgatcaatttgaatcgcttcacagtctaggtagcgaagctcccaaagcgcgaagcgctttttcccagctaaatagccgacggttcacgcacccgctagttaatatatacgttatattgacaaggagtttcgtttcaaaaaacaaaatctcccggccgaaggccgggagcgccctgaaagtagtggaaaggtcttacaactttttgaggagaatccgggaaaactatagagaaaaattctgcgcggacgactgagtcccggggaccgatttctcattttttcgtgcatttgggggcccgtaactttttttctaaaacccaaatcaaaaaatgtctgctgtgagggggctaagttgaagtgttttctaaaaaacaaaaaaaattccaagcctctatctgcaataggaaaggctgtaggttcgtggactttttcagtaccaactttgtccagttcagtcccggttgaataactcattagggtttgatctgggcggggagttaccagcagacttattgtagagttcaatgagctggatttttccagtttttaaaatttcgaaaattttcaaaatttttcgagctaggctnaaaacggnttttccgggtttttgaattttaggaatttttaacgaattttcccagagaaacggagaccacttccannacatagttttt

SEQ ID NO: 30690 - DNA, 1339 bp, Heterodera glycines
tcgtgcgagtgaaaagcaaaaaagtcatgtgtaagaattatctcccaccttttccaagcagtccatccatttctcatcctgcacgcttctctcgagatcctgtcgcatttttgtcagttttttgatttttttatagaaaggaaagcattgtttgtgttccggatttaaatggagacactcgcggatttgacccatagcattctccacgtcgccaatctacagaaattagcacatggttttttgatagccaaatacaaaatacctcgtaataaatctgactcaattccaaaaaagtctcagtagaatcaggcacaagtctagcaactgctcgaatgtccgctattgcattttgtgtgtcaccacgagccaaacgacaccgactccgtttcctgtgtaattcggcatcccattggcagtgctagacaaaagtggaagtaaaaaataaaatttatattttcgagacctcaattgcgtcgttgaacatttgctctgccgagacatagtctctgctgtcaaagtggcgtagcccatggtcgatcaatgtctgtatgtgattgattttttgcagccgttcatgagtttcagcattgtcaggctcatgtccaagcttaaagaaagttagtcaatgaaaactaaataaacagaaaaaaaggaaattcacagcaatttcaaaatccgcttgagcctcttttagatttcctttcttgaacaataaatttgctctctgaattcgacccttaataagaaaaaaagattaattattccttttttcaattaccgctacaaaatcaggcttgagttcaacaactttgtccaagtcgggcaaagccgcgttcactttcccacttgccaaaaaaacggtcgccctgcgataataaatttgataatcggttggatccaaagcaactgcttgatgataatgctagaaaaggaagtttaaaataacatatcgtctaaaaaacacctgaagtgcttcttggaattgtcccttagacagccaatgttttccttgttcaagatgtttctcaatttctttgcgttgcgaagatgctaaaaaataattctttttttggtttgttataattaattatgaaaataccaaaatgaataagagtgaacgaaataaaagacaaataggaaatcggaagtattggaagaggtagaccaagaacgccaagaggaggatttagccactcgtaattgaaatttaccatatctaaaaagaaatcattaactaaaaatgaaatttacatttaaaaaatgccattaaattgataaaggaaaagcctacatcaattgcttgataggatacgtaatcgtaagcataatcgatgctaat

SEQ ID NO: 30691 - DNA, 1595 bp, Heterodera glycines
  misc_feature (185)..(186): n is a, c, g, or t
ccccccccccccccccctttctttgttttacccaaaacgtagcgttctttgtcctccgccgctttctctccccatttggccttctcggattcgggcaattggcgccattcatcgcctgaatttgctgggtgtgttaaacggcaaattagttttgtgtcattttatgccggcatggcactggcaanncccatcgattttcgagcatccctcgccagttctaagccagttaaaatcccatggctaaaatggtttttaattgcttgcacgacctgcgatgacggccaaatccggttgggtcatccccggcttgtagaaacggtcacggttttcgttcatcctaaaatttttgtttcatcaaataatccgttacaaattaatatttcacaaaacaattggctacagtaccaaagaaagaatgacgattgggcgggcttcggctcgtcggtcatttttgaaatttttaaagaaggaatttgttaaaagctctaaacatttataaaaaatcaggcagaagaaaatgaaaatgcataaattgatgaatttttgtttgtgcgcaatttgcccatttatacgccaatttcaactgccaaagatttttggttgcttggaaatgccgcgtaaaacaaaaacaaaaaaggaagaaatacataacaaataaacaaatgaatgatgatgatccacggattttgtaactgacaaatgaagaaaagggtttcctaagaaaacacccgccgacccttcgccggtggcgaattgtcgggggaaaggggagaaagggggggggggcatcaaccaaagatcaacacatgagacgatccaaaagtggccacaaaacatgaattgatcaacggttctgtgggggatctccgaaaattgggaaattagctaacggtcagctgccaaaatgtgcgagaggaatattaaaattcataaccaaaaaaaagtgaaattaaactctgctgctgcatgaattaaaaattttgtctaccgtaatccacaaatggcactattgtaacaccagtccctaaagccaacttcactcactttctcctccatttcccctcggggaaggttttgtagcactcccaaaagtttgaacaaaaaatgtttatgaatgatggaagacaatgacatggccatgacttcacagtacaaagagaggttgatccaaatggatcaaaaggtgatcatttgttcctcctccctcttcgtcttcattttgcaatggccttcagcggcgattgggaggattgtctacctgaaaaatcaaaatttatataataaaaaatatttttcaattttaaattcacacggaacccatggatttttttacctcatccacaactgcaccaacggcacttgccgttgcaactccggcggcaacggcgccaattgccttaaaatattggggagttaattttttggaaatgatttttgtttcgacttcagttggcgcccccaccgccgctccaatcgctgcagccgcctcaaaaatacataatttgcttagatttttggtttgttttcgaaaaaattcacctgagcgggcgcagacgcagcagtagcagctgccgccccacagccattgctgactc

SEQ ID NO: 30692 - DNA, 806 bp, Heterodera glycines
atttcgttaagtttcaaaaaagttatggttagaggaactcaaaaaaccttgggtttcgagcatttttcgagcatctttgtcgctaactcttttgaaacttgatgaaattttttgaaattttgtagactaatagagaacacatagggctatcgaatcatatcaagaaataaaaattcggttgcttttcagctaagttacaaataatttttcatcaaatcataatgatggttttttaagtaacgacatagcaccacgcaatattgttgcgccgcgaaatttgcgctgcggacatttgcgtctcgacacttgcgccgccaagcaaaaatggatatttgagccgctcactcaaaaaaattttttttacgattttttaacgaattttactcaaaatattgtgcaactacaaaaaagcaattaaaagaaatgcaaaaaaaaaaaaaactaataacaacgatagacaccagggatatgggctttcgcgtttcgctttcgcatatttcgctttttttggtactttcgagtttcgcattttgtcgcgaaacgcgaatattacaaagctaagaatgagggatgagttgcccctaaaatttttcaaaatttgataaataaatcgactaattttcagtgaaaacatgtttaaaatggtcaaaatttccaatttctccccagtggcgtcaatcggcaccgcaggacccgaaaaactcctatttttaatagtaaaatagtccaaaaatcgcaaaatttgatcattttttagtgaaaatctgttaacaaattatgttcaaattttcaaaaattttcccggc

SEQ ID NO: 30693 - DNA, 1641 bp, Heterodera glycines
  misc_feature (67)..(68): n is a, c, g, or t
ttatggttttgtcagcggaagcggtcaaaaaattaggcacgggtttggcgggaacaaccgaaaacgnnccacacggagcaggtatggccggacagaagtccaatgccaacttcggaaccatcctcgaccagcaaatcggcgacgggccaaaccaaagccatgtgatcctcaaaatgggggggggggggttcaatgtaatggagtaacaaaacaaaaatgcgctttttggagaaaagtctgacaataaatgtgataacaaaggtacaacatacccatgaaccgctcatgagaaggcccgtgttttcgtcataaagaagtgtacagactgaaaaataaagtcaataggaaattggaaaagtaattaccattcgatttgtgtccctgcagcactttcagcggttctttgaatgcgtttgatggcgaaaaaattgcaattgagccatccttccgaccgacaaatacgagaaaacctttgacggatttggcggcaacagcgacagaatttatcgagaggcaatccttttggggaatcgtttcgcaattctcgtaaatgtcactgaattagggatgggaaacaattaaaaaaatatcgaagtcaaattaatttccggcatttacagatttaagacccccgatgcttacagttgggattcccaaaaaaaccaaagagggacctttaggctttttaattttttgtagtaatagatgaaaacttgttccctgttgttttcagaatcgctgatcagaatctgatatcaatttcgatcaatcccaaactcgtatttaaacaaaaagtcgaaattcttttttcgagttcgattttcaaatttagattagggattcaaaaagttggataagttgtaaaagtgaccaatcccaattatgaaatttgggtaaaaataattgcatattaatattaacatggcaaaattaaaaagaaccgttttctccaaattttcattagtccgtcccttccgccagtgaccaaattgccatccggcatttccgcgacacatttggcatcgtttggctgatgagcctcgataattgcgctgatagtaaatttttccagcaaatgttcgctgcttttgcttgtggatgcttgcaagtcttgctgtccattgggaagatccatcttagagcaaaagtaaaaaaaattatttgttctccttggttttatgatcatcaaatgacaaaatttggttttttaaatcatctttttcattaaggcaagactaatttagattggtattgataatttaatttggtaatgaataaaaaattcaaggattaagagaaaaacaaattaaaatttgaaaatcatcatttggaatttgagtgcattaaatttaaaattttgaataatatttaaaatgtaatgccaaaatttatttaaataaaaaattatgtttaatttaagttctgctttttttaaactcttagttaatttggctcatgtgatagtccgtgttttgggatcatctgtgggcttcattttaacaacagattctaaccgccagcgacaccaactgggtccgggtttaggttttgaattgatagtgaacataaaaaccgttattaaaaagtaaaagtcttgttttacacaccattgttttaattatttttgtttgggactctaga

SEQ ID NO: 30694 - DNA, 1073 bp, Heterodera glycines
accggcaggcaatgatagctttaatctgcaagaaattagattggcaataagtggttgtaaaaaacttttgggtaatgaattattttttgaagtgagtcaaacaccctattagtgctttgctgtgccgagaccggcaggcaatggatagctttaaatctgaaagaaattatattggcaataagtggttgtaaaaaacttttgggtaatgaattattttttgaagtgagtcaaacaccctattagtgctttgctgtgcggcaatggatggctttcaatctgcaagaaattagattggcaatatgtggttgtaaaaaacttttgggtctggaattattttttgaagtgagtcaaacaccctattagtgctttgctgtgccgagaccggcaggcaatggatagctttaaatctgaaagaaattatattggcaataagtggttgtaaaaaacttttgggtaatgaattattttttgaagtgagtcaaacaccctattagtgctttgatgtgccgagaaccggcaggcaatggatggctttcaatctgcaagaaattagattggcaatatgtggttgtaaaaaacttttgggtatggaattattttttgaagtgagtcaaacagggtacatgtcaactcgccgacgccgactcgccgatggtcgactcgccgacgccaactcgccgatggttgactcgccgacaacacgactcgccgacgtcgactcgacgataaattgtgcaaaaaatcgtggaaaatttaattttttttaatttatcgaaaaagtcaaagacggattgccaaacataataaaaaccaaaatgaagtaatttttgcattgtaaaaaaataaattgctgtatgatcagagataaaaacgcgaatgcaaacaaaatttttatactggcttgggtttttggctttcatttggctacaattttaatgtttcctcaatttttttttgcacatcattcggcgttggcgaggcgtattattggcgagaattcaattttttcaatttttgtctttttatctaaatagggcaaaattaaaatttcgttttaaaaaattaattttttt

SEQ ID NO: 30695 - DNA, 1146 bp, Heterodera glycines
  misc_feature (46)..(46): n is a, c, g, or t
tcgctttcagtaaatgcatttaatcactgcaaaaaaacaaatattnaataggatgcgtgacagccaaaaatactgagccgcccatcgttctattaatcaaggacattcacaaagtttcggaagatctcttccgaccatttgactgcaccagacaaaatgacttcacgaattttggttattggttcaacaaacattgatgatgctgaggcgcataatatggtttttgacatgtctatttttggcaaatgtgttgaaaccaatcttcccatattctcggaacgtgttcaattagtcaggtaattggcattttgagtttggcatttattttttctacctctacaggaagtacgcattggtaaaggagatctacctcacggaaaatgatgagaaagaacttgctcacgacacaaattctctttctggattaagtaagcaatcctttttattaaaatctgcttctattattcagtttataccgcaaaaaatatattttgaactttatcgaaattaacatttataactctaaatcgtcaaaatggtttatttgttagatttttcgagtaaaattttatggatttagtagcttttttaaatcctgttttgaaacttgaaattgattctgattcgtaatgcaatattctgaatacgtgaactttatatgaaaaaatattttttgccttttactgcatatgagcattaatttgaagagctcgagactacttgtgcgcgttaatattggttccagatttccctcaaatttaggtttgcacgaggcatgccactctgcagtttcaatttgttcatcttcacaacttacatacgtttcagcgcttccttcattagggagattaggacacgtacgctataaatgtttatgtttttgttaattttattgccttcttaggtaatggcgttgccggacattgaaaagaagactgtgaggaaaattgatgtcttgaatgaaattgactatctattagcggggtatattggagaagaattgtttcttgaaaataaggaacgagtaacaaccggttgcagcaatgacctccagagggcgaataaagtaaaacaaatggaaaaataggaaactctctaaatcaatttaagttggcagaaaattatgtcactaagtggggattctcg

SEQ ID NO: 30696 - DNA, 2096 bp, Heterodera glycines
  misc_feature (2021)..(2023): n is a, c, g, or t
  misc_feature (2065)..(2065): n is a, c, g, or t
gccgcttttgcattctttccgcaatgtgaccgttcccttccccatttttcacacgtcgagtttttgaaaccaccagtctttttgccagtgacttttgcctccgcatgaatagcagggctgatcacgttggtccacttttcctttaggtgccgttgaatttttcggcaggaaattttggcctttgtggctttgctgcggcttcgttttgggcttctgcttgtccttgatctgctgcggtttggctcggatggcactggtgctgcagggatttgagccgagggagagcgcgctttcctttagaatttggtatttgcggcactcttctcctagctcttgcagtgaggttgaccgtccgctcgttcgactgtcttccaaacgctgaaggcatttttgcctcagatcggtgaattcgtcgcgcaatgcaatgatgagaatcatgcatttgagctcctctttgctcagcgaaagatctgcgttttcgcaggacgagttgatttgtgcaatcaaacttggaacgtcctgttgcgcttcttgacgaatttggaaacaatcaaaacgacggagaaacaatgatcgggtttctccaaacaatttttttaattttgcggtcgtctcatcccaattgaagtcgttctgcgtctttggtgcgatgctgtcgcagtaccgcttgtactccgcttcgcccaatttgccaatcaatagttggacttttgactggccgctgagtgcttgtccatcctgggcgatggtctgcccatagcgcttgagccaaacgtcgtatgtatgccctaactcagggtcatactcaaatgtcgaaaggcgcgcatcgattgatgtcgccaatgcagcagaactgttgttttgttccgctgatgccttcaaaacagcctccaaaatcagtttaagctgattggggtccatcaaatttggtgattagccaaccggcttttgtcgaatttgtcaagccgactcggcttttgttgtattttgttgagagcagtcccggctttagaagaataagcagtttcttttcactgcgttatgacgaaattgacgagccacccggcttttgtcgaatttttgctgagccgacccggcttttgacgaattttgatgagccgaccggcttttgtcaaatttgatgagccgactcggctttagacgtctagcagtttctttgactgctttttgaggaatgtgtcaattaggctttaaaacaattcacagccaatcccggcttttcggtgaatttgtttgccgtctcggcttttattccttaaaacaaaatttgatgcctttttctcacccgaagatgtagagcaggtcctttgctgactgcgccaaattattgtgtatttactacaacaataaaaatgtttggtcttcgaccaaaacaaatgttgtcaaataaataaataaataatttattaatggaggacagcagggaataaataaataaaataatgaaatggtggaatgaatgggagaatgcccggagtgggggaaagggagacatatttatggggctggtcaaggggcggggcgagagacaataagagagggagtgaaagggaaaatataatcaataatcggtgtggtcccttatccaacaacaccaaaacggcaaaatgccaaaaaaggcatttaacgaaaatctcgaaaaaggcaaaaaaaaaaagaagaataataaaagtcaacgtaaaagcttcaaaccaagtggaaaatgtgttttttatgctcaatatatcggaactaatgcgcagaaattggcatatgccctcaaattcggtctctaattataactttatttttcattttttcgacctcgttactttgtgtggcagcccgactcaaatgactttgtccgagcagactttggcataatacgcagaaccgaagagggttcgctcattttttaggtctttcccttacaatctcaacaaatttagcgggtcaagatttttcctaatttgccaaattttactttttttcaaagttaatatcctaatacatatgaattnnntgaggagctttaggacaatcaaattttatagacattgatctngagtaacggacatgctaagcgttaatattct

SEQ ID NO: 30697 - DNA, 928 bp, Heterodera glycines
aattttgaagaggctctccggaacggattagcatcgcgggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaagagatagccatttttctgagaattaattcacaatttccgcagctcttagggtaatggaaaaaattttgaagaggctctccggaacggattagcatcgggg

SEQ ID NO: 30698 - DNA, 1022 bp, Heterodera glycines
tttcggaatttccttgcctaaaatcacatcccaattgaagcatagagcaaaatgatcaaataatataaagacaattttctgaatggcctaaacacccaaacatttaaagcagcacaacacctggtcatctttggcctccttgtagccgatcacgtacagtccaagctgcactccgtagagcgcgtcgtcactgatgtgccatgtctggtccatgtagttcaggtcggggttggtgaagttgcgcgggtaccaagtgatcggcatcacctcaaaaacattgccattaaattcattcagtgcagtgaaatacggtatcagactgagagtattacataagttttatacggtattttgacaaggatttgtcaagtttatacggtaatagaatgaagttagttgttagtacggtatcagactgagtcggcggtgttaagttttattacgctattttgtctactcgatatggtattagaataagagttggttgttaaatccagtacagtatatggatgagttttgttttttatacggtatacgactgattttatcgtttcccttgaccaacagtatagcctacctggtatggcatcgggtttttgtaccagtcgtaaatgttgccgatgtccaatcgcattgggtccaacgttggaggcactgtacgaaatattgaaatttcaattaaatttaaattaaattcgcatgccgaaataaatgtatccaacgaatgctctttcgtcatttgcgccctgactttgcggttggaaatacacagttttggtgccccagtcgtaaattttcgggatgttgcaacgggccatcgccggattgagcacagtgcaagaagcggtctgaatttgctcagaaactgatgaaaacgccataagctttctgatcaccaaggctggaaaaatgaattgaaaattcttccaaaaattgagccgaaaataaatagaaaaaaaatttgaagcgaaatatgataataatctttaaatgtaatattgattgataacatggatcatgat

SEQ ID NO: 30699 - DNA, 1274 bp, Heterodera glycines
atttgtccattccaattttaatcatattgtcgctttcccaatacattcaaagatgttcattttttatttcttagattcccttagattttcataaaaatttacattttatttatgattttttgttaaatttttaacatcccccaagggttaatggaggggctaaaatgccaatccccagggttcgggaacagagttatcgggaaacagggaattatacctcaatgccaagcaatgcaaaaaatgtatacttataatttttcattcaaagggatactttttataaaataactaaaataataattgaaatttattaaatgttttgaaaaagcaccattttgctgttttcgctacttcatttttgacgtgaaaatgccacgagttcctgtattaaatgagcctatttaattttctagacaaatttaccagctcaattagaaggaaaatatgaaaaacattaaaaaaagaatcaaaactttcatattgtgcttaattttaagtaattttaaaaaatcgttgaaattttgttaacccaactttatattaaattcgcgaaaaaattcaactgatttgcgtatattgttgtatattatttgtgcattttattagtcaaaattttaataattttcatttttaagttccatttaaaatgcgattttctgtttttatttttgcattttttatgtttttgcgttgtttcgacagcaccacggcgggcgtctgctttagcagtatattttttttggatgatcaaattaatttaaagaaaaaatatttaaagtaacaattatttataatttttgtaggccaaaagatcaacaatctatgaaattatgaaaaataaaaatttttgttaatttaattaagaaattatttaggccaaaaagaagagcattcaaatccgaatcgaagacaaagtaatgaagaatattatataatttatttataaaaattaaaaaaaaataaaataatctgtatcagatcaatttttagcgatgcaaataaattttcacaagataatgatttaatcttttctacgccagtaaagaattttgaaaaatttaaaaatcccaatgccttttgttgacccggccagactaaaaaatattattttttgaaatttaacttttaaaaactgatattccctttttttcactttcatccaaaacgaattatttaggtcaacaaaatgaacaaaatccgagttcaaattcttcgagttcaagtttttggacttcaagtaatccgacgggttcaagttttgcgagttcagagta

SEQ ID NO: 30700 - DNA, 850 bp, Heterodera glycines
aactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaaatttttaaaattttattcacctccattattgatagaaaaagcatcagagagccttattaacttgtaaataaaatttggtgcgtttcagaaccctttctgaaaaaatatttatgaattaattttgcaaaaaataaataaaaacgaaagactcagattttcgaaaattttttttgagccagctagctcggcgctcatttcagtgtaagttagtcctttaccggggagtatccctgcatagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtggggccttcgcccccccccctcccacgcccttcagagcacgacaaatatttcaacaaaaattttgaaatcat

SEQ ID NO: 30701 - DNA, 1881 bp, Heterodera glycines
agaagtcctcaaattttagcctaaagaattgacaaaagcctcttagaatgaaaaatttcaaatgtttttaaatttgaatgagtttcagtgatttatattaaagccttttgaattccaaggaataaaaaatttcaaaaaattttaatctttggacatttccaaaaagaatataactcttaaaaaattggaactttatgccaaaacataaaaaaatggaaattttctatttttatgctcaattttcttcaaatttaataaatttagctttatttagtattttttttcttctaaaatgattttaaagttaattttttcattttaagcaaacaaatatttaaacaaaatcaaaatagacacctttaagctgtagggaccaatgattacccatccggcactggaaaagacaaatggtcaaattacagtataataaaattaaaactaacaaaagaaatccacagtagataattatagcacaaactaagaagcgcaaaatggacggcaacgatttgcgcaatgtcagaatgatgacctttaaaattggagcaaaagaatatttgacttccaattaaacacccgataaattcatttagaattggggtaattggtaattattgtgtaattaactaattatggaaatgcttttcaccacaacaaatacaaagaacggacattgtattgggagaagaaagtgaaatagcggagtaggccaaagaacaccaggaacacgccgagaccgagcagtacaccggtgagcgtaaacagtgccgagtcaaagtcacggaattggatggacgccttgcagacggtgccggcgatgagcaacaggtcgttctgtttgtatattcaaaagttaggcagaaatatcagcgattttctttgtctgatcaaaagcatatatataatgtgcaaaaaagggggggaaatgaaaaaatgcctatatcttaacaaattcggtaagatttttctaatggcggttcgttaattaataaattttcaaattttccaggcagcgcttgtcacattatcaccgcgccgtaccctcctctttcccaatggtttttttgaaaaaagcgcggtgaaaaatttcagggtattaagcccatgttcctttggttcataggtgaagaaggggtgcgccagggcgaggcccatacgacgaacgattggcgcagggggggggagtgtgtcaggaccaatttttcgcacgaatgttcccaattttctccggcgacgaccttttttttgctatttaaaggagttttgggtgtgccggcaccagggctgggcgcaactggcttttcaattacggaaatccgcaatccgcaattgcggagattttctgttacggaaatccgcaatccgcaattgcggagattttctgttacggaaatccgcaattacgggggtccaaaaaccccgcaatttcccgcaatccgtaatcagcaattttcaaaaatcaattttcgtcagaatttttgaatttttttaaatagtgaattaatgaaaatcaaaaaacagattttcggtatgtatcttcttattttgattcaatattacatatattttttgtgtctgaaaaaattaattctttttggatttttagggttcatttttgaaaattttttgaaagtctgatcattataattggatttatttatgtatattgttatttcaattttaacaaaacaaattaaaaataattaaatctgatttttaattgataaataaatcgaaatacgggtagccctttaaataaagaatagaaaattttttataaaaataatcttacaagaaatcgtctcgaaaagtaatccaaaagtcaaattacggatcaaaattgcctatgtaggcaaaaatccgtaacccgcaatccgtaatccg

SEQ ID NO: 30702 - DNA, 1012 bp, Heterodera glycines
taattgccgacgaatttgcgctaattagtgaaaatgccctacccagtgtggcattttgccaaacctttccatcgcttcgcttctccgattcgattggcgcttttcctcccctccaaaaatgagttctcccaattttccacccaataaaagggcatttctgtgcgcaaaattcattttcagttcgcattcgctccatttggcgttctgttccaaagtgtccgttgctcgcaccgtcaaaataaccttcaaaaattggttcttttgttaatttttgagcttctctccctctaattcacctcatttaaattagttggcacttccttggccaatttcaattcgcctgtggtgccattcaatgcgaataattgcagtccgttgccagaatgaagggaataagtcagctaaattcacattttaattagcgggcaattaaattgattagccattcagtaatgacctgcccaaattctccattttccgaattgaccgcctcaaaaatatgaagcaaaatgccaaccgaaaagttttcgtcaatttgtaaactctaaaaatattattttttattttaaaataattttgtcaatttggcactttttgttgtttttctccgtcacacgaaataaattgcggtgccttttccttttccgctttccgattcatcttcaaaatggtaaagtcggcagcatcagccgattcgaaaagactggccgaaatggtcaaagtgaaaggagaagcgagtcgctaaaaaggctaattagagaattaattaatgatggaatgtttgcctccggcaatggacgagccaaaatgacatttccgctggaagggtcgacgcggaaaacttcggcagttgccgcaatgtcatcggaagaatgaagcgaatattggaggggcgaaatgctaaaaaataattaaagaaaaaccgaaattgcaattgcattaaccgatcgttttcctcttctttgtcatcggacatttccaatttggcatttgcttggaacagccaccaaat

SEQ ID NO: 30703 - DNA, 1860 bp, Heterodera glycines
  misc_feature (13)..(13): n is a, c, g, or t
  misc_feature (15)..(15): n is a, c, g, or t
  misc_feature (29)..(29): n is a, c, g, or t
  misc_feature (58)..(58): n is a, c, g, or t
  misc_feature (64)..(64): n is a, c, g, or t
  misc_feature (69)..(69): n is a, c, g, or t
  misc_feature (76)..(76): n is a, c, g, or t
  misc_feature (80)..(81): n is a, c, g, or t
  misc_feature (83)..(83): n is a, c, g, or t
  misc_feature (90)..(90): n is a, c, g, or t
  misc_feature (95)..(95): n is a, c, g, or t
  misc_feature (100)..(101): n is a, c, g, or t
  misc_feature (104)..(104): n is a, c, g, or t
  misc_feature (106)..(106): n is a, c, g, or t
  misc_feature (112)..(112): n is a, c, g, or t
  misc_feature (118)..(118): n is a, c, g, or t
  misc_feature (120)..(120): n is a, c, g, or t
  misc_feature (124)..(124): n is a, c, g, or t
  misc_feature (130)..(130): n is a, c, g, or t
  misc_feature (132)..(132): n is a, c, g, or t
  misc_feature (136)..(136): n is a, c, g, or t
  misc_feature (142)..(142): n is a, c, g, or t
  misc_feature (148)..(148): n is a, c, g, or t
  misc_feature (159)..(159): n is a, c, g, or t
  misc_feature (162)..(162): n is a, c, g, or t
  misc_feature (176)..(176): n is a, c, g, or t
  misc_feature (178)..(178): n is a, c, g, or t
  misc_feature (186)..(186): n is a, c, g, or t
  misc_feature (203)..(203): n is a, c, g, or t
  misc_feature (217)..(217): n is a, c, g, or t
  misc_feature (223)..(223): n is a, c, g, or t
  misc_feature (225)..(225): n is a, c, g, or t
  misc_feature (230)..(231): n is a, c, g, or t
  misc_feature (233)..(233): n is a, c, g, or t
  misc_feature (235)..(235): n is a, c, g, or t
  misc_feature (242)..(242): n is a, c, g, or t
  misc_feature (265)..(265): n is a, c, g, or t
  misc_feature (267)..(267): n is a, c, g, or t
  misc_feature (269)..(269): n is a, c, g, or t
  misc_feature (277)..(277): n is a, c, g, or t
  misc_feature (279)..(279): n is a, c, g, or t
  misc_feature (288)..(288): n is a, c, g, or t
  misc_feature (291)..(291): n is a, c, g, or t
  misc_feature (296)..(297): n is a, c, g, or t
  misc_feature (299)..(299): n is a, c, g, or t
  misc_feature (303)..(305): n is a, c, g, or t
  misc_feature (325)..(325): n is a, c, g, or t
  misc_feature (330)..(330): n is a, c, g, or t
  misc_feature (339)..(339): n is a, c, g, or t
  misc_feature (342)..(342): n is a, c, g, or t
  misc_feature (347)..(347): n is a, c, g, or t
  misc_feature (368)..(368): n is a, c, g, or t
  misc_feature (1649)..(1649): n is a, c, g, or t
ctcaaatatttcntnattaaataaatatntaaaattaaaaactctcaaatattacatntaaatnaaatnttaaatnaatnnanaaatttntattntattnntcncntatatncatatncntatncatatncntatnccttantcattncttaattattnatnaatatatttacatntntaaaaatnaaaattaaataattttntatattttttactncctatnanccaanncnanaaaaacncatccattcacaaatatattaanantnaaattcananaaaaaaatnatnaaatnntnccannncacacataaaattttatttnctacnttacaacanatnctctnacatttaaaataatcattccnttaatatcaaatttattgaaataagtaataaatttctaataagtttttttaattattttttttacttttattttaaaataatgattaatacaatggataaaaaagcaattatttatcagcttataatgatgaaaaaattatttttatttttgtatatctaatgaaatttttgttaattggaaattgttcagttccattgaaaatttgtttgtctcaaaataaaaagaaagaaaaaaaaagttgaatattagtgattttagaaacagttttaaaatgcatataaaattttaagttttcttttcccaaaagtaatcaacgattatcctaaacattatcatcagtgcccaattttttaggatttcatctatttttttgcggatagcttatggtgagataaacaacatttacttcgatcaattttctatttcgagcgactttttagaaattattttcaactatttttgcttatgaaacttttaaacaactattttggcttgtaaaaaaatattttttggcaactattttagcatttttcagtattttagcaactattttggcagtttttcagcaactattcaggtacttatttcgcgattttagctcctaaaaatccgggccctgaatatcataattgtattataatgaaagttgttatatttatttgaaaaatacgaaaaatttttttttaataattggtatgtctccattaatgcaggttaaataaataaatttagtggattaataaatttttccaataaaatttttatagaatagtaaaattttggcgccaatagaatttttgggaaactcggacgagattaaaaccaacaattgagtaggaattggcaaaccaaattacatcgaaataagatttttcagaatttttattttcttgaagaaattttttctcaaaatatacaaattcaggcaatggtcaatttgttttttacagtgtaaacataatattgatcgcattttcttataatttcgtcttaaatgccgcaatttgctcaagaattttttctgaaatttatttaattataattttttaagaaaaatatgaaaaaagatttttataagaataataagtgctaatttgtcattaaatttttaaatttgaggatattcaaaagtgaatttttcaaaaattgaaagcatataaatattaactcgcctttgaagtggtcaatgttgttgtccttcattaactgcttgaactcctcggtacagtacactttctgtggtgttgccaacaaattggcacttaagtaaccccggtanatgtcgaagtacgaattttgcaacgcttgctcggcacttgtccgttgtgccgggtccaacacaagcaattgaggagatcaattggcgaacattttcaactaatttaaaataagtaaagtatcaaacattacttaaattttttaaattttatttttcttttgtcaaaaatctcattaattaaattttttattaatttaaaatttaaacatat

SEQ ID NO: 30704 - DNA, 1587 bp, Heterodera glycines
gggaatttgcttcacagatttggtacaatatcattattccattttcttgcccaatttttgagtcattttttttttttttgcaaatttcgataccaagctgagccttttaaaacatttaatataataccaagaaaatttttctgaaaattttcaattcattaattcattctaaatatatgatcgaaaacattttttaaatttttttttcataaatataaaaatcccttttatgccaatcactcaccaaaaaattgactgaattgctgtccgtctcaaatccatgcaattccttttcataatcaatcaccgtgtattgctgttcgtcagccgtaaaaataattgtgtcaccaaaatacaacgaagtttcaatgtgctgatggttttgcgcatattcggtaccgtttttgtggttgggactgaatataattattgtaaatgactaggcatttgatttatatttgccaaaaactgcccaaaataattaatttttagtttctaaaaacctccaaaatagttgctaaaaatgggtaaatagttgctaaaaactttcaaatttaggggtgtaaaatcgtaaaattttacccaaaaaggaacaaaattatgccaaattaatattgagataaataatttttaaaatcacaaattcttgtcatgaaagtaaataattaaattttggaaatgaatttttgagaaaaattttgattttataggtgcattttttaaaaattttctggccgattctaaaaacaatgtttttgaagctctttattattattatttttgaaaaaaacaaaaattttcaagcgttttgcccaaaatttgttaacaaaaatgcaataaaaacgaaattaaattcctcagaatggaccctaaaatttaaaaaaatagataatctccaaaatgtatttattaattttatgaaaataatttttggtttttaaaaattatgtatcttaatactgattggcttaattttgttggtttttgaacaaaattttacgattttaaccccctaaatttggaactttttggcacctattttcccattttcgcacttatttttggctttttgcaacataaaaacaaactattttggcactttttagcatctaataatcgtatctcaaaatattatacagtatcaattcaaaaaatttcttcaccaaaaaattataatatgaaaaattaatatattgtaatttttggttacagcttctttgaaaaaccgacaaaatcataaaacaattaattaattacccgagaatgaaaagtggcgaatctttgtcccggaaaacaaattttatgcccggaaaaggacatggtacaatgatgccgttgtgaatgggcgcgccgattggaccgcaatttcctctggcggttcggaatgcaataatggcacgttggtgccgtcgttctgcacgatcactaacgaataagcgacgataaaatttttcaactgttatactcgtttgtcggggtagaggcggaattttcgagaattacggactttttaagccgagaatttatatttaagtcaggaatgatattggtcccttttggcaaagttcaaatttttcgaaggattct

SEQ ID NO: 30705 - DNA, 1054 bp, Heterodera glycines
cgatggaagggaactgcaaaatgccatggagcaagcccgaagcacgcacttcgaccacctgccaatgaatgcattaaaatcaaaacccgtgcatcgaatgaatgccattgaacgcacttggatgttatgttttggcacaaataggtcatactttccggcaccgttgttcctctcaagccatgtcggcattttgtgcagcagcgcctttttggggcccagcaattcggtcagtcgtttaaagtccaatgctttgagccgtgaagttatgccggcaacaattttcaagtggaaatttgtggatgggccgggcagacgagcggcgaccaaaaacgatttgatatgactgaacacgttgttctcatagcgaattccgacaagggccaagtcgagggccgactgaacgccgtagtcgggttttattttgaaccatcctttaaaaatgcaaaataataaaccgaatactcacttcccccaccccttcccttccaaccgtttcgttctgctcggcttcccgggcgatagagcgaattgaacgctttgaccacaattccctcttccccatttcgcattgactgcttgtaaaagtcgacaaatgttttgctggcaaaacatttatttaaaaacaaaataaaatatgaaaacttacgccgtttggacagtgtttttctgggagatgaacaccgtccccttgtcttggtctttgaacaacttttcgagcattttcaaccgttccgttaagggcagctctattaaagacacaccatccaagtataaaatgtcgaaaacagctgaaaattaacgcaataatcagaggaaaatgctaattgtaagtaattgccaaggcttctttggaggtatgagtgatttttgatataatcgtcgtcgatgtgttttatgtcgtacactttgccgtccgatgctcgttttccttttcccactaaattttgccgcgtaatttattattaaaaatgtttccatgaaattctatcccaccaaaactttgctgtcgttggtcccacacaaaacttcacagtccaacacaaattcgcgtacc

SEQ ID NO: 30706 - DNA, 1971 bp, Heterodera glycines
tcagcttttgttgattcctcgtgagataacacaaatcttctcggcgcttcatccgatccataaattccccgacgataggtatcgcccccactttggcgccggccaggcattttatgtaaaaaaatttgacgcacttaacaaatcgatattttatcggggatacatagagttagcaaagttcaatcaaaacaaaaatatatggcaacaattgtgtcagaagagggcactgttttgctgttcctctttcgccctgccaccgcattttagcccctttttcagaaaaaaaagttgaccaaatcaatgaaaatataaataaaacaatgtttttcaaaaaactgaaaaatcgatgtgtattttaaataaattttattttttgagcccggtgtttctgagtttgaaaaattttcgatcgaagcccttacggccccggtaaattggacacaaatggaaatttggagaccggaaaattggaccttattggatataaaataaattaaaaataaataaacaaaaattttggttttgctaaaagattttattttagtctgcacatccctgtgtttttataagcgtaataaaatggcaataaataaggtttttattattgtaacatcaggagaagaaagccaccataacattaataagtagggatcggatttttagtgataaaaaatcccaaaataattaactaaatagtgagaaaaaaattccaaaatagtggcgaaaaagttccaaatttaggggtgtaattttttaaatagctgttttttaatttgaaaataatttaaaattaaggaaaaagattttattcactgattgcagttacaaaatattttcttagaaaatattgaacaagaaaaaaaaatttgggggaagaatttttatgaaatttttccaattcttagggatgtatttttgaaaatttttaggtcgattcttaggggtgtatttttgaaaaaatttttaggtcgattcttgggggtatttttcgtttttattgcattttttgggaaattttccaaaaaatgccaaaatagtggcaaaaataatgacgaaacgccaaaatagtggcaaaaaattattttagtggctaacttccgaaatagttttttttagtggcgaagctccaaaatagtgattcctagtgatgaatagtggcactaaaaatgaaaaattttcgaaaaagaatgtgtttttcgtgcatttctcgtcgaattaaagccgcagaaaaaatagttaaaaaactaagaatccgatccctatttatatataaaatatttttgttcatttttttagtttcttcctatttcgttgaaaaatcttctgatgttcatcaattatttccatttgttaccttagtgaaagctggtgatgaaattgagactaactttggacccaatttcaattttacaatgccaatccgcgaattcttaattcaaacttgcgaaaactttttgcacgacggagaaattacaaaacaggttcaaaaataccgttaccaatgaaattagttccgatttctctatcctttcgggattgcaaaaacgggatttagacttcgattttgaaaatcgagagatccgaaaggccgggattgatttcggcaaacagtgccttaatgggtctgaattacgtgatcttaatttaggacaaaattgacttgattgccaaagaattcattaaatttaattgaagtgttagtactattagataaagttacaataaatgaattatttaaggaaaatctttgggaagccattcatggaggcctcaaaatcactggtgacaaaagtttgactgtacaaaatgagaaggaaagttatggtaatttttatgaaataattttaaaatatctttatttaaaaggttagcagtttgtcttcgctaaacattcaatttcacagaagaataattcatccaaccttttttattttgaaattacagtcaacgaattagaaaggaacgggtaag

SEQ ID NO: 30707 - DNA, 839 bp, Heterodera glycines
atattttacgtgtcaaagggtgtgcatttaagcgactctctgtgcttgcccactgcatttcaaatagctggtaatttttatttctccggcctaatccagaaaaaatcactatctctttttttggaaaattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttgtccggcctaatccagaaaaaatcactatctctttttttggaatattttacgtgtcaaagggtgtgcatttaagcgactcgctgtgcttgcccactgcatttcaaatagctggtaatttttatttctcccccctaatccaaaaaaaatcactatctctttttttttggaatattttacgtctcaaagggtgtgcatttaagcgactcgctgtgcttgcccactgcatttcaaatagctggtaatttttatttctcc

SEQ ID NO: 30708 - DNA, 918 bp, Heterodera glycines
tcatttcacttttttcatgctaatttaatggccttgcccaccggttctcatccccctggacaaatttgaactttttttctcaatttcaaattcccgcccttcgccagtgccaattttcttaattaagccaccctaatcaaaaaatcctttgttccagttccattaccattgccattgccaccctcctccctcccaccctttgtgccgttcaattcaatgctttcagtttatcgcccaattccccattcccccccccccgaacttttcttttcctaataatcccccataaaagtgccgaacaaagcctttcttccgcccctcctcattttttagcaaaaaaaagtcatttgaaggaataaacaaagcgtaaagcatagaaaatggttaaatttgggctcgtcattttacgttcattggcaccccaaagcattgccccgggggaatattggtaatgggacttttacagtaaaagttcaaaatccaatcttttaaattcgtataattgccccccccccccatttttcccattttcaaattccttttttcccattacttttctttgtccatttttcatctctttgttttttctttaattttatgctgtcactttttgaaacctgcccaaaatggcacttttcctcttcttccgttccatgataaatgagaaggaacggaaaggccaaaggaacgctttgcttttctttttctttttccatttccatttccattttcattttccaatttccaactttatttgttttatattcaaatgaattcttcgggaggggggggggcgtcccgtgggaaagttggcacaaaaataagtaaatgccgaaagaacatcggatttgttggattagaaatattctgtccaaaaagaaatgtcaagcccaaaaataaatggacaaataattgtaa

SEQ ID NO: 30709 - DNA, 756 bp, Heterodera glycines
atgcacataaatgttggtcgtcggtgcaaaaaagttactgtattccctactgtaatagagtttcctcactgtaattataattagtgatcagcaaaatttaaaaagacccaagggcataggataagtgaaccaaaagcggtgaccttgatcatgcctgaaatcttgatctttgtgtgatcaagaatgttttggtgtttcaagtaagtgatcaggagagaaaagaacttagcagggcttttccatggcggaataatttgttcctgatcggaaattatcgattaggacaaatcaatagaaatcagagtttggaggaaaatttaatgaataaaatggaccttcacaccagaaattagaattaaatttggagaatttaattgaataattttaaattgcccgcaggggaaagttttatggattaaataacggagcatcaaaaagttttgcagtttaataaaatgcttatatgtgtaccacaaatgtgtacaacagagcacagggggtacattcatcacaaagaaagcataggtatgaaaggtgacggggaaaaagtggggaaaaaagaacgccaaaatttgcccgacaaaattgtcgcgcgcaactgcgcggggagacgacggcgccgcgggggggggggggaatcgatgcttcggaacacagacggacgaagacggcggcggcgagacgagcagtcacagagaaggccaaggacggggacaaggacaccgcgcctaatttttttttttgggggggggggcg

SEQ ID NO: 30710 - DNA, 771 bp, Heterodera glycines
catttccttataaatccgtttttgcgagtttcccaatacttactctcttcctctccccccgcgttcagtccgctggagccctactcattcccgttcatggtgctcggcaacaaaattgaccgcgacccggagcgggctgtgtccagtcgcaaggcgcagaattggtgcgaacggcacggcggcaccagcacgaaaaacattagctacatggaggtgggtggcgggtgattctaacaattctcaaaaagtgacgctttctggcttcgtgccatgtaaattccaacttaaaaaccgaataaccattgttaatttcttttcttgggtcctaaattttcatagcatttcaaatttttcatcaaattttgaggcttctgcgaagagtgccgcaaacgttgaggaggcatttgaggcgattgtgcgcgacgcattggcacgcgctgcgcaagacgaacagcaaagagaacccgtcggtgggtggtgccaatgttttttggattcataattttgggtggaggatttatggtctccttattttaatgagtacattcactagtcttactttcttaagtctcggtcgagtagattagtaaaaagtgaaggaacaccgttggtgtggtggagggggagggcagcacggagctttacaaaaagtcgtggcaaaaaattttttaaaatttatgataaaagttcaataaaaaaattttaatttttcattatagaaaaattgttccggtgcacttcgtttcaatataagtcatttcaatatatatc

SEQ ID NO: 30711 - DNA, 807 bp, Heterodera glycines
ctaagattacccctaaaaataattttctcaaattttactataaaaaaattttgcgggaccaataatctataccattgccaaaaattcaagttttatttttcaaagctgactagaatgacttatttttgatgttgcaatgatctatgagttttatttttgctaattttaagcaattttaaaattgaagttttgacttaatgtccgaattcgttccaggggtacgaaattgctcgaattgggtgtcatattcgcgatcagtgaccccaaaaaccaagtaaataaaaaactgcggctcatcccgaaaaaacccgttattgcgagccgtggtcgcgttccaaacacaccatgtctgttggaattgtctggccatgttggtcccatttccataccgtcgttccatacgaccgtttccattccaacagtttccataccgtccatttccatactaccgtttccatacaacgtgtaagtgttcggaattggcgctgttgcgtttgtttgacgtcgtacgcgcctggttgcctaagcacgaaatttcttggaaatcttttttccaaaaaaaaaacttgtttggtgccgttcttggatggcgacagttgcgcaagcactggcttagcctcgttttgcagtgccaatgatcgaatcgtcgtcgatggtgattgtttcatgggtttttccgcgccccgctggcgtttgtttccagcggtgatcaccacgcgttgtgcacctcttcgagctgtattcggttcaccagtgatcaccacccgttgcgcgcccactcgtgcaacacgtggtttcggttcacat

SEQ ID NO: 30712 - DNA, 1488 bp, Heterodera glycines
aaaatgtattttttattggttcggcgacagttaaggcgatcctcaagagcattttttgctttatcggtaaaattttacattatgaattgttgtctttgtaaaataaattttgtttttagctcatctttttcgttttttgtcttttgtacatgtcactttccccaacattggaaaaccaacaagtccaaatgggaagcaacaataaaaatgaggcaaaaactgaggaaaaagcagcaaaagttgaagacataaatcaaaggcgtggatttctgaaatatgccaaatggaatgttcactctgtgcgcgggatttacggcaaaaagaacaattcttttttggtttcattgggcgactccgaatcggcaatgcattccattgaggtcggcgcattatggattaaaaattggcattacattttgttaaagtttttggcgattgtggaatttgcccctctccccacccccttctttccccaccattttcaaaaaaaatgttacttttaaacagggctgccagattaaaattttcaaaagcctcatttggcatgcaaaaaaacctcattttgggtcaaaaagcggctctaatgcactttatgagtccaatcgacttttatgagtccaatcgacctttatgagtccaatcaattgacaatcccgggtttttatacaataactttgttcatgatcgaacaaaccctatctttgtggtatcattcaaaagagcaaagtctgataaagaaataatacgacaaaacaagagaattctaacatttcaagaaagtgaccaacagaaattatcaaaaattactgactcaacaatctgtggtgagactgatacaaaaaaacttcccctaaaaatcgtagcttttccaacggaatcagctgcatttccaacagtacaacagaataaataaatactaggcaaatgaaaaagttttttccttcctctttagaaagagactaaaaatttttgttgttaatagactgaaaacgtgtttttttagtgacaattttttttcaagagaaggggatatgaaaaatcacttataaagctcatgcttggagataaaggaatcggaaaaaaaaattatctcaacaatcagtcgagaaacagttcaataattcggaagcagtgccatattgggaaaagatgcacaagtagagtaggctcgaaataaaggcaactgccgaatattaacaaaaattcaaatttatttggcccgttctgcttgacaggccatatctcgccagggagtggcgggagaccctttgttgatacatttgaaaatgaagagcgcgtctagctcattcgaatagcatcaaactggtttggttttgccacgaaacaaaccccctgatggccacgccaaaaaaaggcccaaaattttacatccttaaaactccattttttcataaggccagcgtgtttaaaggaaaccccaaaactgaaaggaaatttaaattgaacccctataaaagtttaattttt

SEQ ID NO: 30713 - DNA, 1049 bp, Heterodera glycines
gaacgatgaaacattattagggcacctcagagctctacagtatcgactggccgatacaggaattcaagattggtagaattagttagaatttctagctctgttggggtcttgagcaagcccaaattgtgaaatgaattatataggctggataaagttcggcgttaatttggagagaaattaaatttgataaaaaatgaatttgtttggttgattatttttaagcatgtaatttatgtaaaatttactaaatttatgcctaaataagtctaattttggttgagccgcaaatgtcgggccgcaaatgtcggaaaatggcccttaagaaaagggccgcaaatgtcgggccgcaattgtcgtttttggctgggggacgcaaatgtcgggccgcaaatgtcgtggctccggtacccgcacgcccggttttttaatacccgagcccggtacccgggcccggttttttggaaatccaatacccggtacccgacccggtaggtccgggtacccgggtaccaaaaaatacactggtaagaatgggggtttgattgaaaattagtgaagaaaattgttgttaaaatcaaaaatttttaaaaaaataattaatatttatataaaagtgacactgccaattgggcaatagtctagtggctagtctcctttactttcccttctctttacaattgttcaatccctctacagaaattaaagtgcttttagttgttttttttttgtatactcatgtgtttcctatcgacaaaaatatgattaatttacacatttttatcattttttaaatgaaatccgtacaattgagcctactaatcccaaaacccaaccttttttgttgaaaatctgttaacaaattacactcaaattttcaaaattttccccgggcggcgcctatcggcaccgcccctgcccccaaaagtttttaaaaaaagcacaccgcaaaaaagcggtttaaatagcataaaaaaaattttggaaaaaataaagcgtttatttgtaaaacattatatttttcatggtttttaaaatataagtttttattt

SEQ ID NO: 30714 - DNA, 1084 bp, Heterodera glycines
  misc_feature (21)..(22): n is a, c, g, or t
  misc_feature (38)..(38): n is a, c, g, or t
  misc_feature (1003)..(1003): n is a, c, g, or t
  misc_feature (1063)..(1063): n is a, c, g, or t
cagaaaacagtaaaacgctcnntattcatgcactagcngctgagatatatgcactgacttttctgcatatattgccattctcgcaagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggaagtagagcatntttcatggtatttttcagaaatttgtgcatgtgggcgacccgaacatttagacagttccnaaccaacactcatagtaaaaa

SEQ ID NO: 30715 - DNA, 1625 bp, Heterodera glycines
  misc_feature (1337)..(1337): n is a, c, g, or t
  misc_feature (1373)..(1373): n is a, c, g, or t
  misc_feature (1468)..(1468): n is a, c, g, or t
  misc_feature (1470)..(1470): n is a, c, g, or t
  misc_feature (1479)..(1479): n is a, c, g, or t
  misc_feature (1499)..(1499): n is a, c, g, or t
  misc_feature (1535)..(1535): n is a, c, g, or t
  misc_feature (1537)..(1538): n is a, c, g, or t
  misc_feature (1543)..(1543): n is a, c, g, or t
tgatgcagttgcgagggaatgcaaagtgttttcggtacctacttcggtgcgccgagtgcttctgatataatttttaaagattaattgttattatcattttctacctaaattcaattattttatttaaatattgttttttattcaaacgagaatataaataaagttagcatttcatttaaattaatttttttatttcttttttttaaaattataagatattgaaaaaaaaattctattaatagcttttcaaataatattcatattttttgttttggcctttttgtagtttcaatatttttcttcgttaaataataacaatcctttcattaattcttgataatgacaattaattttgaatttatttgtaataattatcataatataattttaagaatgaaacttgattatttatctcaaagcaaaaaaaggatggtgcttaattttttgttttccttgaccgggttattgtttcaattgtctagagtttttaaggtattcctgcaattaagagttttttttatttaaaatgcatatcattatgtatttattaacttttattttttctctgttttatatcaatccaacttcatttattatattagttttattttatggcaaccaatccaatgtaatttgtatactttggcaggctatggaataatttcttatttagcgttttcaaatattaaactataagtcaattgctctgatgtccgtgcactcgacaaatgcttaataacttttatggaattgaattaattgattgatttttcatttttggtttcatttttatttttatagtttaaaatatttaattaattatatagaatgttttattgctttaatatcaaggctaaaattgtttaacttatttgtatattctcatacgttggtttaaaattccaaattccgagcttaacaaaattgttttaataatttatcaatttatattagagaccggacgactggggtcggagggatccgagtcgggatcccgactgaatccaaattaaatttttgtttttatgcgattttaggttaacatcacagtattaaatcaaattgaatgaagtatgttaatagtcttaaatagaatagtaaattataaaccaattactaaaataaaggtttatttaaataaacctaaattcttaaaacaactgacgaaaccaaaacaaatttttacaaatattcttataaatttaaccctaaaattttaaaattaaataattattactctaaataaaaatagtaaaatctattttaaaacaatcttatataataatattttgtaaaaattgttttgtgtttgacttattattattaaaaaaaatacnacaaaaaataacatattataataatttatctttttntaataaacaataaacatataacaaaactattacactaaatctcatattattctattaatatatttttttaatacttattccatattaaaatcaananaactcatcntaaattaccatcacttaaanaaataaatatacaaattttaaacatctttaaagggnannatcanaaacaaataaacataataaaacctttgatggaaattttaaatgttttaaaaagcattgcccatgaggactctagaggtcccc

SEQ ID NO: 30716 - DNA, 1541 bp, Heterodera glycines
cccattcattatattattttaaataaaagcaatgttatttgtgcgatttcgctctgttttcggaccttatcgtgcgttttctgaattcctttctgcaaagtaagttttaatctctgagctgccgtttccaaccatatttggagtacatatttaaatttgaggttattttttttattgtagtcggacttgtctttatgacttccatgtgaaaaatggtgccaaaatggttgagttcgcagggttttcgatgcccattcagtacgatctttcggtcagtgcttcgggtgagttggcgacctccccatttcatttccccgtactccccattcagtgcttcacacgcgatcgaatgtgagccttttcggttggtttactgtttctttagttgcttgtttctaatgaatttctttagatgtctctcatatgttacaggttggttggtttttgttgttattttttgatcttatttcccaatttttaagactgaaatcaccggtgcccataggtgattttgctttctttgaatgttttgatcacaaaaaaaatagggtgcaattcattgaatcactgacgccaactgatgtgacgaatttgccggagaacagtggagctttgagtgtttttacaaattcagagggagggataattgacgacctggtaatagaaattaattcaaagacaaagaaagtaactttcagataatttcaaaaacggcccacgaatcactttatttggtgacgaacgccggaaggattggaattgatttgccatatttggaagtgaaattcgccgccttttgctaattgaagtgttattaattaagcaaaaagcctccgaatggcgtggcaatgggaaggaaatccaagtgaatgtgttacaaaaaaaagcattggtcgcaattcaaggttattgcccgttctaacactaaaccccctcaaaactcaaaaggtcctgagacgattaaactgttggggccagtgaccaatgtccctctcgattcgctcttcttcatgcattcgtcggttggcaaagtttgtggggttgagaattgcagagtgacaagatgcggttacaccggagaggacggagtggaggtgaaatgacaggaaaatgaacgcatcgaactgggaacaatttacacagatttccgtcccagtcgaagccgcagaaaaactcgtaacgagacttctctcctcgaaagtcgcccgtccgaaattggccggccttggcgcgagggatgtgttgcgaactgaagcaggactttgtttattcggcaatgaaatcgatgagcggacgacaccagtggaagcggggattgcctttgtgatcggtgggggaaggaaagggagggagccaaaagaattttaaatcaactcataagggaacacatcgagctatcagtcagaatacacaaatttgtattgggtattttaattttagcggtggcggtgtcccacgccaagttcaaaagtcggaacctcaaaatcggaaattttgctgttctcaacagagggagagagcagttagttggccgctaaaat

SEQ ID NO: 30717 - DNA, 997 bp, Heterodera glycines
ttctaattttagaaaaaaatctagaaaaattgtcatacttttaatagctagcttaataagaaaaaaattcaaaaaaaaactttctatcaagaaaattcaaggaaatttttaaaaaaatttcaagttttttggttttttccggaaattcagcaaatttagtttttattaacacttagattttcaaaaagctaaaatacttttaagttttcttgaaatctagaaaatttttaattatttttttttttgcggcgacgttatgtcccggcgacgtttcggtgcgacgttttggggtgtaccctttagggacaccgattttttttttgagttaaatgcctccatttgggatcaattcctttcactttcccccaaaaattagaaatgggaaatttttaattcgatatttctattaagaaaaataaatctaattgtaagatatttttccaaaaagcatttcgcccaaaactttttgcaattttcaaaaaaaaattttttttttttaaagtccaactttcaaaagtcaccaagggttgttttttttttgactatgtttgtcgaactcctcagaaaacggcatgtttcaggacgacgaattcccaactctgtgcggtgcgcgcattgtccgcgtcgctgtccacccaaacttccaaggcatgggctacgggtcgcaagcagttcgcctcctgctcaacttttacggacggaggccgcggcatgtttcaacgacaacggcggcggcacaatgccaaaatggggaggacaaaaatggtggaaatgataaggaggaggatgaagagatgtcgagggtccaacttgtggatgtaaggccatccattcaagtttcatggttttttttgtagcattttggcaaaaaaaaaaaaaattttttttaattaggcgtttgtccggtggctcctctaaaaacgaggaaatttaatggatttgttaagaatattgagtaattttcaaaaaacttgttcattttttcttgaaatttttg

SEQ ID NO: 30718 - DNA, 1424 bp, Heterodera glycines
ttttgtaaattatattcttatagagaacaattaaactccaccagtgataccatgaaatattaatttggttgaatttgccctaagttatgaatttttatgtgttacatattttttgtttcgaacccattggcggatttacgaaacgcgcatgggtggcattttttacgaaacgcgtcagcacgttaatggggaaggcggcagagggcagaatgggaggcttataaagatgattgctcatccctctagggcaaatatgcatattaaaaacctggacaaaatctcctggggcgagacatatagaaaagatcacttctggccttttttaaattttttgcaggtaaaattatttttttaattatctataaatctttaaggtacaatcatgtttgagtgaggctcaatgcgtccttttagctttaaaatttcaaaaattgaactaaaaacttaagtttgtaacaaaaaaaattcgaaaatcaattcaaaaattttgatccttatttttttcgggccatttcttaggggtgtatttatccgattctttcggaaaaacgacaaagatggcatgaaaacacaaaaatgccaaaaaagcattaaaggcataaaaatcgtgaaaaaggcataataaaagtcaaccaagaagccccaaaccaagtgcaaaatctattttgtttaaattgaaataagtctgggctaaaaggaacaaaaaaagctattctcttgtttagatgttggactgataaaacattactgttcaatgcggcatttaattggttctctaattgcctggcatgccatttactccttcaaaaattcattaaaaaataacgatagtttttcccaacaatagtgaaatgatagatttgaaaaaagaatgatattgcttcttgcaatcaacagtgataatcaggatttccattttaaattcataaatattgaggcacaaaaattaaccacaaaggcggaggcaaatgtcaccataaacgtcattgctgacaatgggcaacaactgagcacgatttgctttaaaaaaggcccgcaatttgttaacattcaaatgcaaaaagtaattctgaatgggaaaaacaattaaaaataaattaaaaaatcgatttaaaaaaatttttaaaaaatcactttcaaaatggtgagcccgtattgtttggtcagaaggaaacggtcgatcagcggaatttccacgcaattgatcaaatgcttctcacagcgcaaattttaccaaatcattttaatagtaatcgttaattaatagtcataattccaattgcaatcaatttacatgtgtaacatcaagaaggatcattagcagacaacaattgtgttttacatgtttaacatcagttaaggataaatttttgcatgtctaccaacaattaaggatcattagcatacaataattatatttttat

SEQ ID NO: 30719 - DNA, 978 bp, Heterodera glycines
  misc_feature (113)..(113): n is a, c, g, or t
  misc_feature (128)..(128): n is a, c, g, or t
atttattgaatataacacacaatctgtttttaagtcctccatgtgcaacgaagcagagtgtgccgtgcccgacgcagcgtggggaggtctgtcgctgctgaaaaatccacggnatgaagcaaatccanaaatttataggctttcggttcgatttggatgcaagctcagacctattatcagaaaaaccagaaaaaaaattttcggggcgagtaattcgaagattttttttcaaaattatgcgcctcaaatgaaaagtataatatttttttgcttgatttttttttatctatgatagcctacgattttttgatcaattttgaaaaaaaaagaattttaaaaattttaaaattttttaaaattgataaacttctctcctccgccccccccccccccaaaaaaaaatgattcaaaattaattttttcaattttaaacagtattagttatgtaggtgtttgttgaaaaaattacgcttttatgatttcagttttattaagaattttttcaggaatttcaatcgtttgttttatattttcaaaaatatatttgtttctcggaggccaagccggtccattacttttgtacttttgtggccagtttaggttcttcatttcttaattacccagtcattttggcactttttggatttttcctagtttttttttttgcttttgctttttgatgccctttggcattttcaggctggggttactggtcgccctgctccgagccgtgcggagccgtcggaatgcgtcggcgcgtccgcaaatgttacggcagcggaaaatgcccgggcgacgacgtgcagcgcgagcaatgcgtggccacagccggggacggcggtggagaacggcacaaatgcccatgaacgattcattgattttgattttggcgcccgcaaattagggttaattaattaattagttcattaattgccctttttcaacattccccacttcatcctcattttgcgggttccc

SEQ ID NO: 30720 - DNA, 1419 bp, Heterodera glycines
atcggaataagagagttttggagattctccaaaaaagttgaaccattcagagaaggacttgttaaagtacaaacagtttttggaacagtaatttgtggggaaatgatctccgcgggacaaaatttatgcccgctcacagcaatgatcatagaaaacgaagaaaaagaaccagaaaaatattgggatttggaaatgattggggttaaagataatcccgtagaaaaagatgatgatgtgacactaaaaatgttccaagactcagtataccgaaaagatggacggtatgtggtaagttggccttggaaaggcccaaaagacgaattaccgactaattttgcattagcctatcgaagaatgatcggcataatcgaaaaattaaaaaagaccaacgaatttttaaaacattatgatgaaatatttaaagaacagataaaagaagcatagtcgaagaaaccgaaataaaaggatatgacgaacatttcttaccacatcactgtgtgctagttgcaggaaaaaagccacgagttgtatatgatgcgtcagcaagaataaaaggtcaaaaatcacttaatgacatgttattcagaggaccaatctatatgccagaattgcctggtaaaaaccaatttcaaagacaaatctttgcgcattcagatttaaacgagtaccatttggggtaatttcttccccgtttttactgggggcaacagttcgatatcatttagaaaatgaacaatcagagttggcaagagaagttaaacgaaacacatttgtggacaatatatttgtaggttgtcatgattttgatgaatcaatcgaaaaatataaaaatctaaaagtgttatttgaaaaggcacgaatgaacattagagaattcatctcaaattctgaaagagtaaataatgagatcccagaaaaggatcgtttagtaaaggaaaacccaaaagtacttggtataaattgggacattaaaaccgacacttaccaaattaaatttccaaatgttcatgaaacagaaaggataagcaggagaagtgttttaaaagagttaaactctgtttttgatccatgtggatggctatcaccttgtttattaccagctaaattattcttccaaagtctatgggaagaagacaggaaatgggatgataaaataggagaagaaaaacagaaagaatggaaatacattacaagtttatgggaaaataaatcaattaaatgcatacggagaatagtccctgacaaatttaacagagcagaattacatgtttttgtagacgcatcaaaagatgcatatgctgcttgtgtatatctaagaatcgaatcagaaaaaacacaaatcaatttattatatgcaagaagcaggttgagaccaagaaaaatcaaaataactataccaagaatggaattgttgggagt

SEQ ID NO: 30721 - DNA, 944 bp, Heterodera glycines
ttttacttaaattgcatttcaaatttacagataaaaaggattccaaaaaatctgaaacaggttttaatttaattttctttaataaaggcatgcttttcagcaaatgctttgtcgtttcataatttcgctaatttcacatttttaataaagaattttcatagaatgacattaatttaacaaaatttaagtcatttagtggcatcattcgtttcggatatactattgtcaatccactataaaaaatcgcataaattatatatataccaatcgatagtctcgcggagttaggcatgaaaaaaatttttctccagctgcggaaatgtgtctgaccctattttggaaccggctcaaaacttgaaaaatggagagcatttggcacttccagcttttttaaatgatcaaatccaaagacaaattaggtatctttcaaaagcccttgacgagctaagtcaaaaaatctggagatgaactcaaactgacgtcatctggcaatgagagtttttgaaaccggttcaaaaaaatttgatgcaactaatgccaaatttttaaatcactttccagcccttttttgtgttggcctgtaaaatttcaaaaaatttttgtcctggttccgacaaagctatgccaaacaaaaccaaaatctatggtccatttaatcatttcattaacattgatttaacgaatttttttaagcccattcttagttaataaaaaatctaagtgtttgcgatagtctccaaagtttggcactttgccaaatagggtcatttaatgatgttgccaaattttagaatccaaaacacctgtaattgaagaagaatttgaatttccgactcccagcaatgccgaaacagaaaagaacaaattagcacaaaaattccaaaattttaaaagatcaaaaagaggaagatttcctcctcttggtcgacaaaaaggtttccttt

SEQ ID NO: 30722 - DNA, 829 bp, Heterodera glycines
tgttggccccacctgtgacttcggctgctcctctcgttcattagtgtctcggcggtcgttctcgccccattgcccgcgttgattaacctaaataacttttttggtcctattttggaatgctcctttcattcggtgtttgttcacctctcaatttggtcgtaattggtcactttgtacaccgacagtccctccaccatcggacccaacagcgaatgttcgcgcactttcagcgacggaatacgtttcggtgtcgaaacgcaactcttagcggaggacggcctaattttggggagagaattcgaattattaaaaaagggaaaccgacccaagcaaatccctaatacgttcgttgtacacctcgaaaaaggacacttccaacttgaacttctttatcccatcttcactcgtttcgcgggccaaccgttcgaacaattcggtgcataaacgggggacaatcccttggggagggggggaggggaattagtccaattacgattgatgtgctgccataaattatcccaattaatccctcataattatccaattaatccctcattattatccggtttagcctaattaatctttcattattgcccgatttatcacaattatccctcattattatccgctttatcctaattaatccctcattattacccggttcctccgaagtgcccatcattgtgtacgacttgccagaacctattcgcaaattcaatatagcatatgcgattagccaatctcaacatgactgacccgtctgtccataagcaaaaacgcaagagtttaggccgagaaaggcattgtccaccacttcggcaccgacgga

SEQ ID NO: 30723 - DNA, 1215 bp, Heterodera glycines
ttaagataatcctttgtaatcattagagagtgttcctattcagtttaaacttgctgtttgcgcacgcattgatcggacggcgcgaaaagactcaatttgacgctatgggcgagaggaaatgcttacgctggagaaaaatgtgaggggggggggggggggaatgatagaatgtttaagaaaacaaaaaaaaccaatgaatggtttcacaaaaataagaaattctgaaattcaggcaccgtcagatttcaaattggacagtgacttttctgagatttgtcgcgtgaacgatgtgtgacaaatgacaaacaaatcggaataatacaaattttacctttatattgaattatttttgattctgttgtaaaataatccatgcaaggtttattgaaataaatgcataaatggatctgctgataaaatcaccattctttaccgagtttcgttaaataatacaacagcttgcaaatattgaattggcgaaatgtttttcttttcacaaagtggacttcgctcaaatcacattaaagcgctgacccacaaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttggacatttcgtggcttggacactttgtgggggtgcccattaaagaattcacattttttcattgtgttattaatggccacttcaattggccttaatgaccgcgtctccattcaggacgtattttacagtgttcaggtataagaatattaagtcgaagtttttttatatattaaattctgatctaaaaaagccatttccatttataaggcactggaagagctgcaaattggcgatgatttgccatccatcggcgccaattcgcagtccctccaataccgcatttccttcgacaccaatttcgaggaccgaagtgcatttataacgggatgctcaaagtgcgagaatgaaaatattgacgaaattgcaaaaaattggctttaaggtcatccaagaaggcaccaaacatggcgaatttggaagaattggtggtggtttcatggggttattcatttggcaaataattacccaaatttgactccttaatgacccattggtttttttaaattttttatcattgaaaaacacactttt

SEQ ID NO: 30724 - DNA, 1177 bp, Heterodera glycines
gtagagctgtgccgtgactgaaaaagcccgtgaaattcacggttttcgtgaccgtgaccctgcatttttttgagtttaatttttctctatcggcgaattttttgcaattcataattaatatttatagttaagattatccaaaataaattttgttaaattcagttatttatttacaattttaagttaagaagatttcttgaaactttatctttatttaatcattatttattttgatttatttttgtttaattaattaacttaactttcataatttatttatttttgcattctttttattctaaatttattgttatagttgatttatttataattcttgtccgcatttcagctgtagtactaatttctgtcgaaatgctgcttaattataatttttatcaaccaattcttttcacaattatttagaattttcttcatctttaatattcatttgaacagtaatattaataaaaatttttattttttattaaaatattattttaaatcaatttgtaattttttttgtgttgaaaaacaactaaattctttaatcttaagataaatttttatgaaattaaaaaaagcacaaatattttattgaattttaagaaaattagattataataggcgttaaattatcgaaaatttctaatggaaatggatccaattccatgtgacatgagattttttaaaataaacgtacctcgataaagcagtaggcaccaatccccgtcggattaattagagcagtgttgaaacaattgatattaaggaataataatataattttatcatgtctttagttcaaataaatattttaattaaaattattaaatgattctttattaatcacttttaaagattaggtctcttctgagatttgatttgtttaaagcttttttagataattattttcttttaaataactattcaattagattaaaattctatattatttcctctaaatattatattttaattaaaaaatttaaattccaaaattcatttatcatgatttatgttttatctatgatttttcttgtttcattatttttaaatttgctatgaacttgataatatgcattcttccgggcgcagccatttaaatagtaatttaaaaaataatattttttttcattgttatttaatttttcttatttcatatttaatatattcataa

SEQ ID NO: 30725 - DNA, 1321 bp, Heterodera glycines
  misc_feature (1151)..(1151): n is a, c, g, or t
  misc_feature (1273)..(1273): n is a, c, g, or t
ttttttctccccctaatttttggagtcccccaacgggccactgaaaaaattgtttttttttttttgggggcattccccccgaacccgatgcccccaaatttatggggagccggaatccttcgggaaaagcttccctatagcctgtactttaattttgcgtgggatttttgctcccccataattgtttgagtaccccaaacggacacttgaaaaaatcgattttttgtttccggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggaggccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggattnttgctccccataattgtttgagtaccccaaacggacacttgaaaaaatcgatttttttgttttcggggcagtccccccgaaccgatgcgcccagatttatggggaggaccgaatccttcggnaatagcttccctatagcctgtacttttattctgctttggatttttgct

SEQ ID NO: 30726 - DNA, 1060 bp, Heterodera glycines
  misc_feature (42)..(42): n is a, c, g, or t
  misc_feature (57)..(57): n is a, c, g, or t
atgccagttttcgagaattctgaaattccagcactacatgcngaaaatattgctccnaatgacatttctcgcccttttaagcgcaaatggggacttattttgtaattctccataccgttttcaattctcacaaagatgccagttttcgagaattctgaaattccagcactacatgccgaaaatattgctccaattgacatttctcgcccttttaagcgcaaatggggacttattttgtaattctcccgtaccgttttcaattctcacaaagatgccagttttcgagaattctgaaattccagcactacatgccgaaaatattgctccaattgacatttctcgcccttttaagcgcaaatggggacttattttgtaattctcccgtaccgttttcaattctcacaaagatgccagttttcgagaattctgaaattccagcactacatgccgaaaatattgctccaattgacatttctcgcccttttaagcgcaaatggggacttattttgtaattctcccgtaccgttttcagttctcacaaagatgccagttttcgagaattctgaaattccagcactacatgccgaaaatattgctccaattgacatttctcgcccttttaagcgcaaatggggacttattttgtaattctcccgtaccgttttcagttctcacaaagatgccagttttcgagaattctgaaattccagcactacatgccgaaaatattgctccaattgacatttctcgcccttttaagcgcaaatggggacttattttgtaattctcccgtaccgttttcagttctcacaaagatgccagttttcgagaattctgaaattccagcactacatgccgaaaatattgctccaattgacatttctcgcccttttaagcgcaaatggggacttattttgtaattctcccgtaccgttttcagttctcacaaagatgccagttttcgagaattctgaaattccagcactacatgccgaaaatattgctccaattgacatttctcgcccttttaagcgcaaatggggacttattttgtaattct

SEQ ID NO: 30727 - DNA, 850 bp, Heterodera glycines
aaaacccgggaccgggacttaccgggatttttcccaagtgaaatattttgggaaaaaaatttgaaaatttgagtgcactttgttgcgaaaattgcctatattcaaaaatgtacccataaaatttttaaatttttgtttgggggggggggagaaattcgaagaatttttccattattcgttggaaaatttttaaaaattttcatggggaggaatgttggaattttctgagtcccaaaattctggattttttaaattaattaacaatctcttaaattttttaactttttgtggcgctgttttttcaaaagactttggctacattgggggcggggggccggcggtgccgataggcggcaccggaaaaaaattaaaattttgtggaatttttaacagaatttgtcaaaaaatgaccaaatatttggttaatttgcggttttaggctgtttaaaaaaagaaaaaataataatttttaagttgaaatattttttattaattaaatttcaattgaaataatgtaaagaaaatattaaaaaatttctgttccgttgggggattgaacccaagagacaaaaaatgaaggtcagaaggtatagccagtaaaccacaaaaggatatacacaaatgcgttaaataaaataaaaattgatttttttctccaataatttctccatctccaccaattcccttctcttttctcacccagaccccattcttaccagtgcttatttagtcccgccgggaccgagactggtaaaaccgggaccgggatttctgtttttccaaaaatcgggaccgggacctgaaaaacccgggatttcccgaaccggtcccggtcccgtgcaactctact

SEQ ID NO: 30728 - DNA, 1457 bp, Heterodera glycines
gcgctccgctctggggagattggagctttggtgcatgtattagctctagaattaccacagttatccaagtaagaagtcaaggtcaagtaaattatagctggtgtaatgagccgtacgcagtttccctgtctggcaggttaaacttacacatgcatggcttaatctttgaaatgaacacatcagttcaggcaggatcaaccagatagctgctagcgagcgttgccaagcgccgctattacagccgtcttgtaaagacggatagtttcagcagaaacaactccgttcagcgcaagcgtgcgcatgggcagcgaaggagacagagcaagtggtaatgacacagcgctggccaggcatccgagcttcccggacttgggaagaaccatctcgccgctggacacagctccgagggcagtgcacaggcactcacacgagcactccggatttcccggttaggacacttcctcaggccaaaggccttcgggcgcttatgtctcgtgttttttcgaatgcaagcacactggtccccaggcaaggagttccgatccacgaactcatagggcttgtcaaccatggcaatacgccactcactcgtataccaacaccaccaccaactttaggttcagcatccccagtgctgagttccccacagcatttgtgccttaggccacatttacacaagtcaattaactcgccaaatttctttaacacacagacgagctgcatgtttattcatttcgacagctgccaatcgctggagaaactgaggccacgacaaaggtggcaccccagcagcagccatcaccgttcaatgccgagcacaagcgcaagcaagcacttgaacccagacggccgcgctccccatagcgaaatcgcatcttttttccagccataatatcgcaaaaacggcccaaccaccacagtcacccacgccaaccaaccaacgcaaagcacatacgactaggaactttatacaaattttaaaaaagtaatattttgtatatgcatttaatcaaatttctactttctttataaatgttagctaattagtcagcgtctatttattttctgtaaaaatttgcctctttatttaaaattaaattatatataatttcatgaaataagacactaaatgtatagagaatgaattaacgtggtcgattggaataaatggacaaaaaagcaaagtcaaagacaaaaccttaaagcaataggcgattggaataaatggacaaaaaagcaaagtcaagaacttatcctacctaatttcatggtggcaacgaggcatttgactcccttaagagagccttccttctcatgtacttgtacctaaaatgttgttggcacaaaaagtaaagggggaaaaagaagacaaatcatcccgatcagggctaagtctcaacagatcgcagtgtaaaagctgctctactgctaacaacccccctgacagtagtcaagtc

SEQ ID NO: 30729 - DNA, 886 bp, Heterodera glycines
aaaggatttaaaatcaaatagattggcatgtatgtacgaaaatcaattggaatttgattctctgattatttttaattagaactaaagacatttcgccataataattatttaaattttcaatcttggggcagtttcgctggcgaatttaagcccgttttagcccggccaaaatgaccgggctcgggcttagacaattggccgggcccgggcggcccgtccaaaaaaagcccgttttaccgggcggcccgggcccggtttttttgaaaatttaccgggcccgggcggcccggcaaaagcccggcgggcccccgggcccgtccggtctctaaaaatatccacagtgaatcggttcccggttgaaaagcttttgcctgtttgtcttgatcaactcatctcattgtctttttaaagcgattgaaacctaagaaatgttatatcttaattttgtcgcgtcccccacttttaatggaatggttcgtacatatttcgatcaaatggaaaatttcgtcgattgattaacacgattaattctatgctccatcaaaatccccggattttcctctatttcccttcgaacggtttctcgtgcctttccttcgtccgccacacccaaaaggccttttctcccatttacccatccgtcgatgaagcgaaggatctccgctctgattgattgactttattcattcgttgtgctgcttctgctcgctctgcccctccctttctttctcaattttcctatttccttcgttttcccctcaaatttcaaatggcaatttgttcaattgttagaaagcaaaacattttatggttggcggattcatcaataagctcggccgactgcgatcgttgcaaattgcttttcgtcgccaattgttcacgcaat

SEQ ID NO: 30730 - DNA, 1189 bp, Heterodera glycines
  misc_feature (1150)..(1150): n is a, c, g, or t
ccattaattgggtttaattgtttctcctctttccgtctaaacatgggttttctggggcagcggtcttgaactgttccattgatctttggcggtctatgggacccactcggcattttgtttggcaaatgtgccattattggacgccaagtttttttttttacattttttaatttttctagagcctccaaaggtttcgtttaattaaaatttccattttcattgatttaatggcgatgatttttcaggaattgttggagcaacgggaaaagttggaacgggccgaacagaatttggacaccattcaccacaccactcagcacacacagcgcagtgagagtttttttaggccaaattttaaatttattttgtatattcaccatcattgacaatttatttgcccaggcctgaacagcttgaaatcgtggtttggtgggctggtcagaaacaaactttcacgagcgccaaaagggttgggcacggcaaatgccaatgccaacaatcagcagcaacaacaggaacagaccgtgcagcagcaacatcagcaggtgatcaaaaatggatagaaaagagtcacatatttcggggtgtgggaggcctaacaaatccgattaaaatatatacattttttaaaaatttcaagaaaattaaaaaaaaaaatttttttggcgacgtttcgtcccgaggcgtttcggtggtgaccttttgccctgctccctttgtccaggcatagaatttcttagaattttttgaatcaaacaaaggtttaaaaaaggacccgctgcggctaattgcgttataaaatgtttggagactgccggaaaatttaaatttgtcaaggaaattggaaagttttgcatttcggggctggggagagtgtattctgtgacaattaagtaattagcgttatttgacttctgaattaagcgtccgctgcatgcccatttggtgcagtcgtctgctgacgaatttgccggggccatcggtggcggaggcggcggtgttcagcccccgcaacagcactcgctgaactcctcgtcacgcgcgtacattcagggcactcgttgggaggcgatggacgacgaaattgacaacaatttgggtaatttgtcttgacaaattctttgtaaaaatgtgccgtgcctctcttttncacaaaaaaggaacttggaacgccaaaaagcttaatatt

SEQ ID NO: 30731 - DNA, 677 bp, Heterodera glycines
ttttcaaaactgtcacttttcatatagcgcccaataagtgtttaccatttctttttctgccaacaatgggtccaatggactgcccacgaatacgacaatgcgctgccgatggttgcgattcttcctgtgtttgagtgccaagtatgcggttttgattccatcgaaaactttcgaaacgccctaaaattgggaaaaagatgtgcaaatatgaaaatatatatatatatgaagaaattacaagaatttcaagactatgaagacggaccaacaacttgcgatcttcagtggtcagtgaattgagcacatcaatacgactaaaaacaaaaaacaaattttgataaaataggtacataatgacgaatttctttttctaccaaatgaaaggggcaattaaaatttttggcgctagttaaaaagtgaccttttttgaaaattttttcacttttttggtcacatttttttttgtttgtttgttttgatatagaatgatgaacacattaagcattgagcataatttggcgaatataagtatattcacgattttttatttcaaaaaattttgcaaaacaaaagggtcctcccccctttggttttttaataaaattcaaaatctttcactttttttgttgatttttcgtcattcgtaccatctgttaaaaagaaagaaattctgtatc

SEQ ID NO: 30732 - DNA, 567 bp, Heterodera glycines
cttgcatggcctgggcaggtcttacaaataaataaaatttaatcgttagaagtgcaaagcttatttattattcaaattttattataagagatggcctaaatgcaaaaaagagatagcaaatagagtaccaacccattataaaattataaaaaccaaaataataacatgaaatttattttattacatttttggctgataaattctttgaaaagcatgaaattgatagagcacaaaataaatcatcattataccttagcatcaatttgttccatctttttagagttgctgatgagatttttaaaaatccagcaatttctttatcacagaacgacggatttgctttcttcaatttataataatcaatcattttgctcattttttgttctttcgaatgaacatcttaaaaggataaaataaaatatttaatttaaatttaaaagttactttttttaaattttagatttctgtgtgggcacaaacccccccccccacccccccccagaccaagcttcaccattttccaaaaaatttcgcttaatatttcaaaaaaagcaacaattttttgat

SEQ ID NO: 30733 - DNA, 973 bp, Heterodera glycines
tataattaattttttttaatattttctatgccaaacaaatatgcagtttttctaatcaaatagataaatttgtccgacagttattgtttaaaaatcttatgttgcgcaatacagatttttaatttcatattttatataatccttattgattgattataaaaaaactaatcataagtggaaagtaataaaaatttctgttaccgagatgccaatttttattttaaaatcttttttggcaagttttgaaagtttcatttcttatgaacttttttagcatttattggaaattaaatcaattaatacaaataccaacgaagaaaaaattaatgtgaaacgaaaatgaaattagtcgaagagagggggcatctggtggagaaatgccaatgatgtgatgaagacaatgccaatgatgttaaaagggaagaacgcgtcgttttgtgtcgattgactaagattgcagcgagagagtgagagagactcagagagaccaatgagcgaagagaatagaagagatagaaacaaaggttgagagagagagcagatagagagagagagagaggaagagagagagagacaatgaaagaaaaaatctgatgacatacataaaatgaattgggtgaatagaatagagacagagaaaaagagagaaacaaaacagaaaatagaaagtatataataaaaagacgagaaaagtattttaacttcttcaataaatttcctcttcatttataaacttcaaaattttcaaaaagaaatttaaaaattttttaaataagttaaattaaaaaattcgtttttttgataatttatttacatgtattaattattaacattatttgaatattttgtgtaaatgtaatttttttaagttacatcaataattaagttgatagttctcgtcaattagtaataattttttcattttaactttatattaatttttatcttaatttcttgcagaaatttaatgttt

SEQ ID NO: 30734 - DNA, 1709 bp, Heterodera glycines
  misc_feature (11)..(12): n is a, c, g, or t
tgcaggtcatnnctccttggaaaaagcgcatttcctaaacgctgttccccctttcttcgaacaaatacccgtcgcgcaagtgaccgactcactcttcgctaagcgccgacgaaaacgcgtgccaccacggggaggaggcgtcggtgggggtcagcgatttgcacattcccttttggacgaactcaaaagtgacgtccgggcccgcctctttgcaccaattggcgatcattgcttccatttgctgaaccaatgacagaaagtccaaaaaacagaaagaacatttccccattgactcacctgaaagtcgtcggttggcgtcacgcgcatgtcaaaatctaatggaataattaagaacataattaatttcatgaaacaatccaaaaaagccccgacgacaatgaacagtagttagaatgacttgaaatttggtagacagacaaataccaaaattaaatgccaacagtcgaaaacattttcgattacgttatataaaaggtctcaaacaaaattcaaagtcattctaacaactaccagcatttacaaacttcgtgaatttcatagactaaatccacacggtcagtgatcatacaaatagaactgtttgtgcggaaaaacgtacatgccacgaattgggcagggatcacattggtctgcactccaccctcgatttttgtcagatttacgcttgtgacatcgccgagacgcaaattcgggtcggcgagaagcaaatgacgctgacgttcacgaaaagcattgaaattggccaaaatggaagtctaaaaaattaaattagaaaataattgaatggggaaatttattcgcaaagaaaaaccacaaataaaaccaatattttgccacccatcccacacataccaactttggaccagctgtgttttcaacgaatcgcgaaccatgcccaggggctaaaaagacaaataacgaaaatgataatcaaaatgttttatattttccaacaataaaaatttgaggatggcgtagtgcacgcaaaaacaatacaaaaataccaaccgccaggacaagtgatttgcagccctgaataggaatagaattgtaaaattgtccaattgtcataactcacaccacgcgcatcgttccccataaaaaactgagtgagtgtccgtttcgctggccaacccttcgtcaagcgcaaaaccgatgttcagagaacgaaatttgtccgtatgaataaacttttccattccgtcgtggctgccaatttcttcatctaaaaacccaataaacattcgaaagatttttgctcgtcgttagtcaaaatctttcgtttgaaaaatatagcaaaattgcccatttttggttgtcaattccaaattttaactaccgtcaatgttcttcttgaaaccaacctggaccccagagaatgtgaaccgtccttaaaaatggtttttggccattttcaaataaaatttctctcaacgcctccatgtattggatgccaacacatttcatgtcctaaaagcaaaattcaagtgccatgtttaacaaaaggaaatggggtcgacttgtgctcctcgcccaaaaatattcccatcgatgtctttaaacgcttcataaggcgggtaagtccaatgttcctagattaaaaaaaagtgttattataatgttcaaatcaggcaccggaaaagtcggcaccacatcggtaaagggtaaaggagaagggatggcaatgt

SEQ ID NO: 30735 - DNA, 1423 bp, Heterodera glycines
cgagtgccagaacaagtgccgtgacttgattttccaatttttccatcggcttttcaagcgctgataggatcttttctggaatggacccacgcccactggcaaaagcctctcaagcaaattttcgagtcgtgacattcgtggtcaaagaatggaaaggtcgggattattggcagaaagaagttcgtcagtttcactgcgaagtcgtttgctcattatagttaattgaggaggataattattgtgggaattatcgatttgaatttttttgatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaaaatatttcaattctttggggtgtattttcagaaatttttctgttcatttcttaggggtgtgtataacatttaataaattttacgttgtcaacgcactcataacaatgtcagttattgtttaatacatctgctaaatgggaatgtagaagtaaacacacaatactttatcttcagctgctttaataagcattgggcaattaattatctggtcaaaattttgacaaagaaaacaacacaatcgaacataatttgtaaaagtttccatttggcagttggttggcattttatcactttgccaaaatcaaattcccacccaaaaaaaatatttaaataaatccacattaattaaggaatacataagttaaattttcacaaattgtcgttaataatcccatggaattgttgctgtttcgtcagggcgaatttgacaaattgtatggatgtgagggatttaatgcgggcaaaatcccaattgaagaaagaacaaacattatgaacggatgcattttgatgatactttttttcatttttgaggtcttttttcgctgggtgatggaattatagggctcttgatttgaatttttctactcttgaccgagacgcaaaaattcaaagaaaatcccaaaagtttaaaaataaatcgatataatttaagctactgtatattccgtgtatggtatcaatttacaaaaacatgaaaaacaatgcctgctacaaattgatgttcttcattggcatattggacatggtcatcttttaacagaataaattcttcaagaatatttatttatttttaaattaaatttccatagttggccttgttcattagtgggttggaaactggaattcttggcatcattggtgccgtttattgtgactatccattgctgatttattcaagcggaa

SEQ ID NO: 30736 - DNA, 929 bp, Heterodera glycines
gcttagatcacatgcgatttcggcactctgataatttagcgcacataatgggatgataaaggcgattgtagaagagatggaagcgctaaaattgtttgaggagctttttgagcgtaattacgatttttacttacaccattttttgctaggcttagatcacatgcgattttcggcactctgataattttagcgttcataatgggatgtataaaggcgattgtagaaggaagtggaagcgctaaaattgtttgaggagctttttgagcgtaattcacgatttttacttacaccattttttgctaggcttagatcacatgcgattttcggcactctgataattttagcgctcataatgggatgtataaaggcgattgtagaaggaattggatgcgctaaaattggttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgattgttacttataccattttttgctaggcttagatcacatg

SEQ ID NO: 30737 - DNA, 1135 bp, Heterodera glycines
tccctccccccgggggacttttttattgacccgcccccctcccccattcattcattatgatccctctcccccccccctcctcttccaatggcggggtggcccacagatggcgcaaatcgttccgccgtatctgtcggcattccctgcaattaacccttcggccccctcttttccctctgggcgcgccatttccaatcacaagtaattcgccggcggcgggcggcagcatttccctccccccaaaatggcattttcgcattcattcgcccccccccccccgacaattgctcaatctgtcgtcgtcgtccctgatcatctcaaagggaatgaatgaatgaagcatttcgtcgacctaatgcataaaattaatgggcaaataaataaaaaataaaataaataataaatcggatgatcaaagaacgaacgacggacccatggctttctgataccgcaaaaattacctttttggcccaattgccccgtctgctggtcactttatggccaagtgagcagttttttcaaaaaatgggacagaacttttacgacggcgagttgtatcattttttgggattaaataattatcatctgttccttcctttcccactgactgattattcacagagtcattttttccaaaaaattgctataaaaatgtctgaggattttaaaaaaatcggctgaatgtgaattcatccgtgatcatgtggagttgtataacgatatgattctcctacagagacctcatttatggcaggcgtaaaagcaatttttggttttgctgaagcccataaaattacgattttcgcattttttgagaccatttttatttgtacagaagtaattaatttattttattaataaatgaattattctttcaacttttttttgtgtccttgaatatgtcaagatcaagtcgcttctcctttttcctttcctcgaccgatggtcgagagtgccgacgagagtctggattaagaattctcttggtgctctgaccgctcattctttttgatcaagagtgaaaaatgttgaatgaaccgatcgcatacaaaaaacaatactctgaccactgccgatcatactgatcgagagggtcgcgagggatcgaggactgagtactgactgactgattgct

SEQ ID NO: 30738 - DNA, 692 bp, Heterodera glycines
aattttccaaaattaaaaaacaattttttaatatttctttgtttccaaatgatccgcctttaagttccgaataaataacttcaatggcacttccaacaatcacaatgcaatcaaaacgattaaatctgacaaaatacaaacaaataaaataaagaaaaaatcaataaatttaaaagtatcaatacagtacttcgatgtaaaataagtacggtaacccattgcaaaaattttgataagcatttcactgatgaaaatggcaagaaatgtgaactcggcatattctacaaaaagtttcggatttgtaataaaatttaaataaataacaaataaaaaattacttaaaaattccgtgaaccattcgggctaaaaaaaattattatttaaaaaattttaaactaaatttcacctgtccatgatgctcactggccacacaaacagtattcaggaacaccaaggttatcacgctccagtaaaaaatctaaaaatattttaggggttgggaaaactgtgcccggaaaatggcccatagaaaatgcgtcagtgaataagaattttttgaaaacaaaatgcgttcttaagcattacttgatagggaaaaacaaacttacaataacacaattacactatatttttaatgcgttttcggttaatttttaaaagtttatttattatttttaattttcaaaaaattg

SEQ ID NO: 30739 - DNA, 1189 bp, Heterodera glycines
  misc_feature (90)..(90): n is a, c, g, or t
  misc_feature (92)..(92): n is a, c, g, or t
  misc_feature (94)..(94): n is a, c, g, or t
  misc_feature (99)..(99): n is a, c, g, or t
  misc_feature (103)..(104): n is a, c, g, or t
  misc_feature (106)..(106): n is a, c, g, or t
  misc_feature (108)..(108): n is a, c, g, or t
  misc_feature (110)..(110): n is a, c, g, or t
  misc_feature (114)..(114): n is a, c, g, or t
  misc_feature (118)..(119): n is a, c, g, or t
  misc_feature (122)..(122): n is a, c, g, or t
  misc_feature (128)..(128): n is a, c, g, or t
  misc_feature (132)..(132): n is a, c, g, or t
  misc_feature (134)..(134): n is a, c, g, or t
  misc_feature (141)..(141): n is a, c, g, or t
  misc_feature (143)..(143): n is a, c, g, or t
  misc_feature (145)..(145): n is a, c, g, or t
  misc_feature (155)..(155): n is a, c, g, or t
  misc_feature (157)..(157): n is a, c, g, or t
  misc_feature (167)..(167): n is a, c, g, or t
  misc_feature (173)..(173): n is a, c, g, or t
  misc_feature (177)..(177): n is a, c, g, or t
  misc_feature (183)..(183): n is a, c, g, or t
  misc_feature (194)..(194): n is a, c, g, or t
  misc_feature (214)..(214): n is a, c, g, or t
  misc_feature (224)..(224): n is a, c, g, or t
  misc_feature (226)..(226): n is a, c, g, or t
  misc_feature (1171)..(1171): n is a, c, g, or t
aaaaaaaagaatgaaacttatttcaaaccctaatatcccaccaggccacaactccttaattggagtctttggttcttctttagagaattntnanaagtntttnnangngnaggnaaanngantaaggnaatnanattgggnantngaatttggtntngggttgaatntgaatntttnatttgnttatgattatntaatatgaatttggaattanattggtggantngggaatgcatttgattattagtgattagtgcagaaaggaaaaattatccaaaagtgggaaacaggaagttattttatttatttttgaacaagtaaaagtaaaaaacaaaacaaatctttttaagaaaaaaaaatccatttttatttttcttcgtaacgccaaattttctctttttagtgccaaaaaaccagagtgtaatatgataaatttatgaagaaactcacctcccaaaccattgcatttcacttcatggaaagtctaaatcactaagatttttcatcgtgggcacaatttatttttcgttcacatttttggtttttcggggagctttagccctctttggctacgccgttggttccctaagtcccaaaaataaccattttccgctgtgtcaccagcgcaactctgccgaccattttaaagatggcaacttgttatcaaaaatatacgaatttcttaaattcttcattgttttaaatagaatggttcccatttattgaaataaaaactgatttattcgtagcctatgttttaattgtccatacattcgtcaattattagaggggatggcacttttagagggaatcagtgatcgattgacgggaaatatttctttaacctaattgcctggatattcgtttgtcctttcatactcattaattaatcaatttggagggctgcttattgacaattggagtgatcggtaacaacaaatgttgggaataagtcgcaaggatcgctgcacttgaaaagacccgagacccacttagcaaatgaaagaattaaagggtcaaagtacgctttttaatttttataagcaaaattcgtaaagtaacataatcagcaatggtaaaagaactggattcccgtaggaaaaatattgaagcaaaaattcgaaggttcacataagttttctctgaattcctctggcttcctcctacattngtcatgcctgaattatga

SEQ ID NO: 30740 - DNA, 1061 bp, Heterodera glycines
ccaattttgcggtaaaaaaaatgaaaaaaaaaagatagccaatttttggtcaaagaattttttttgtttgcgtttcaaatatcgtaagatggttgatagggccagacaagagaaggcatctgttgtaccaagtttgcggtaaaaaaatgagaaaaaagagataaccatttttggtcaagaattttttttgtttgcgtttcagatatattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaattttgcggtaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgcgaaaaaagagatagccattttttggtcaagaattttttttgtttgcgtttcaaatatcgtaagattgtttgatagggccagacaagagaaggcaactgttggtaccaattttgcggtaaaaaaatgagaaaaaagagatagccattttttggtcaagaattttttttgtttgcgtttcaaatatcgtaagattgtttgatagggccagacaagagaaggcaactgttggtaccaattttgcggtaaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgcgaaaaaagagatagccattttttggtcaagaattttttttgtttgcgtttcaaatatcgtaagattgtttgatagggccagacaagagaaggcaactgttggtaccaattttgcgttaaaaaaatgagaaaaaagagatagccattttttggtcaagaa

SEQ ID NO: 30741 - DNA, 2212 bp, Heterodera glycines
ttctcagatgcagctgaacggctcttccatcctttccatcgttctcggacgattatctcaaaagaatgcctccgccgttcattgcgcggccccgccccccgccacagccgccgctctcagccggcaccgccattccagcgccggctcaattcagtcggacacgcggcgcaatttgattgctttgaccgcgagtgtaggcaacgctttgcaacggacgaaacgcgagttgcaacggacgcgcctttggcacgcattttacgccttcgctttgccaatttatacggtggcaggagcacttcttttccaggtgattcattaattgcgactacatttgccaattagtcacctaattacggtttttaaatgaatgttttgtttaggcgttggacggtgcccacgatgaccaacaattggcccaatatgagcagcgatgtttggacggacgtacaacgaaattggctgaattggagaaattctgcgacgcgcagaacagcgcggactgtttccgacaaatgaacacatttttgggagaggtggaaaattgttatcggagatggcacgaagtgagtggcataatgggaaggactgatcagacaaagaaccaacaaaaagatcaaccggacgataacccatccgatgtccgacttcacaaatgccatcatttacgccttcaggcaattcttatgccagccgattaattaatttatttattgattgactgatagttgaccccgggagtaacactttccgcggccctttcagcgtgtacaccacaattggctacggcacaatctctgccagcacaacctccgcccgtattgccacggtgatttacggcgtgtttggcattccgttgttcttcgccttcatcaaagaggaggggaacatgttccgcaacgtgctcatttggctgtacaatcgtgccaagtattacggcactcgtcgcttggctttcgcctcggcaaaccttccgcagacattgcgaagtaaaggcaaattgtaagagaaagacattggccaactccttcagaattctcttcgtctcggctgttgcgttcggtgagggacggacgacggccgagggacggccatttgagtacagaaggcgaggaaaaggaaagggcactgctggcgaagggcacgggaagcagccaaaccgaactgaccacggcggaaaacggaggagcggagagcggcacatttatatttaatggtgggaaattgggtgggagaggggaaaagaaaagataaaagggaaatgtgcaaaggggggcaaagaagggcatgagatttgcatgtaaatacaatactttgacaggcacaagtcgtcagaagaatgcccgtttcagcaaaaacccgccctttgtgcgtcgctctagtgacctgtcccttccaaccggtactccctttcccttcccctttccctctctccctttctctctctctttcactgtcttttttctttgtctgtgtgttgatgattcgcttttgtccctccactccattttcagcatggaaaggctcttccgcctcctcttccgtcgcttccggtggttgccgtaagcaactcgtcgcggtcgctgccgcgcgcaatcgctccgccgcgtccgattcgaccgccgcgttggaacagcggcgcgtctttctgtgcggagtgttccttttctgtctctatttgttggccgtgtccgcgctgttctccctgatgaccaactgggattacttcacctccttttacttcttattcaactccgtcgctctgatcggatttggcgacgtttttccctctcagtcgcgcatcattttggccaatatgtcattaattgctctctttgtcggtccatttgctaatagggtgttaattagttcaggttcttcatcgtcttgggcgtcgttctcttctctatgtgttatttcattcttcaggaagagattcgtgccaaagccttcgaagcttcgcggaaggtgccaatcccttccttatcagtgcttaacagttttgacctcaggcgaggatgagcatcaccaaatactcgcagtctctgatgcttcacacgcggccgtggagccgtcgaaattcgccggcttttgacaaaacttcgtcggcggaaacgccaatcaattcgacagactgcgcaaacggcgacagtcggcgccagtcattgcggtgcagcggagcagcgacaacggcggaggcaaggggagggcgagc

SEQ ID NO: 30742 - DNA, 1014 bp, Heterodera glycines
  misc_feature (56)..(56): n is a, c, g, or t
  misc_feature (71)..(71): n is a, c, g, or t
  misc_feature (943)..(943): n is a, c, g, or t
  misc_feature (968)..(968): n is a, c, g, or t
agtgatcactcaatcaatgctcggctttcctcctttcttttgctgcttttcctttntattgaaaactgacncccttaggcattttgttgctaaccaaattaattaatatttattggctttttttaattttcaaaagttcgtttaaaacagacactttacgcaaatgccattggaatgcgattccgccgaaatttaccaccaatttgacacccaaagccaacaacagctgaagagaggacaaatgccagtggacgacggtgccgtagcaacggaagcacacgcacaaaacggcaccgccacccgaatcacttttgagaactttttgggccaagtaaagtgccaattgtcggtattgctttcacaaaaagggcattttgaggggcgagtgaatcaattgggcggagtgtttatcaatggacggccattgccacacgaaaagcgcgttcaaattgtggagatggcacgcaggggcataaagttggccaattgacggaatccattcttaattttgtgccttacagaccctgcaaaatcagtcgcgaactcaaagtttcccatggagcagtgtcgaaaattctcaatcggtgccaaaaaaacaacaattagtgattgtgaatgaatttctttttttaggtttcatgagacgggctcaatttctccaggacaggtaaaaggggagacaaagctatgagaacgagagacttaagactttgctattatttggaaaaagtgacagttattttttgaatatatacagtattcctttttgacacacacttacagtaccaccatgcgatgtcttctctctctctctctctctctctctctctttctctctctctctctctgtgttctctcgtctgtctgcttctctctctgttctctgtgagtgtccaatttaattgccatttcgacacgaccaacgaatattttatgtttatgngtgggacgggggagaagaccttgancaatttgaaatggccttttaaaggatggatttgtgcgaaattttgg

SEQ ID NO: 30743 - DNA, 753 bp, Heterodera glycines
gaaaatttttatttcttagggttatatttttgaaaatgttagggtcgattcttaggggtataattttctaaaatttttggggtcggttcttaggagtatattttccgtttttattgcatttttgttaataaattttgggcaaaatgccaaaatagtgatttttagtgacgaaaattgatgttcaaacaaaaatttcaatgcagaaatacgtttcttaagctttttcttcaaaacaattgagcaaaaaaatagttaaaaactagaaatcgcatcttaatttgttttgtcactttctaattgacttgcgtgaggtttgtttcatattttcactgcttccattgctaaatttgtttgttgccgttgaaaaagaagcttctgtcggaaaagtttcagcagctgttgtaacattatcatctttcaaaaaaaaattagtaaataatttgagtttttgaatattttgtggcttttaaacttaattaattatttaaaagaaatgcaattaaaaatgcggtgttaatttatggacgtcctttttgggtcagattattttaaagtgtgcttgtttctgcactaaaagatgatactgaaaagagacgctaaaaggataagaacctaaatgaaattaattaaaaataaatattattttaataagattaactcatttcgacgctgtccaattcgttgggcattgttccatcatttggcatttctgaaggaggaaattccgaggataaattattatttgaaaaattt

SEQ ID NO: 30744 - DNA, 1521 bp, Heterodera glycines
  misc_feature (1446)..(1446): n is a, c, g, or t
  misc_feature (1460)..(1460): n is a, c, g, or t
  misc_feature (1493)..(1494): n is a, c, g, or t
catcgacgtcatggcccaatacgaagcagagaaccggcagagagcaacaaatgctcctctgcccgggtctgatgatgctcctccacccgtggctgaagaccaaagaggcccctggtggtttgaccaggattgggggccccagctcccaatggtccctgaaaacaggggccaaaatagccaaattggcgaacaacgaggcgattggggagcccatgctcctccccgacgggaaccatcgccccgtgaacacatggagcgactcaactcgtgggttgagcgacaccacagccaacaatggtacgagacggctgtcattcgccgtgacgcggaggaacacctccgccgagaactgcgcaccggtgccacgctttttgcggcacacctcggtccattcgcgaatgtccatttcgacgggttttcgcgttttggacaggctaacacgcaaatgtttccgggacggactgtccgggaacatttccgacggcgcgggttccaggtggaccagaatttgccatgcctccaagagtatggaggcttcagcaatagccaacaaggaatccatgtcgattacttcccaatcgacatggtcaatgtccgattccaaatcggagctgatcggagggaggccgagccccctcgtcctccccgaataagagcgtatttggcattggagtaggctccaaatgaccaagaggggcccaacaggggacccccgtcttcggcgtctcttcgaggccattggcttccgaagagacaatccgaacattggcgatagggcggaaaacaatgcccgccaagcgcctattcaacgcggagagcgagccattgacaatggccgcccaatttcaccggacggaagctttgagaaccgcccacgaagggcggttcccaaccgtccaacacaccgttggcaaaacggcctattcattgtggctttagctttgtgcctcggcaatttggcagagggaaaggaattcccttcgccaaggactgaccatcagtcgcttaaagcggcggacatggcacgtgaaaatcaagggggattttcacgaatacttttcccatcgccattttcccacgatcagaaagcaaatctgatccaaggaccccgccccttcaatggtagcggaacctatataaggggaaggataaggcatatcccaccaccacttgcccttcccaaaatgccgaaacccatcaaaatgccctcctcgtcatcgtccgcctattcatcatcatcatcatcattatcatcatcgccggatcgccagtcgccgccaccgccccgcaaaaaggcggtggaactgttcaacattgccgcagcaacgcctgagcgggacgcgaaaagcggacggaaattttccgtccgcgacttcatcgacgcggaggcaaaggaggagccttcctcaaaacgcctgccgacgtgttcggcgtgccaactctccnggcatcgcctcggngcaaaggcctgccccctctatgtagctccacannagggagcgggtcggcggcagccagccg

SEQ ID NO: 30745 - DNA, 1550 bp, Heterodera glycines
  misc_feature (136)..(136): n is a, c, g, or t
aaaatggggtatgaaaagtttattggggaaaaaaagacttttacaaaataatacccctgggagaagggagtgggaaacatgatttcaaaattttcaattttttctagtctaatctactcaaaacggctcagaatcnaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactacaaaataatacccctgggagaagggagtgggaaacatgatttcaaaattttcaattttttctagtctaatctactcaaaacggctcagaattcaataaaaataacattcacggtgcgaaaaatggagtttgacaagtttattggggaaaaaagactttacaaaataatacccctgggagaagggagtgggaaacatgatttcaaaattttcaattttttctagtttaatctactcaaaccggttcagaattcaataaaaataacattcacggtgcgaaaaatggggtttgaaaagtttattttgaaaaaaagactacaaaataatacccctgggagaagggagtgggaaacatgatttcaaaattttcaattttttctagtctaatttactcaaaacggttcagaattcaataaaaataacattcccggtgcgaaaaatggggtcagaagagtttgtgaagggaacaccacgagtccgcgaagaggccgagtgagtaccttcggtgcaggaaaattattaaattttaaaaattttttaattgctttttaaatatgccaaaaaatgtaggcttaacttttttagtgaaaattcgatcactcatattttttgataattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttatgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatcctaaa

SEQ ID NO: 30746 - DNA, 963 bp, Heterodera glycines
aaaaatcccagataatcttttaaaaattccaaatctcttcactatggataggtcccatccccctaaacactcttatggggatggatgccatccccctaaacactcttatggggattcacatcataggtagcgaagctcccaaagcgcgaagcgcttttttccagcccagagccgacggttcatttattttattatgaagatttctattattctagtcgtttgtcatatacagtaattgaagtcgctgtggtggacggacggttacttgaattttttgtttgattgttttttgttattatttaatttaaattctgaaagcattaattattaggtttagtatttatttattttttcttcatttgtttgaacactgtattttttcatcttatggaatattttttaatttctattttggatgatttttattactttatttttttttgtataaaataacatttttaaatgcaaaattacatttttcatttttcctttcttggtgttctttctcgttgtcttatggtgtggtatgcctgacattgttctatgtttctttttatattttttcaatttttatcttgtatattaataattgtggcaactttaaatacttgaacttttttattgaactgcttacttaaatattttttaaatttttcatctttaaatgtagtcatatcatatcagtttttgaatacaattatatcgcttttttcatatttatttattaatacaacaattgatttatatattaatcttgttttataaatactttaacaaaatttcctatacaaattatataaagaatttgttaaaaataaaatttttaacataaatttattatctaattattatttttttctttttgtcttcatattcaaagttttgctcttttatttattattatttattttatttattttacaatttcaatttttgacaatttaattttgtttgtacaaaatt

SEQ ID NO: 30747 - DNA, 1073 bp, Heterodera glycines
  misc_feature (54)..(54): n is a, c, g, or t
  misc_feature (63)..(64): n is a, c, g, or t
atctctaagtacatgcacactttggcattgtgttcttccaagccctcttttgtngttggtatnngtgcagttaatccatcctttaattacccctgcctcgctaaaaaaagagtgctaatgtgaaaaaggagtgcgaaaataagaaaaaattcaatttatcctcaagaatggcacaattcgctccgctggtttattggcaaatggccaatgccaacttccttcgtcgccttttagtttcttttatgccattttttgccaaaagacaatttacttcttttttcctccaacccttcaacaagtcatttcaccctcagctttcccccaatgtccttaaaatccgctttgaatgagtcgagtcgcttagcgcgatattggtttgaagtaaagcgaacaatggcagagaaaaaggaaaagccgaaaatacgctcggggaaaatgttgtaaggaaaagaggggaaaaaggggggtgaagggtttaagcggctgtcaagcaattggaaaggttggaaaaagggagggcacagcagagagagagaggggcgggaagatttgtggcacgaacaaaacccaataaatgtggcgggtggagggccgaggcgcaatgttgccttccatttttgccacaaaattcgaaaaagggcgtaaaaatgcaaaaattcatacaagcggctctttccaccctccccccacgagttcgccctgtaataagcgacacattttcattaaattttatttcccactggagggcaatttctacccattctatgccctccggtgccattcgtcctctccatctcccctttttttccttttttttgttgctcgtttacccttttccgaaaccattttactcctccagcagcagtgccttaagcactaaataaacacccacattttttcatctcctcctctcccctccggtcgcttctctttgcttttcgccgactgtctctgtctctgtcaatttcagtacattttgtgccctcctccatctcctgcccttcctcctccattttgtgccctcctcctcccgctctcccccggccttccccctccccttccaatcctcttca

SEQ ID NO: 30748 - DNA, 1161 bp, Heterodera glycines
aattcagatcaaaatgagttttagacaaaagtggtccttcctataagtctatcagtcacacatttcgtttggaattcgaatgttagccgcccaaatttggagataaactgaaattcagagtgtgcccttccttctgtttcaatttctgagataacactggtgtcatttgttggaagagattcttgagaagttgtaacaaacaaacaacgcaataaaaagaccaattttaagttaaaaagaacattccacattgagtaatctatttttttaaattaacattaatttcttaaacaaataaatatatttaaacatataaacatcagtaaaaaattttgagttgttgctagcgggtatactctgttttaaaaccagtatgagtgcatttatgtgcacttttattcgctgggcgtcggggttttcgttcgagttcaatttagtgatacagcgttttgaataggagactaatcttttgtcaagagtcaatcgggaattttttattctagttactctaatgatctcgttagaaaatttttattttattaattaacaaaaaaacactgctttaaaactataatgtaattattttttcattttaatgcaaagttcttttggaaattaagtatttaaaattgttttgaatgtttttttatagcttttgcatttattttttataattaaatttatttttaattaaccgataaacattctcttgacgaatgttttcttttctgtatcccgtatttctgagataataatgatcatttaagtttttgttaaaaaaatgtaacaaacttagctatttggtactaaaagaaagttttgtttattttttaccaacatttttcacatagaagtgttactttttggtataatacaaatcattttttgtcgcagaatctcatcttccacaattaaagaataaataaacatttttactttactttcttcctttattctagatgttaaataaaaatttaataaaataccattttacctaatcactttgattttgttttcattttaaaaatattttcgaacctaatataaattttcattttttagcggacacaacattattaagctcatattttttggttttattagatttacgtgaaaatataattttaattctatcgaaattttttgatttttgatgtcacg

SEQ ID NO: 30749 - DNA, 884 bp, Heterodera glycines
ggagaccgaatccttccggaatagcttcactatatcctatactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatattttttcccagaaaatgctctaaagcgcaccaaattttatttacaacttaatttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagggcggggggg

SEQ ID NO: 30750 - DNA, 903 bp, Heterodera glycines
ggctcaagtccagtttatgcgtcccatcgacttttatgcgtccaatcaaattttatgcgtcccatcagtttttatgcgtccaatcaatttttatgcgtcccatcagtttttatgcgtccaatcaaatttttcattaaaataaatccattaaaacaaaaaatgcactataatagccaagtaacagccgtctctacgttcgtctgggacaaaaagcattgaaacaaaaaaatgcactatagcaaagtgacagccggcctttctctctccatttgtcggcaaaaaccaatactagccgctttttctctccgttcttcaaactcaggttgctatgtttcgactagctatattactgctgacccgccctttaattttgtgtatggaatggcaaggctttatcattgacaaattcggatatcgaagagcgcacccttggcattgttgcggaatttgtcctgacaataacaacatctatgacaaaggtcgttgtgttaacgaatctagctacgaaacggaaaccgatcgttatattcgcaacacaacttatgtatttatgactggtatttctgataagccttatgtaaccgtaaaaaacccgtatagggatagaaggctgttgaaattagacaaaaaattgattggacgcataaactggacttgagccgaaagtaaatccattcagaaagggtagggaatgaccaaaacgaatgtttatgcagcgacccattaaatgaactctttccaattcaaaacttaacctcgcatattttgccgctctctcattaagttcgattgctctcttttcgtaattgttttgccgctgagaggaaccggcagaaataatttccgtataaattgcggccaaagaattttggagatgtgccatccgaccatttgaaatctccg

SEQ ID NO: 30751 - DNA, 1105 bp, Heterodera glycines
gcgcgcgtgttgaaatggtacggctcaggcaagggagccgagcgaggtggtctggcagcggacggcgatgggagctatcggcgcaggcaagggagccgacagcggccggctcaggcaagggagccgagcgaggtggactggcagcgcccggcgcaggtaagggagccgagcgaggtggactggcagcggccggcgcaggcaagggagccgagcgaggtggactggcagcggccggcgcaggcaagggagccgagcgaggtggactggcagcggccggcgaaggcagcgatggctcccttgggctgagtgctggcagcggacggctcaggcaagggagccgagcgaggtggactggcagcggccggcgcaggcaagggagccgagcgaggtggactgacagcggccggcgcaggtaagggagccgagcgaggtggactggcagcggcccgcgaaggcagcgatggctcccttgtgttgagtgctggcagcggccggcgcaggcaagggagccgagcgagcagcggccggcgaaggcaagggagccgagcgaggtggactggcagcggccggcgcaggcaacggagccgagcgaggtggactggcagcggccggcgaaggcagcgatggctcccttgggctgagtgctggcagcggacggctcaggcaagggagccgagcgaggtggactggcagcggacggcgatgggagctatcggcgcaggcaagggagccgacagcggccggctcaggcaagggagccgagcgaggtggactggcagcggccggcgcaggcaagggagccgagcgaggtggactggcagcggccggcgcaggcaagggagccgagcgaggtggactggcagcggccggcgcaggcaagggagccgagcgaggtggactggcagcggccggcgaaggcagcgatggctcccttgggctgagtgctggcagcggacggctcaggcaagggagccgagcgaggtggactggcagcggccggcgcaggcaagggagccgagcgaggtggactggcagcggccggcgaaggcagcgatggctcccttgtgttgagtgctggcagcggccggcgcaggcaagggagccg

SEQ ID NO: 30752 - DNA, 710 bp, Heterodera glycines
cagcagcaggcggtagggggtcagttccgtcccagacttgtttaaaacatcataacttttttttcagttggccaaattttatatatttggcatcattcgaaagctctacctacacctttggaagcttttgataaggtatttctctgcgattgaacaacttataaaaaagttgcaacatgaatactagcaaaaagtcagaatttttgcatattttaatttatgacttttttatatgtatgtatatctttatgatttttgggaaaccgatagagcgtgttaagagctttcgaatgatgccaagtttattgaatttggtcaaaaaagaaaaaagttatgatgctctaaacttggctgggacggaactggactgttccgccagcaggctgtcgggattagagttgagcgggcgggaccgggaattttgggcaaaaggtggaccgggaattgtcgggacctaagaagccgggaccgggaccaaccggaatttttaaaaattaaaaaaaaatcaaattttaatttatttcaagtgaaaataatgagagaccgacgggatcgggactcccgcgagtttttacgggagtcacgctcccgactcccgtactttttgccctgccggattttaacgggattcccgttcgggactcccgtcccggaaaatttttttaccggactccaaaaataatacaaaattaatttttatttattttgat

SEQ ID NO: 30753 - DNA, 1693 bp, Heterodera glycines
aaaatttgagtgtaatatattaacagaacttgtcaaaaaatgatcaaagttttggttaaatttgcagttttaggctgtttaaaaaaagaaaaaataataatttttaaattgaaatattttttattaattaaaatttcaattgaaaaataatttaaagaaattatttaaaaaattctgtaccgttggggaattgaacccacgagaaaaataatgaaaggcagaaggtttagccagcagaccatatttgaattggagctatccaaaaatagagaaaacattaaggaaggaaagaaagagatttaagatttttttttcgcgtaaatttgaaaatttttctggctgctcaaaagttcaatccttaggggtgtattatcaactctcgcctctcgtcccaaaaaacgagaggcgagagacgagaggcgagagtaccaaaaatggcgagagttggcgagaggcgagagacgagaggcgagagttgtcccacccctggtgcgcagctgcattacttgccaattgcgtcattccccaacacctgcatattgagctgaaatgaaattgccaaaggtgaacacacttttcgcgaaggttggtttagacttggctggcccgattcccaatcacgaagaagggcgaccggcacgattctttgtattatttgctggttcacaaggtttgtgattgccgtgcctgttcctgatgccaaggcagttactttggtaaaggcatttttatctaactgttatttaaagttcggcggatgcacagaactcatcactgacaatgctacggcattcacttccgaattctttcgagaattctgctccatgctctacataagcaaacgatatgcgacgccacactggtcgcagggtaatgctacgactgagagaagcttccggactttccacaacatcatgtcaaaatatgtgtcttcggaccagcccgactttgatgaacacctcgacatgacaaccttttgctataacaccgcgattcattaatcaaccggtgaatcacctttctttttaatgtatgggcgtgatccgatcttctgcattgatcagattttagacccaaaatcttctcgctcgtctttagtgagtgatttgtctgaattcaagcaaaagcttgtcaattccttgagaacagcttgggaggctgctgccggtgaatctaaacaggcacagcagcgggctaaggcccaatatgacaaactcattcggtgtctggaaatcaaagttggagacagggttttactccgaaattacgctggaaaagttggcacgtcaaagaagttccaccttccatggaagggtgtgtttcgagtaattaagattgaagaggtgatggtaacgattgtcagttgtaatgccccgcaggctaaccctaaagttgtgcatattaatcagcttaaaaagtgcgtagaaatcttaggacccgcttgcaccgcaccaaatgtctccgatgaggagaaactttctttggaaaaagcagatgctgttgaagtatttgacatgcccggttttaatcatctgaactcagacaatccaaacaaatccgaaacagaccctaacactgagtccacataaacttttgcattattttgctatcttcccatgtaccacaatactctttgaattctgttccctccccatttgatttcagattcaaaactcataatcctccaaattcc

SEQ ID NO: 30754 - DNA, 1427 bp, Heterodera glycines
tcaattgggaaaaacaaaacaaatcactttaaattggggccattgaataattattagaagcgaatgtccaaaaaatgtgaagcgatgaatgaatcgaatgatttgagcagtgaatttattatgtattagcaaatgacggaccaatcgaacgcatttcccaatgattcattttttgtcggctaatttatgaaaaagcgaaagagaaaagtgcgaaaaataaattaatcttgttgaatagctagaaatttggattggataatcattaaatcacatttcactatctctcgctttcctcactttctctctcctctctctctctatctctctctctattcagctctctatgtttcccctttttctctcacactcattctctctttccctctctcaccactctctttctctcctcttttccctgccccctctctttctctctatatttctcccttttctcacacactctccctttctctttctctctcttctcactctctctctcccccctctgtatctttccctctatatttctcctttttctttcacactctccctttctcttttttctctcacactctctcttcccctctatcaccacccttctctttctctctatatttatcctttttctcacacactctccctttctgtttctctctcttctcccttctcactctccctctcccctctctttctttctctctccctctcttccgctctctcttttccccctttccttccgtccgtctttctctctgccgtttctcatcgcatcacaatgtctttgaagtgaatgcgaaatttattccctggaaattttattcgctgttcttctgtgcccattccgaattgctgcttcatcagtgccaacaattggtcaatgttcggccgtttttcggggcatcgctcgaggcatttcttttggggtatttattgtattataaaattaatttttaatgaatttattaatttacttttataactactgtaacctcggattactgtacagactaaatccctataattcgatgacctttttccatcacaccttaagtatgttaagcatcgcttcgtcttcgtactgtccgaaatgaatgggctcagtgccgtgcaaaatcgctggacggagtgccgcgtccgcgcgttccatccgttccgtttcgtcctccacagcatcgaattggtgcaaaagggcggagtacggtgaatgaccgtacaccatttggtacagaatgacacccaacgaccaaacgtctgacttttccgacatctgtggggattagggctcaatgtgttcttccggttgggtttacttggtgctctctccgcttttccttaaactcgtcaccgtgctgtgccccgcaccatgccatttgctccggactcatatacatcactgtgcctataaccaatttgttcgttttcgtccc

SEQ ID NO: 30755 - DNA, 1581 bp, Heterodera glycines
  misc_feature (1483)..(1483): n is a, c, g, or t
  misc_feature (1491)..(1491): n is a, c, g, or t
  misc_feature (1509)..(1509): n is a, c, g, or t
  misc_feature (1530)..(1530): n is a, c, g, or t
cgttttcaaataagggagatttctggtcgttttcacatccgtagtgaaaaattcagtcacgattttcccaatcggaatctcccggcaaggttttacggaaaagaattctggacactcctgaccattttcagaaaaggaattcctgtcgcaaaggaaaaacagaattcttccggtcacggtttccaataattctggaggtttctggccgttttcagaataagtagcataaaacccggttacgattttccaaaattggaactctggtcaaggtttccggaaaagaattctggacactcctgaccattttcagaaaaggattccggtcgcaaagaaaagcagaattcttcttggcacggttttttattacgggtcccttattattcaattaacaataaaaactaagtaattatcctataaaagtttcctttatccattgaatcactttttgccacatttcacgagcagttgaagggctggaaatgtgaatgaactgaccaacatgcatatgctataggtgacgaactgaaaaaacaaatcaaattaaaatgaacatttaaactgtgataaagaaatgcatttttaattatctttaaaattaatttattaattttattttattttaatttaaattatataaatgtttctagttcttatggataatttaattattaattaaaaatgattgaaataatgtatttatagtattaattaattatttgccccacttgtgcttcaagtgacaatgcaaaagcaccatttacatcgacaataagcagtgtgacgactgattggagcagaagtgcaacaaaactgttaatgccaaacacgaggccataggcgccatttggtgacaaatgagtggcaatcaaattgctgagcaaattaatgaggcaattaaacatttttaattgttgaaactcaatctcccggcttaattcttttagaatttggtaataatccacctaagatttttttaattttgttcaaaataacctaaaatatagtcaataaaagatgcgggttttttatttataggattgcccggcatttttgggggtagaatttccgaaattttttgaatcatcgaatttcaaattgccgaaaatttttggcgccatagtgacctggaaatggcattgagcgtattgtaaaacatataaagcacaatgtaaagaatgtaatcggcaaagagcgagtcaaagtgcaccattgcatacagtaaccaggccatggacattgtggaaacgcaacacaccacgacactacggtactcggcccatttgagcggaacgaactgggccaaaaatacaacaagcgtgtcttaaaacgaatttaatcatattgataacataaacaaatactgttatagtaagaatttgcaaatatttcgcataaccattaaaaatttccatttcaagggcatgaaagcaaatatcaaaatattgtattagcaaaacaacaccacatataaaatttgttttgncattttancatataaaaaaggaatanaaaaacaattttttatattgnctggatcatgggagataatataacacttatttttaattaaaaaataagtct

SEQ ID NO: 30756 - DNA, 276 bp, Heterodera glycines
gcggacatctacatttttgaattgaaaaaaaaattgcctttactctttctttttctccatattgaccatcatactcatactccccccacccttttcttcttccgccacccacctcccccgctacgcgccgctcccctccccctcgtgctcctctcttgatagtttaaactgaaggcgggaaacgacaatctggtccccatcaagctagcttctgcaggtcctgctcgagcggccgcccggggatcgatccccgagctagtaacatagatgacaccg

SEQ ID NO: 30757 - DNA, 1346 bp, Heterodera glycines
  misc_feature (1340)..(1340): n is a, c, g, or t
aaaattgggcagtcgcatcaaaaaaaagaaaaagccgaccctatcgaagaaggcaacaaaaaaacaacaaaagtgaccggcagggaacagcagaagcaaacgaacaaattgaaacccgtaaaacataaaaagtaaacgccctccagtgagactcgaacacacgactcttcaaaccggcggggacattccgttgtgaactggcatcacaaacggaattatgctgttacattaattcaaaaataaaacaatatttcgaattaaaaatggtgaatatcaatacccattatatacaaaaattcaaaataaataaatataaaaatcaaatgtcaattgagtgtctttaagcgattaagtgttgcaagtggaaatccatcggtgttcgagacattcgcggcattccatctggcagcaacacgcgaatttgcactcgcctttgtggggcaccacctcatgtgttgcatattttatggggacattcgatcgtttgtcggcctcatgtcgggcgcttcgcgccccgttttttaatttttttgggggatattcggccgcttcgcggcctcaggacgggcgcttcgcgcccgttttcaaactttgtagggaaattaggacgctttgcggcctcaggacgggcgcttcgcgcccgttttttaattttgtgggagggatccggccgcttcgcggcctcaggacgggcgcttcgcgcccgttttttaattttttgggagacgtttggccgcttcgcggcctcaggacgggcgcttcgcgcccgttttttaattttttttggggatattcggccgcttcgcggcctcaggacgggcgcttcgcgcccgttttcaaattttttgggggacattcggccgcttcgcggcctcaggacgggcgctcccacccctcagaatccccaataacacggggattctgaggtcttaaccatgtctaaagtaaaatctgattacatattcgtgatcagcggcgcaaataacctctaaagacatatttttggaagatttttggtgaaaaaaattttccactcaaaaatcatggtcacacccctgtggtcccgaaggccaaaatcacttttatttctataactttttttaaaaaagtgataaaaagctaaattaaaatttataaaatagagcaaaaaattgcggattttttcagtatttaaaatttcaaaaacacctttacggaaccgagttctgaatttttttctgaaaaatcgaaaatttccagaatttttggaataacttttttattttggaagatagaaattccaaacaaatctcataaaattctccttattttttgctattttttcaaccttattccactanatttga

SEQ ID NO: 30758 - DNA, 966 bp, Heterodera glycines
aaaaaagtttttttcttttttttgttatgagatttttgggcttaggtaatcaaagcgtgtacgtcatgaaataaacgcaccaccgccaatcccaaacacgctcacagacttaatcatcgcagacgcatacaaaatgtatgggcgcaccgaagaacaaactgaacacgatttggcatttcattgaccttctgcgaaggatcaatagttatcggatgatgacttcgcgaagtgttcaactggacaagacccaccgcaaaaggcaaagaaatatcgcgaagcagaccgccgaattctcacgatggttcaaaattatttaccactcaacaatggagaccccaatgtttttccacttgagcagcgctttaatcatctatttatcattacctttttgatcggaatttctcgaaattatgaaatgagaccgtgatttgaaacagataaaatgttatttaattttcttgcttgttttaatagtactgtttattaatattcatactttggtagggaaatggcccaaatgccttagtagggaaatgcctggtagggaacccaaaatttagggatttttgggtaattttttttaagaaaaaaaatttttttttgggggggggcgtgccgataggggcgaattttaaatttatttctaacagatattcaccaaaaaaattaagactttttcgataaattttcgttttttaactatattaaattatcgtgatttactcaaaattggaactcagattttttaaattttttttcttgcggcacatttttcaaaaaaaaaaacttgatgaatgtgcgaggggagagttccggcggtgccgataggcgccgccgggaaaattttttgaaaatttgaatgcaatttgttaacaaattttgtacaaaaaatgagcaaaattcgcaagcttgggataatttttaagaaaaaatataggaattttgggggccggcggtgccgatagg

SEQ ID NO: 30759 - DNA, 1200 bp, Heterodera glycines
ttttttttggcttccaaaacttcatcgaccctggttcttttattttctttcaaatcgccccaatttttttttacagctaaactagcccctattaagcttatttccagaaaatctcgcatgaattctcatttttaaattttttatagatttttaaatgttggattttttttgcttaccaaaacttcatcgaacctgttctttctattctctttcaaatcgccccaaattttttttacagcttaactaggcccaattaagcttatttccagaaaatctcgcatgaattccatttttatttttttaatagatttttaaatgtttggatttttttttggcttaacaaaacttcatcgaacctggttctttctattctctttcaaatcgccccaaattttttttacagcttaactaggccctattaagcttatttccagaaaatcccgcatgaattctcatttttaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagccacgaggccgcgaagcggccgagtgagtaccttgggcgcaggaaaattattaaggaggagggttcattatttatttatttttgcaaaattaattcataaattttttttcagaaactgctctgaaacgcaccaaaatttatttacaagttgaataaggcactctgactcttatattatcaaaaagggagatgaataaatattttaaaaatttctaattcctttttaaacaggccgaaaaagtttaggcttaactttttcagcgggtttaaaaaatctagaaaaattagtaagcatttgtagtgctccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaataagtaagcttttgtag

SEQ ID NO: 30760 - DNA, 1857 bp, Heterodera glycines
  misc_feature (1698)..(1698): n is a, c, g, or t
  misc_feature (1830)..(1830): n is a, c, g, or t
cagtagtaattggtcgggtgatgaaaaaacagtgatcaaccggtcaaatgattgaccagacattacgatcacttgacaatggcctctttagtactgctcagagttcccgaggcttgagatcgaaattggttcgggaattgaggaggagcaaaaaaaaaagcgaaaaatttcccgagttttgagtccgagaatctcgaacagctctcgcatggtgtaatgacaacttgtacaaaagataactcgcacaattgcttaggttaggctaaagcctaagctttaggcttgtcctaggcctaggcttaagctaggctttattttctgaaatacgagttgccattgaccccatcggtattttgagtgccaattcgtcaagtttttatatgtattggacaaaagagcaccaccgaccgaccatataataaggtccaccgcccgaaacgacgccattggtggcaatggcggatagcgaaatggaggtgagaaaagtctgaaaaaggagaaaaattttatttgaaagaagcaaatcggacacataaaaaaggatgcaaactatttaaaaaagcgatcgatcattttttgatcgaattgatcattttgatcaatgataatttcaattgggaaaaaacagctggatgatcaggagggatttattggaaaaggcattgatttggtcccagcaaatgatcatgtaatcgccgcttaccacgctgcagcacagcaacacaaccatgaacgcctccaaaatgccggcggtgccgacaatccacggcaaacggatgaagaagagaacgccgaaaatgttttgcaggcatggaatgtagctgaacagcagggaggacaatatttagattatcctccacagagaataccaccaaatgaatttggctgatcagagtgcccaatgattaatcccgctgccagcatttatacttacactcccataattgtgcccaatttggcggtttgtcgcttgggcgccccttttgtgccgccgttgcgctccttttctccgtttttgacgcctccgtttgtcgcccctttggctgtcgactctttgtcctcctcgtccaccgctgtcggcagaatggcgttgtaaagggacagcgaacgcaacatttggccaatgttttgtccgcccttggagcagtcgtccttaaaagggccacaaattgattcgctactgcttctgctagattgatctgccgcggtaagtttcggtgaattaaacgactctgatcagtgtcgagaggtgatttgatcagcaattcactgactctgatcagtgtcaagataaaaactattgactttgatcagtgtccagggtaaattattggctttgatcagtctcacccattgactctaatcgagagtttcgtactgatcagtctcacaatcagtggaaatgatgccgtgaatgggttccaaagtcgaatcccgaggcattaatggtttagtcggagtgatcagcaggtaattttgttatcactcgataactccacgtcccgatactcaactgacctcgtacaatgccatgttgtgctgctgttgttgctgcttggcgcacaacggctccttctccgtcgtctccgtggcgagtcgcgtcgccgtcggcggcggtgccgtcggcgtcttagccgagcttccgttgtgctggtgccgatggttgctgctgttgtttttgtgcttgttgttgtacgngcatttcgttgttggcacccgtcgccgtgccggcgaagtcatcgtcttcgtcgtcgtggagttgtggctgttgttgctggtgcggcaaaagcaccgcgacgggccgtcccccggcggcactgccctcatgtnggtgcatcatcaccgtggctgaatcat

SEQ ID NO: 30761 - DNA, 859 bp, Heterodera glycines
gctcaagccattttccaaccgaccatttgtagggctcccccgcatatagtaatgcgttttcggggaaaaccttctcgttggaggctgtagaaaaaagagttagccatttttctgagaatatctttcggggaaaaccctctcgttggaggctgtagaaaaaagagttagccatttttctgagactatctattcttagtaatggagccattttccaaccgaccatttgtagggctcaaccgcatatagtaatgcgttttcggggaaaaccctctcgtttgaggctgtagaaaaaagagttagccatttttctgagactatctattcttagtaatggagccattttccaaccgaccatttgtagggctcaaccgcatatagtaatgcgttttcggggaaaaccctctcgttggaggctgtagaaaaaagagttagccatttttctgagactatctattcttagtaatggagccattttccaaccgaccatttgtagggctcaaccgcacatagtaatgcgttttcggggaaaaccctctcgttggaggctgtagaagagtttaaaaaagagttagccatttttctgagactatctattcttagtaatggagccattttccaaccgaccatttgtagggctcaaccgcacatagtaatgcgttttcggggaaaaccctctcgttggaggctgtagaaaaaagagttagccatttttctgagaatatctattcttagtaatggagccattttccaaccgaccatttgtagggctcaaccgcatataagtaatgcgatttcgggggaaaccctctcgttggaggctgtagaaaaaaagttaaccattttctgagaatatctattc

SEQ ID NO: 30762 - DNA, 1229 bp, Heterodera glycines
tagtaggtaattatgtaattttttttaacccaccccgtttgttttgttttctaaactctgattttcaaaacttttttgaaaacctggcgttgggattctgatcttcggtctaatttttgattttaaaattatttaattaattaaaaactttttttttaaattttcatcattttagcaaatttattacaaaatatcaccaaaatgtttgccattttccacttggcttttctgctctttgcttatccttaatgtgccgaaggatcagacaaatgaatttgaagcagcgcagtcaccgtgttgaagttcgaatgtgttacgccatcatttttgtataaaattgcaaatcttctcttcgcaatttatctaatcacttgataattttaaactcttattgaatagcaaacaatttaaaatgattaatcaaattttgccttaaaaaagtcaaattgttgacccattttggaaacttaaacaaatcaaggaaaaacaactgcctgtttttatttttccttccttttccaagccttttaattatatttttgaggtttaatttaaagagctcaaaaaattttgaatgtatctttttggcattttgtcatcttttagtagaacgagaaatacacacctaggaatcgctttacaaaaaaaatttccattaaagtttatgcctattatatggctgatttgtgagcgggacctggtcaaggagggtgaattttgatttaaaaaaaataaaaaaattttattttttattattttagaatatgaatgatctcaagcgaaattaattttttttaaacattatttcgatttttgaattgaaaacttaaaacgcttttaaattcaatcaattctcgatacgtgaataatttgttaaattaattgttatcaaaattttcattggaaaatctcaataacatccggtcgcgtaatgaatcgggatttgggaccaattagctatatattcttggctttatttttatggcacattaaaaatttctatgcttatctaacaagtcatcattttatcaatagccaatatgtatatgtgtgtttgtttggatcatacattctttgtaaaattaataaaatttttagaattttttatattttatgcaataaaaaaaaattgtcataaaaatgcttagccctacaaaaatgccgtttattatttttggtttctccattatttgtgctcatttttgccaaattttgtcaaatcctgatga

SEQ ID NO: 30763 - DNA, 2239 bp, Heterodera glycines
  misc_feature (154)..(154): n is a, c, g, or t
  misc_feature (1284)..(1284): n is a, c, g, or t
  misc_feature (2222)..(2223): n is a, c, g, or t
gggcaagcagtccatgcacagagagagttacacgtgcatccgcaatgcacccaaatcattcaaatatataatccccagctgtaattgatgacgaaaaaaaacacaaatttaattggggtgggcggggaatgaatggtgttccttccccttcccncagaaagctatttaaatgccaatttttcacagcagaaccataaagaacggcaaaaaataaatttttaggtattttagcaataagaaatttatttaaatcaatgcattttaaaaaacaattaaatcattattctatttttaattattttcagttttcctaatattaacaattaataattattagcacaaatggcgctggaagcaatgggcttggactcgtcaactgacggcaacgacagcgagccatcactggccggtgattttgattttaaaaaattaacaaaaaaagtttgaaatgggacagaagaaagacacacatcagccaatcattggccatcctgacaatgagtggcgaaataaatagatttgctcataaattgtcataaataaatatttttttaagatttaaaacggcctgaaaatatggacatttctttaaaaatcctctattagaacggccccatttcaaagagaaaattgaaaattttagctttatttagtatttttttagcatcaattaagtcattttgacagtattttgcggtttgtaaacatagttattataattatgttttagctcgtttgttcaaaggtgttgacaccaaagctacacaacaggtcccagcgacaactattgtttagtgcaagcaacacagtacggcatctaacgaacgtaaatacattcgaatttaaatcatttcaataaaaaatttaataaaaaaaatttcattttttcaaatttatttttattattatatttaggaccctcttaacaatttgtcgctagcggcagccgacctgccgcaggaagtaaaaataattaaattataaatcaaaaacaataaaaaaaatttttacagtatcaatataactttatgttttttgactaatttgtaaggtcctttaaatctttattaattaaaaaaaaagaaaattcggtaagtgaaaacgaagcgaaaatgtaatttgaaatatgatgccaaaaaatcaaatcatttttatgtttagcattgaaatttcaggaaaagcttgtccaaatggagaagaacctacagcaaatgaagaagggccaaaagaagatcattggaagtaaattaaaaattatttatttcaattactaaacttactcanaaatgggtactgtaaattacagtgccatttaatatcctttcaaatttttgtgtaaaaaagtccttccgtatttaaggttttgccgttcaaattgaagacctgcagaacggacaaaaggcacttgtggaaaaaccaccacctgaagtggagactgaatagcacctgaaaatggagaatttagagatgtgccgttttattaattatttatcatcttaatttaattaataagcattaattatttcaaaacagagtgtgcatccagtgaaatattttcaaaataaggacataattgaccaaaaaaacaacatgataaacatttaagaacaaattaggacaagctttaatgactacgaatgtacacactgttttttaagcatatttattttaatttttttgtttatataattaatttattcggggacgaaattgaggcgaactttgcgcacaatttcgatccttttaaagtgcattaatttttttttttgaaatatttccgagtcaaattgattaaatgggttgcttatcgagagtgccatgcaattagtcaagaatgggctgaaaactcgggaacgacaatgagaaccgaaacttcctcatttcaaaaaagagtctcccccaattttaaaattggcacccctaataacattaaataatctcttaccaaatccataattccaaaaaacgaatggaattttgtgattttcagatttaaaacccgttatatatttattaagaatggatatattttttaaataatgatatttcttataattcgatcatttttacctaaattaattatcgatcggagaatggtcgaaaaaattgtaaaatgttgcaaaaaaaataatattgagcagggagagacttaaattggccgataaaaattgatttacgtcattttacgagttatgggagtggtggcgccagaaattggaccnntgcaggcccatgcaag

SEQ ID NO: 30764 - DNA, 1487 bp, Heterodera glycines
catcgctgtttctcctcgaaattatcccccccccggcgggtgggagattttatgccttttaagcattcgaatagcaccctctccccgattaagcaggttttccgcactttgaggcggcggccggggggaggggtgcaaatgcgtaaaatctcctttcaaaagtgccgcctcatccccctctggcggcactatggcaccccggcggtacatttcttttgaagcggattatgccttacacccctccacttcatccccccttgtgcttgctgttcatccaaagtttggcagcacccgtttggtgacagccgcttcatcgcattgcgtcatttcccccgcccccaaaacttggggccaaatgttcatcccccatcccctccgggcccgtgccaatttaagggatggtcactttaccgaaactcccctgtgccatatttccctcattttaaaacccgttttgccgtgccaattaactccccggctgccatgcctggctggggcaatcaaatggcaaaacacaaactagccaaaacgggaataacagtcattccgaaagacctcgtttttttcttggaatatccgcgcgacggggattatctcctctccccgcacccaaaactgagtgtgccatttaggcaccccttttttggcacaaagtttaagcgaataataaatggcgagaaaatttgagtgccacaaaccagcgacgagcatcatttctttttccggttgtgcccttctgatgcccccgactgctgcagtggatttgcgtcatccgttttgaaggatacgatcaaaaatgagtcccccgcgtttgccatccatttagcgcttccaggcaaaaaattttggcattggcacccctggacggggagaatttttttttattatttatggtgttatggtcgccaaatataagtaaagcggcacagaccgtatgccaaccgctgacgaataaccttttagacataaagcaaaagcatcctcccccccccgccccacattggcataattttcagcttcgtggcaagggcgtagccggagggcggctaaacccccctctcccgccgaaatccaacaaattttttgaattttatgcaattttcttaataaattgcattaaaatttcccaaaaatttacccggcggcgcttaactgcaccgccggacccccattttactattttttttttgaaaaatggagaccaaaatggcaaaaaacattcttcaacaatcttgatatcattcgagagctcttcagatgctctaatagcctgcaaaattccaaaaaattttgttaattttaaaccaatttatggccaaaaaagttggaaaatttggttttttgaattcttctggccataacttttttgaacctaaagtaaattttttaaaattttgcaggctaatagaggacacttagatctttccaatgattttaacaatgttggatttggatgacaaagactaaagtgatagctaataacatgc

SEQ ID NO: 30765 - DNA, 970 bp, Heterodera glycines
gtgttcccctgtccctccggttttctgatcccccattccccccacccctccgctttccccccattattggtccccactcccctctctcccccttcctcagttgcgtcatcagtgaagagttctgcatggaattgcctcgctcttccgttttccattctcttcaactttcgctcttcgaactcactgaaggtgcgcgaattcagcgatgcatcggacggatgaaactgacacggcacgagttggtcgcttacggcaataccattcagtcagtgtccactctctgctgaccaaatgcaatctttgcagagaacgctggctgccaattgctcgcattagacccagcgaattgaccgagactctcggcgcaatttgtgcggaattgagttggaatgggcagcgcaaaatgctcactttacggtgctttagtttatattggcactttttcaaacgactttgcacttttgtgactgtctcttccatttattcgtattttccgctttttcctcctccgattgccttttccttccccctctctttcgaatttgaactctcttcgtcttcccttctcatgtttcaccacatcccatcctcagagttttcgacttcaccatttggtcacttccgtccaacaatggccgtgtgaattccctccaaaggcattgcaacgacggcgggcgtctctttttgaagtgccgccttgggtttggccattcggcgtttagcgcaatgcaaaagatgcgattggtggagaggagaagtgttgagccggtaattgtgcttgttattcgtcatttgcttttggctttgtaaagtaaaaagtgtttgaggttcgtttcgactgttcgcatttccttgccgataaattgggacagcgtccgcccccccagcgcgaggggacgagccccccggggaacagccccccgctcgtcggacgaatgtactttctgcaggtcgccctgcgtcacgccca

SEQ ID NO: 30766 - DNA, 1003 bp, Heterodera glycines
aaaaagtagatacccatttttatgtgataacctctaaatataaaaattccctcaaaaataaaaggtctattgcgcacagccatatctctcatgctcgagagcatttgtatgtgtataaaatttatcaaaaaaagagatagccatttttctgggataacctctaaatataaaaatcctctgtgaaataaaatggcggttgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatatccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcacgggcctccctatcatgctcgagagcatttgtatgtgtata

SEQ ID NO: 30767 - DNA, 1732 bp, Heterodera glycines
caaacggggcttttgcgaaaaatggggaggggaggccattccaaggaaaccaatgagaaatgaattgataaagccaacgtgaatgctgggactgacttcgatgtcctcttggcccggcatgaaaatcaaaatgtcgccctccatgccgcccaagtgaattttgaccgcctgtttgaccgccgcgtcgacgtggtcttccacgggaacacgggcgtggtaaatctcgacgggaaatgttcggccaggaatttggaaaattggcgtatgtccgccgaagaaattggcgaatttatccgcatccattgtcgcagaagtgacaatcagtttcaagtcggaactaaaaaggaaacgtaagagaaaatttggaaaggaaaacgacagggaatgattaaccgaaaaaaatgaacagcgaaagtggaaagcactcaaataatgttgaaaattagatgtccctacttaattccgccgcagatccgtaaccagggggtgtgtggggaattgccaaacgcccgaaatgaaaaactatccgaaaaatgggaattttaaattaactgaatttcttaaaagatgaccaaattttcgtttcctcggcagcatctaggttttttttctacggcgctggaagctcttcggttgcctccccccaccgaatttttttctggttatgagcctgtttatctatgcaattttaatttcatttcttttaccgtcttgccaccacatctctcagcagtccaaacagaacgtcggtgttcagtgaacgctcgtgcgcctcgtccataatgatggcggcgtaggagtccaagtcggggtcactgaaaatgaattataaaatctaaaaaaagaatgcgtttgggatggcacctcaaacattctctcagcagaataccatccgtcatatactgaaaaaaattaaagtgaaatgcaaaaatgggaaatcgaagttactttaattatcgttttctcggatgtgcagtcctcaaaccgaatggcataaccgcactcctgaaaaccgaacatataaaggcaacaatcatctgccacattttctagagaatgaccaaggagtgtgtttttgttagattttttatccgtctgaaacaacaatataatcagcattccaacaaaatgtcgtcagcgacgaaacacacactttctatggcttcgcttttctgtccaattttggcactacgatttggattcaaccaaacaacccgtaattggttggtggtcttgccaatgccatacccttggcccacccgtcccccgtgccaacctggccaagttcgatgcccatctcttccgacacgcgcttggccacactcatcgccgccactcgtctcggctgagtgcagccgacgatggcacccggccgtcccaagccgtcctccaccaaatattgcgtcaattgcgtcgtctttccactgcccgtctcgccgaccacaacgaccaccgaattctcgcgcacaatttgcaacagtttctgacgcacagcgaagacgggcaaatactcgcgctgctggcgaatggttttttccatggcaaacgttgagacggcctccgactctttcaaatgggtggcaaactgttgagactcactgaagaaaaaatggcataacttttaagattttctaatttttatatttggatggattggtaaatgtataaactagaaacagaaatagtatcggatcatgaacaggatttaaggatttacagaacaagtcgtaaa

SEQ ID NO: 30768 - DNA, 958 bp, Heterodera glycines
gactcaaaacacctcaaaccctagagaagtgtcgttcaacctccgccatttttgctgtggtgcactcttttgccgaaaacgtacgatcctaacgagctttttgaaaagcgaaacttctgactcaaaacacctcaaaccctagagaagtgtcgttcaaactccgccatttttgctgtggtgcactcttttgccgaaaacgtacgatcccaaagatttttttgaaaagcgaaacttctgactcaaaacactcaaaccctagagaagtgtcgttcaaactacgccatttttgctatggtgcgctcttttgccgaaaacgtacgatcccaatgatttttttgaaaagcgaaacttctgactcaaaacacctcaaaccctagagaagtgtcgttcaaactccgccatttttgctgtggtgcactcttttgccgaaaaaggacgatcccaacgagctttttgaaaagcgaaacttctgactcaaaacacctcaaaccctagagaagtgtcgttcaacctccgccctttttgctgtggtgcactattttgccgaaaacgtacgatcctaacgagctttttgaaaagcgaaacttctgactcaaaacacctcaaaccctagagaagtgtcgttcaaactccgccatttttgctgtggtgcactcttttgccgaaaacgtacgatcccaaagatttttttgaaaagcgaaacttctgactcaaaacacctcaaaccctagagaagtgtcgttcaaactccgccatttttgctgtggtgcactcttttgccgaaaacgtacgatcccaaagatttttttgaaaagcgaaacttctgactcaaaacactcaaaccctagagaagtgtcgttcaaactccgccatttttgctatggtgcgctcttttgccgaaaacgtacgatcctaacgagctttttgaaaagcgaaacttctgactcaaaacacctca

SEQ ID NO: 30769 - DNA, 1564 bp, Heterodera glycines
  misc_feature (1416)..(1416): n is a, c, g, or t
  misc_feature (1424)..(1424): n is a, c, g, or t
ttttttttcagccatcgaaataccgatttccgaaatttttgaggccattgacacacattatacactattgtattaggtgtcgtagtttacagtccccaaactcctccaatcaagcacccgtccgctctctccacactcccaactcctttccgcccatccctctcttctctcgtgcttttcccttcactctttcttcgttccctctctctttgcgcatcgcttttttcttcatcaattcctttcttaaaaaacgctgtccaattgtgccgttgttgtcttttgttcttctgctgaacaccaaatcatccctgggcttttctcgtgcgaatatgtaatccttctccgccccaatgtcctccctctctcctccattttttaaatcctcttttggtaacggaggcatatgaatctgatggccatcgaagggatcatccacccttttctcagtggaatccgcttggaagtgacgcaattttacgttgtttttctgaagacaaaaataattttatggacatttcgaatcgaatgcatctcaattctttccatcgttataaattgctttttattgtcaatttgacttttgcaaaaaaaaaaaacgaaaagctgctgcaataaatgttaggctttattgttttattttgcaataaaagtaccgataaccgggctattggaattttctcgttgatggaagtattttgttcaatggtcactttctgatcaattgcagaccgattcatttgctgttaaattgtaggtaatttgcttttccctttcaaattaaaattaccaattccgaccattctctgttaatttttgaaagccgttcattttcctcttcgagattcaaaattcgttcttgctggccttaaaatcagaataaaaattgagattcttttttgaaaaacaatacctttgctttgcctgtcaaaacggtctctttcctccgccaacaaatgctcaattttctctctgtgctgagtaatcacattaatttgcgtgtgcaatgagtccaattggatcagtgaaaaactgagctgttgttcaagccgagcgacttcaaccgacgactgattctgttgtgaagtgaaccaaatgaggaagagaaagacgggcgaaaggagcagcaaacatttgcaaaggcgccgaatgaacgcagcactcaacggcaccattccatggcaataagcgaaaaaggaggagaattgaaaaaaaacaaaacaaattaatttcaatcaaaggggatgctaaacaaaaagttaatatcatcggtaaatattaacttcgaattgggcgttaagtatttcaacgtaacaagaaaatgttaattttatgaatttcatttttgagtatttgcttcttcgatatgcatacaaatgataataaagatgtgacaaagaaataaaaaacctctggaanaacgctanatgaacattcatcaaaaaattgttcaaaagtgttcattgttcatccctcttttgtcttcctccgttccaaacatttcttttttgatgctttcttcgtaaaacttgtcgagacgagctttctccaactgcagcgtcctctg

SEQ ID NO: 30770 - DNA, 997 bp, Heterodera glycines
gtaaatattcaaaaaaagagatagtgattttttggatagccggagaaataaaaattaccagctattgaaatgcagtggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaa

SEQ ID NO: 30771 - DNA, 914 bp, Heterodera glycines
ctcattatttgacccttttgtgttttttcagaatggtccaaatggaaagccaacagaacgccaaattcgacttgctcatttgctgcggggatttcaggtcgaaatacaaattattattgttaatccgaaacaattgtgaattggactgactttattcatctttttaggccataattcattcattttttgccattttagtccttaagaaatcacggcgatttgcaccatttccacgcgccgtttcaccaccgaaaattgggcactttttacaaatattacagcggtgaaaaagtcatcatctttaaatttttttttggtttatttaataattttctgtctttaaaaggtcgctccgctgctgacactttttgtgggcggaaaccacgagagcagcggatttatggcggaattgccgaacggcggatgggtggcgccgaacattttttacatgggatacgcatcggtggggagggacattccacccgaaggggaggggcggaaacactaataaaatacccaccgcgcacgatccatataaatgttttggtttgaatttaggaaaaactgtttttttaaatatcatatatttatttttttccctttaaatcttttgattttttttgtaatatcaagaattggaagccaaaaacatcaattccaaaggaaagtcgctttgcatttgaaatttgagttaataattttcccattgaattcgttttctgtttttggttcaaaatccaatggcgaagagagagggagtcgcacttttcccattgtcaatgcatttttttccccaatatttcctcctccattttcgggtcgtccgttttgctggccttcgaattggcggactctctggcatttttaagcctggcgatttcaacagaggtaagcaattcacgatgcttgtcggg

SEQ ID NO: 30772 - DNA, 1260 bp, Heterodera glycines
cattgccgaataattgtgccgtttgccccgctcgtccctcattgcgccctactgaaaaattttcatcgttttttttgtacgttttgaaacagcaaaataaaatcataaatttgcatttaaaaaaaagaagcatttttagcaattttgggcagagagttaacagagtagcacagtaccccagaaaaaggatgagatagttttccaaactttttgaaaaatttcaggcgaccgaccgacacagctagctatctggcagtgccaataaattttcaaatttttctgtcaaaagaaacatttattttgattcgggtagggttaggtgttgattttaaaaatgttaaaattcagggggtttggtgtttgaaaaatcctctagaagaattcgcttttctcgaccctttaattatcaatataaaattttaaaaaaaaaactaacgaattgcccggaaaactcattgttgagcagctgatcgaagtgcacacttcagacaaagtggcactgatacaattgacatgttcgaacaaagccaaaactaaaaatataggaaaaaattaagttataggattttgaaaattttttttacgcattccatttaccccctcccctaaaatttgcatttttttgtatgccgggttgggaaataacaaattttgggtaaaaaatagaaaattttcaaaatgctttgaccatgcgatgccagccattcgtgtcggtccaaccccttaggtaatgtgcacaatttgtccaacatttggtcgtcaacagagtcggccacgcaattgtccaccgattgaacaacttttcgtgccgattgagcagagccggactgaaaaatggatttttttaaaatttaactgaaaatttgcaaaaattttcctcggctgcgccatttggcaccattttggacgactaagttctctggattttttaagaatttgacacaaaaatgccatttttctccgcggtgtttaaatttggaaaattataatggcaaaaaaaatagactaaataagagcaaccaaaaaaaaaaaaaaaattttttttcgggtacccacgtcgaaaaattgtgcgaaaattttgtattttttcatacttgcgaaaacgatgggatatgcaccgcctttttctgtccagacgatgtgcacgcggacggtccgttggtgtccggcacgggacacacgccattggcacgggactcgccccgctggggtgccaagtagcgcccaccggtggccaaatcggcgcccttgcgacgggaa

SEQ ID NO: 30773 - DNA, 1109 bp, Heterodera glycines
tcttcaattgttttttccccaattaaatgcatgcaattttccaacaaatattcactggtaaatgcttcttccgattccttcagggcatatgaaaatcgcattttgtcatttttccatctttttattagtccgtttaattgtttaacacttttttcaaaaaattctttcattattttatactccgactcaaataattgtcccatcttgaacccactgattatattgaataatttttcaaaaaagaggtaaagcagccgataaagatttgcgaatgtaaaaattttataaatttgctgcccattatattcgttgttgtgctttttgcgcatatcatttaataattgtacaaaaaatactgaagctccgtagctgtaaaaacttaaattttggagattttgttattcaaaattatttaaaaatgttgttttgatttttagcgaatagatcgaagagaataaaaatagaaaaattaatcaaaaaggtttaaaattgaagaaaaatcgcaaaataataattaattaaattcacaaaggcccgaaaaaattaaatttcaagaatatttgcggtcgttttagcttctttttcactttaaaataattagcttaactgcttatattactactatatatttttaattttaagcaataattgttattaaattttattttttgtgaactaagcagcagaatttttatattttttaaattcaaaaatgaaaactttttgatttgtgagtcaatttttttaaggattttgatttttgtggatgtggataagaccgccgggtaaaatattttatttaactatttgttaaaaaatattcattttaaatggctttttttaaatcctttcccttactcgtttttcaaaatggaaatgttcttgacaatttgctgtaaatccagcgattctttatgtttcagcagtaaacatgccaaatcattttttgtcgtttcattcatcaaatcaaccaaactgtgcttttgcatgcttagaatattttctcgccgctgttcataaatcagtgccaatgtttgtcggacgcccaaatatgccagtacaaaaatttcttttatcgtttcaatttattcagtttatttgcggcaaaa

SEQ ID NO: 30774 - DNA, 1320 bp, Heterodera glycines
  misc_feature (22)..(22): n is a, c, g, or t
  misc_feature (1282)..(1282): n is a, c, g, or t
gatgcttttctatcaaagggangatgaataaatattttaaaattttaaattcctttttaaacaggccaaaaagtttaggcttatattttaaaaagtttcatcgaacctagcgcactaaaatcgatataagctaaccagattttgcgagagcatcaacattgtaaaggaaaagcactgaaaaaatgctaactcctgtaatttttaaaattttttattaatttttactgcttcattaattatttatttttttagcaaaattaaatcataaatattttttcagaaactgctctgaaacgcaccaaatgttaattaaaagttaaataaggcactcagatgctttcactatcaaaaagggagatgaataaaaatctaaaaatttttaattgctttttaaatatgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaaatctaaaaatttttaattgctttttaaatatgcgaaaaattttaggcttaacttttatttttataaactgatcagaagcgaaccagattttgcgagagcatcaaaaagacaaggaaaagcactgctatgatgctaactccagtaattctgaatttaaaattttttattaatttttaaagcttcactattttatttttttagcaaaattaattcataaatattttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattttttgcaaaataattcataagtattttttcagaaagtgctctgaaacacacaaaactttatttacaggntagtttaggcactctgatgctttttctatcaaaaaggg

SEQ ID NO: 30775 - DNA, 806 bp, Heterodera glycines
tttttcgaatagggacaatttttaaaccaaaaatttttaacaagaaaaaaaatgtaatttaggaagaaatttttgggaaattttttcaattcttaggggtgtattttctgaaactttttcgggtcatttcttagggtgtgtttttctttttgttccatttgcgttttcatgcttatctgtagggttgcaaccccgacgtcggggttcggggttgtcggggttggaagcgtcgggggtcggggttaaccccgaaaatggccaaaaatgtcgtggttcggggtcggggttgcaaccctaaattgagtgtgtgggaattgaccgtaaattccgatccttttatactgccaaatttaccctggaaacacggagagagtctggggtcattttgacgctgaacattttggcgccgccaattttgaactttactaatttttttttattttgcaaccaaataaaatattcttaatatcgaacgataagcctaagtgttctttataagcttccaaaatttcaaaaaattatattagattaaaaaaaaggcacgaaacccaactcgtactgtttttccacaaaaaaaattgtcataacttttgttaaaacccatcaaattaaaaaattcttgttagagtgaagcgtgaccgggaattttgggcaagaccgagaccttttcctggcttaaaacccgggaatttttggctgggacaaacgagaaaaaaccgggactaatcccggtcccggtcaaaaccggaaccttggcactccttagtacgctcttcatttccgctttccctccctttatttaattc

SEQ ID NO: 30776 - DNA, 1398 bp, Heterodera glycines
cgccggccaaagcgacttcctcgcccacagcgatctcgcgccgccttacccccgcccccgaggggtatttgccccacggggcattccgtccgaccgccgaaacaccggctggaggttaagcaattacagacacattgtagcaattgcctattcatttggtcggttcagctccgcagtacggcggtgtcagtgggatgataatcgcacaagaaattccaaaagtgggggaaatgaaagcgaaggggcgaagggccattttatatagggggaacgaattcgctatttggacgcacgagagcgaagtcaaaaggcattggtcggaacgatcgaagcgacaattcgagcggtggaagaagcggaggaggaaatccaaaagccaccgcaaatcgaattgccacagtttggcgaaacgcaacggcactggcgagtggaggtggagaaggaggcggtcagcgaccgactcgccgcgatgggagccgcgacggcggaggtaggccgaccaattaggcagtgaatgaggggaaaagggaagggaaggcttaatccgaattagccaaggggcaaaaaaggcatgactaattggcatacctaattgggctaaaaacgtctcaacaattaagcaaataaagcacaagaaaaacgaaattggcctttttattctttgccatttgtttaggttgttcaattgaccgcaattcccgaagaaactttggacacgcgcgttgggcacgcaattgcaacaattggctcgaatattccggaaatgggccgcggggtgcgccaattggccgccattatgccggacgaaagccgtgccggcgatttgatggacgcggcgcgaaaattgtgcaacgcttttggagactttttggagaaggtgaattccattggggagaagcaattcagagcgaaatggcattactaattgtcaggtgcacccggagaagcaggagaaacgcgcgacgattttgtcggctgcgagcagagttggcgaactttcgcacgacatgatcagcacaatgcacgaacagacggaggaggagcgtactttccacgaggaactcaaccgcagggcacgcgcagttgccacgagcacggcacagctggtgcttcagtaagtggggaccgggaggatttgggctgaaggatttgagatggaatttcgaatttgaaatccatctatgaaaagagccaaaacggtgtccgccgaatgtgaggagccggcactgaaggaccaagtgattcacagtgccatgaaggtgggtcgggtgggcaggcaccgttcgcctcattttaccggcattcccccccccccgctcagacggcatttgccacttccgaattggtcgcgtgcactcgcgtcacggcccgaccatgaacatgcgcctgcaaggagca

SEQ ID NO: 30777 - DNA, 1035 bp, Heterodera glycines
tttttaaattttttatagattttttaaaatgttggatttttttggcttaccaaaacttcatcgaaccttggttcttctatttctctttcaaatcgccccaaatttttttttacagcttaactagtccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcgatattaagcttatttccagaaaatatcgcatgaattctcatttttaaattttttatagatttttaaatggttggatttttttt

SEQ ID NO: 30778 - DNA, 1588 bp, Heterodera glycines
agagagagacaataggcaaaatgtggaaaaatttgcaattagggaggaccagtttgagacaattagagcttttgtgggacaaagcatggcttattaaattggatgacgaagagcgagaaaaactgctgacgacggcattttttagaaacgaatttgaattggagaaatttaatgagtttttcagccactttttgctaatgaccaaacaaattgagcagggtaaatgccaaaataaaaatgaattgaacttcctatttagatcaaaaattgtacaacgaaatgtcaaattttacgaaaacagaagaccaaattttaggaaattttggaatatctttgcatttgcaagaaattaaattatttactgggcgaacaaatttggttgaaaatcataacgcaacaataaacatggttgatgataaatagttttttgtttctaaatttaattaaatttaaatttagttgacagaatttttttcaaaaaatggttttggaatggttgaaaatgaaagaaaattgaaaattgacctggcaattgaaagaattgaacgagtggtgaaagaatgggtaaattaattaaaaaataataatttatcaaatatggcaaaactattaaaaataataatttatcaaatatagcaaaactattaaaaaataataatttatcaaatatggcaaaactattaaaaataataatttatcaaatatggcaaaactattaaaaataataatttggtaaattatgccaaaattattaaaaataataattttgtaaattatgccataaaaataataatttagcaaattatgccaaaattattaaaaataataattttgtaaattatgccataaaaataataatttagcaaattatgccaaaattattaaaaataataatttggtaaattatgccaaaattttaaaaataataactttgtaaataaggcaaataaaaataataatttagcaaattatgccaaaattattaaaaataataatttggtaaattatgccaaaattttaaaaataataactttgtaaataaggcaaataaaaataataatttagcaaattatgccaaaattattattattattatttttggttttagaaccctcaagcgaaattgctggtggccggctcttttcagttgggcgtactcactgaacattcggacatcgatgccatttgtgtgggacccgcttttttggaatttcacttttttgggagtgaaaagtgtgaaattcaccggagcagaaggagttgcccggactggtcactttattgccggctttgtctggtcggcacttttaataatggcgacattaattatcattcttcgaagcaaaaattaaaatttagcatttatcaaaaatatttatttatttttggtaattcttagagctcgacattttgaaaaaagcctagacctagactccatgttggacctggatttcctggccgaaacccaggaaaacccaagtccagaaaaaatccaggtccttcaaactgaatccaggcctggacctgcattttttgaaaatctttttaaaaatcctaaaattcttcaaaaaaatcaatattgcttggg

SEQ ID NO: 30779 - DNA, 1278 bp, Heterodera glycines
  misc_feature (7)..(7): n is a, c, g, or t
tcataancgaaagcaacatattaattttaaattccaacgcccttctcagagaaacattttctctgtcttcaatttcttcattccttttcttttcaattccaaaaatttatcgtttcaaatacacccctattttcccagcgtcgctggtatgagcaaaaaaaaaggtcgttcgggcgaaagtttttcaaaaataccacccctaagaatcgggcgaaaaattttcaaaaatacacccctaagaatcgggcgaaaaatttttaaaaatacacccctaagaatcgggcgaaaaaattttaaaaatacacccctaagaatcgggcgaagaattttcaaaaatacacccctaagaatcgggcgaagaattttcaaaaatacacccctaagaatcgggcgaaaattttttaaaaatacacccctaagaatcgggcgaagaattttcaaaaatacacccctaagaatcgggcgaaaattttttaaaaatacacccctaagaatcgggcgaaaaatttaaaaaaatacacccctaagaattgacttttcggatcggtacccccccccccccccaagcccaaatcctggatacgtccctggggtctgggtgagaaaagagtagggaatggtgaagaaggagaaattttttgagaaaaaaaatattaaattatttattttcatttaaagcatttgttcatatgcataagtggtcaagtggccaaaccttctgattttattatttctcgctcgggttcaattccccactgggatagaatattcttcatattttctttaccattattttaattgaaattttaattaaaaaaatattccaactttttttctttcattttaagcatcctaaaaacccaaaaattaatcaattggtctttttttacaaattctgttaacaaatcgcattaaaaaatacaaaatttttcccggcggcgcctatcggcaccgccggccctccttgttccccaaaagtcttgagaaaaacgtgccgcgaaaaaagcggtgttgaaagcaaaaaaggtcattgatttacattaatttacatggccggagacccttcgcaaaattggaaaattggccgctgatcccttgttttgcaataatctgaattttgaggtctacatctgaattttagtgttctttatcctgaatttgaaaaaaaaacttggtcaccctcaatatacatatacttctgaacaattctaatgctaaaaaacaggcactcgcgcgaaaactgaataaaaattttgtatttgaaaaatttgtctaaaa

SEQ ID NO: 30780 - DNA, 903 bp, Heterodera glycines
tagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtactaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgc

SEQ ID NO: 30781 - DNA, 1075 bp, Heterodera glycines
tgaaaaattaatacaactaacccaatttcaatttaaaaagagaccattttggataccaatagtttaaaagcaaaatgatgctaaacccttgcaatttgaatttttttaagataaaattaaaatattaaattttgataaaattccttaagctgtgctcagtgaataaaaattaaatttgattttcataaatgtaatttttggatgggcaaaaacggagggttttggtgaacagccaagacaacgcatgaacagttagtcggaagtgatcagcgccctcaactgggggtacacctcggacagaatgagcagcagcgcaacgccaaccatcgcggcacgcttttggacgtccctttgggaggaccttttggggcaatttgagcagaacaatcttcggttgttgttgttgcttgctttcttacatgaacttgagcaccaaaatgttgctggaaagggcgaatttcgtacggacgtggccaaaaacggtttttcggtcgggggactttagccaaaaaacgcagtcactgccgagaaaacccatggcctttccgagagattggagcgacacgaacacctgcggaaaacacttcattcgtccgttgggaaggacagttaatttactcgctccactcggattatcaccgtctcatctgagctggctttgaccagagaaaagtccgacccgcacggatcgcgcattaactgcgaaagattaaatgattggcatggcacaacatggaggtgctattgattgtatcagtggtgctgtggaaacaattttggggaggaaccctggaatttgcaaggttttccgcttcggggccggtcttcgggttttgacaatttcgccccctgctggcgatcttccgctatttgtttaataggtgcactgcttgccaatgttaccatgcccaccttgaagagcgtcgcttgcgacgggtgcatcagtttgccgagtgagtcggccgtgtgagtggaaagtctgacgagcatcaccgctttgccagcctcattcttcaacagcagcccgtgccccttttggacttctgccgtcatgaccaacttcttcttttgctct

SEQ ID NO: 30782 - DNA, 1029 bp, Heterodera glycines
tctagcactaattaacaaaaaaaaaactatttttttgttttaaataatttttgcagctttacaattgcttaacctcgttctgatgatgtccattgtttcttatcattttcaattagcgcattaattggcgtattttctttcggacattccaataaaacattattattattaacctgttaataaattcgggtgaaaaattgaaggaaaagtcacaaaacttttctttttggtccaatttacacagattttaattgtcccaattaaagtacaaaagataattttaaaaagattattgaataaaatttgatttaattataaaatattaataatttcatctttttaaaatattaaaatgtacgttttcttctccgttcgcttccgttttattctgcggggcgtcggcagcgaagaaaataattaatttgaagcatatcaaagtaaaaatgtacattgtatttatttttgttttaacctgctgaatataatccttatgttaaatagaatttattaaaataaatgctaaaatataaaaataatatgcaaaaatcattgccattaagcataattaaattttgtaaaatggcaataaaatcaattaaattgattaattaattgctcggtgctcaggatgataatttgtaagcatctttctcctcgttaatgtctgcctgcattaatttgtaagtgaaaattcccttttcgaaacatttttcatttaattgctttttaactgtataattaattaatttgtggtctttctcgggaagaattgctaataattcactttttcaaaattgataaaatttattcctaatcaattttaaattatcattcatttgcttctgcaaggaaatgtttgttccactattaatttgcgtttcattgcgatttttttttaatgtgtacagttcaattattgcaccaattcacaatttagcgaagaggaaatggaagtgaacatttaattaattaattaattaacgtaaaaaagcaaggcattttgttctcgcggctgttaataaaactagg

SEQ ID NO: 30783 - DNA, 1012 bp, Heterodera glycines
  misc_feature (59)..(59): n is a, c, g, or t
ttatatttttgtggtttagtggttgttgcttcaactcttttagcacttttgagaccggntgactgtttcctttttaatttatttttatatgattaataagattttttaaaccaaaaatacccattaaaatcaatcatcttggcataatttatagacgtattgaacccagttttattttctttgaataaaaattcaattttttgactaaatcaagaaaatttacaaaaaaaataaaaatttaccagaaattcataaatttttggtgaaaatatgttacaaaatagaccttaaatttcaaaattcacccggcgctgcctatcggcatcgccggcgccacaaaaaacctattttttcttaaaaaaatttggcccaaaatcgaaaaaatctatcattttttggacaaaatctgttaacaggctcatccaaattttcaaaatttttcacggcggcgcctatcggcaccgcggacccatttctcctaaacgtctttagaaaaagagcgccgcaaaaaaaagaccaaaaaaaaaagatttatacagattttcgctgaaaattggccattttaaatgccttatgtgtttttaaataattctatacaaaatatttatgataaaaaaataataaaaagcacataaaattattattacgaaatttaaatatttttaagcaaaaattttataaagttttttgactatatggtataaggcaaaaattgaaaaaccccgaccccgaacgatttgtcaaccccgacaccgaaccccgacgcttccaaccccgacaaccccgaaccccgaattttccaaccccgacgtcggggtcgcaaccctaatttaaattagtaaattcttttcgttttttttataaatgaagatagtagttttgctatatttgtgatttatactataatgtgattaatttaaatttttttattatttatacattctttttcatgtgtatattttttatttaatttaatatggtgctcgaaaataattattataaatattgaaca

SEQ ID NO: 30784 - DNA, 1311 bp, Heterodera glycines
cggaagaatgggagaactgcaggactttgaggtgagaaattagaatcggaagtgagacaattgaatttcaaaaggaggtctgtatcgacgacctgtcgagacggaaaacgcaaaacatttcggccgattttatcgggctctgtgggaaaaatggggagggaagaggaaagacaacgccacgagcagcagcacatcaattgaaagtgttgctgctgttgttgtgggtgaggccgaaaaatcgatcgtagagagagagacattgcgagagacagagaaaagggacagacggagagagaaggaccagcagaagagggagaggaagcggagtcaactcggataaagagtaggcttttagtgagagaccggaagggataatctcagcgtcatatagaaagggagggggggggggggggtaattagagactgggggattatgatagagggattatctttcaaaacacctcgtagactgggggataattggagactgcgggattaatagagactgggctataattagagcatatacggtattggtacttccgtgttttgctacccccccccccctcgaaaaatttaaaaaaaaatcatatcttggagttttcaaggtcactctgactatgaaaatggtgttcgtttttatatctatgacatctagtcatcgatttaataaaatatctgattttttgaaattttaaaaattttcgagggggaggggcagcaaaaacacggaagtaccgaatatttatttgctcagaggttgctcaagaagcagtgaaataataaaacattcttcaataaaactgcttttatgggtgtattttattttattgcctttttcttaaaaattctcttcccatgaaacatcaaaaatctgattcataaattatgttgagcaaatccgaaaatggcattttaataagcaaatttttcgtggaccaattcacgggcgaatgtgcaaattctgctgatggacttcgccaagtgtttcttcctcagatctccgccctcctcagcgatggttgtgaaagccggatttgcttatttggatccgtccctcgtcatcgtacatcacaagtggtatgcaaaaaattagccttaggtaactttttcagaactaatcgtaaccatgtgaaattgcagagtctgctatatccaaagacagcatatataaaaatatttgattagaattgttccaccataacttggaattaaataattataaacaaaacgtctctaattatatcaaatcacagcctgatcaaacaatggtaacaacaacaaaaatgcttcaatcattcagtattcctc

SEQ ID NO: 30785 - DNA, 959 bp, Heterodera glycines
tacttgtgctttttcgaaagggcagaaaatttataaaaattttttgagaaagaaaaggatttaaaaagattgcgtgcaagcgggagtgacccctcaagaatgagtgtgggtggcgcactttaaccactgcgctatttgcacgtcagcggaacagcttctttggaaatatttattctcttctttttctacccaactatgagtgttaattaaataataattcaataaaaatacaaagacagttagtaccattcgggagctatattttaatttaaaaagatatgaatttccaaaaatttaaagtaatattttttatctaaaagtatgggagcagccgagagtgactcaaaaaagggaaaccaaaaaatgacaaactgagaaaaagattactaagcatttggagcaaaattggatcaacaaaatatacgattcggttttgtttactttaaaaaataatctatcaaatgtgcaaaatttcattttcccaagtaaaaatccggatttcccatgtaaaaagcccaagttgattgatccctggtcgcgttttttatagaaccggctggccacgatccacggtttgtccaaaattcctggtaccctgctactctaccttatattttgatattttcatttctaaattataaaatattttacatatatagagaaaaatttaaaaaagcctggacctgaagatgggaatccaggtggagcggacctggattttcttgataaaaaccaggaaaatccagatccatgataaacccaggctgccaaagagtggcctaataagtgattgataaaatccgtaaaacctaaaactccgggccattatttgatcacttctttccaacaaaaagcaacagaaaatcgaattcggcataatttttggcgaataaaatttcttaaaaagtcttcgcaagcgaatctcaagccgattatctcagttttattggggggggggg

SEQ ID NO: 30786 - DNA, 1478 bp, Heterodera glycines
  misc_feature (162)..(162): n is a, c, g, or t
ttatgtgctcagtgcgtggcaagcctttgggtgccattttttacattttattgcttttttaaaatggaaaattttaagacaaatttccctatttttacaaaggcaaatggtatctgaacaaatgggtttataacaacgaaggtaagcagaaaacgagaaggngagagagagattgagagagattaagagagacgagatagaagagaaagagagggagagaggtgaaatttattaatgagcaattaagcaacatattagggctaattgccaaatgattccgtcgatttttcatttttccccaaatgcttcttcttccccccccctctcccaaggcaatgcttacattcgctgcttttatttcaccgccgctgttgcgtgcgttttttgttctttgacttttttcacccattcaatttttagcacttcgactggtaacaatccaatgccgacaaatgtgagttccccgaacaatttttatctttggaatgcccaaaatatatgtgaacatatccacccccccccgtttttcatctctttttcctcctcagttttttcgagagtctcggtcttttttttcttgttctaaagtttgctctcgagtagtattcgccctctcttcacccaaatcctctactataaaatctctcctctctttgttaggtggttgagtatttgtacatgactttttcttggatgatgggcgtttttgtgttcgcccttctgttgggacaaatccgtgacattgtgtcaaatgcgaacaaaaacaacgaggaatttcgcaccacaatggacaaagctttatccgagtgcaagcgactcgacttgcccgagcatttgacggcacgggtgaggtcgtggtaagggacaaatgcgccaaggagaggggggggggcattgacggcacggcatggacaggtgggctaatcggaaatgtttgtgttaggtttctttacacgtgggagagacaacggacattggaggagaagaagctggtggagaagctgccattgaaattgcagacggacttggcactgtccgtccattacagcactttgggcaaagtgaagctgttccaagtgagaggggaaggggggagggaggggcgctgactctctgcgattactctccaatcgccccccccccctcactaggacgctgatcgggcatttctgcgcgatttggtgcttcgtctacgtcctgccattttcttaccaggggatatgatttgcagaaaagtgagggggagggggacaaaaaagccgggaataaaaggcgctgaatttagggggacgtgggcaaagagatgtacatgtgagtgagtgggaagtcaaatatcgaaactattctaatcccatccctcagtgttaacaacggcattttggaggtggtcggcggtgagcacaacgaattggtattcgccacccttgcggaggggtcggtgtttggcgaaatcaggcaattgtgggggatgattcttg

SEQ ID NO: 30787 - DNA, 734 bp, Heterodera glycines
ttattgattaattttaatattataataaaggccaaactctgacacgaaaaaggaccgaatccgacacttttgcagggtctttcttccgagtgtacgcctggttttatatccaatacaaacgcattaagttaaattagtcaattaattgatattaattgttttgacccggacgattgtgacgtcacagttgagactttttcccgccattcttctgcagttacaggaagcgcttgaaaatttctatgcaaatatttctagggttataagttgtgtgcattaaaaaatgccaaatatgcacataaaatatgtacgaaaaatccatcaaatattcccaaaaaacacgtaaatgcccaaaaatgcattaaaagctgccaaaaatggaccattgcagatgatcagaaaaaagaatgattaaataattaattcacaatttattacagaataaagttaattaatgtgaaatgtatttcaaataaaagccaaataaaaaatagaatgcttacctttttaattaattatttgtaattaatttattccccattcgttgttcgtgtttattttttgcaattagataattaaatgctgaaaaagtataaaaccctttttatgagtaaataatccttcaccatttgcgtgtgatcaatttttgtgcctaataaattaaaaaaaaattatccctctcttttaaatgagtgcttttctttctacaaaatcataattaaaattctaataaa

SEQ ID NO: 30788 - DNA, 2070 bp, Heterodera glycines
acatggtgtgaaaagcataacattctcaaccaaagtgccattcctcggcggacagatcacgcctgtcccggctcagtgcctacctgttcggcacctgcatttgggccgaaaaggcgcacgattggcatcagccaccctaccagcggataaggtggtgccgtaataaatgtttcagcgccaaggactgtccctaggggaggggtaaagtaaagaggtacacgcggggtactttgccccctcccccccccctccccccttggtgaaattttaaagaaaaagcccgaaaatgcgctaaaagacattttttctcagtggatatccccaaaccccaaaaaaaggccaaaccctgggactaaataattgtttcagccaaggactgtcccaagggagcaggggagagtgggtaccccccgggtacatacccccgtccccgcctggataaaatttttaataaaaaaccaagaaaatgcgctgaaagacatattttataaatggatgctgccaagccccaaaaagtgatgggacactttccctaatttcagcaattctccgtttcaaagttcatgacgaaatttaacaagtgtgtaaaaactcttaaagcggagtttggaaaaattttttatttcactatgtctcacttctctttttttttttttactattttttatattttttttgctaatgttttacgcattctttttttccaaatgtttttgtgtcttggaaacaattagcagttcgttcagtataatgggcattaagccctgcttataatggggcccatttgtccctgtttttgtcattgccaaggcaatgaatgaatgaaaatgtgaaaatgcgcaaaacaaaacattttcagcccgccggcgcggaggttttctgtattcataaaaacacactcactgactgtgctgacattccaatttttcaaaaaaaaaggaaaatttacctccctccgtgccatttgcatatgttttagcccttaaatgccatatttgtggcctccatttcccatccccaaagccgccccccccatttttcatccaatccttgccccctcccccccccctgtggatagggtaaaaccatgaactgaatcatcggggcgtttggcttaaaaattgaaactccgaaaggtgatgatgaataaatgttcaacattggaaactgtaatggttttttaatgtatatacattttgaaaaatattatattaaaagtgaaaatacgaaattaaataaaaaaaaattataataattgaaagttaaaataaacatttttgtcactattaaaaggagtgggttttgaaaattaaaaaaaaaccaaagatggaaccttttggtttcaagagagttttttaatgatgttcagtcatgaaaacaatgtttccgggtttttggtcttagaatcttaaaatattttatagaaaagtaaaaataataaacgacaataaattcagcaaatcgttaatcgttttgttgctgtctttttttcaaaaatcaattttgaggcgaggggaaggggaattatgaagtaatattgaaaaaacatgaaaaattttacgtttacattatttcttttttttggcaattttccatttaattacataattcttctctgtcacttttatttaattttaattttcgaaaaattggtcaaataattattccatttttctcttttcattttccatttttgtcttaactaattgacgcctttcctcctaatggaggcattctttctgtgacaattccttaaaaagagggaaccatcaaatttttttaaatgatggatggactctgaaatctcccaaatcccttgggattttactttttcttggttggtggtgggaaatctttccaaatctttttttttctgacagatgaataaacaaataatgggtttcatttatatcatgaaatatacacaacgttttgccgctttcgaaatttatttttgggctttcccatttaacaacctgctgcttttagaaattttttttcataattttccagacgatttttttttaattatgatttgaaaaacctatcatgaatttaatcaactaaaat

SEQ ID NO: 30789 - DNA, 895 bp, Heterodera glycines
aaccccgatgttaatccgtccgggagaaccttttcaaatttttttccctttccctaaggagcgcgggaaattggaattaattttcggaaaaatggctatctttttttaggccaattttttttctcgttacccccgatgctaatccgttccggggagcctcttcaaattttttccaataccttaaagagctgcggaaattgggaattaattctcagaaaaatggttatctctttttaggacaattttctatctcgtaaccccgatgctaatccgttccggagagcctcttcaaaattttttccattaccgcaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggttatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccc

SEQ ID NO: 30790 - DNA, 1273 bp, Heterodera glycines
  misc_feature (25)..(25): n is a, c, g, or t
  misc_feature (120)..(120): n is a, c, g, or t
ttctcgagactcactctcgataccncaaagtgccaaagtcctggacttctcgagctcctctcgatgctccaggctgtttctcgagactttcggtgccgtttcgggtgtgccctccccccncctttcttttggcattgtttctcttcgtcgtttttgtcgttttgtcccgcattattccgtctgtcctgtcgtttatgccttttccttttccttccgctcgtcctcttcttccgcgcccaatttccgtccttctccgttccgtcgtttgccctttctttgccgaaaacaatcgtccaaaattcgcttcaccaattgcgcccatcccccggcgtcaattcgtgccgtccccgcggcgcttttgctcaacattttgtccgcgtctgcggcattttgtacttcgacggcgccggcgccccttccgccgttggcactgttcagcacatcgatggacaggcgactgaaagtgccaatggataaatgaagtgatcggaaggaatagaattaagtgatcagccgattggacagatcagaaaaaaagagggaaaacgaaacgaaaattaaaaaacaactcaaaaattaaataagcgaaaagcgtaaaattctaaaatagtaatcattattttgaaatgcgttttaatttttttttttttttaatgaatttctcccaatgttattaattgatcaaaaatttcatggaattctaaaacactggagagaaaaagcaatgccaaattacaaaatgaatccggtcaaaagcattgcgatgatcagattattgcacagtttttgctcaccttccacgacgccatgcgcgaaactgaaaagaaattactgtgctaatttgtaagatcagcgaatcggtcagatgactacggtatcgcacttatccagtaccatatctcggccatgtcattcgaccgtatgttcccccgttccgtgcgcttaccgttgcgtaatccatggcacaaagtgagtcatcttcgcaaatgtttgtgacagtgtttatccgccgacgaaagtcagccaccgaattaggagcaacggtggcggagacggacaacgaggacggcgagcagcacgggtccaattttcgtgccaaaattggctttacgggggtcgtcgacggggagggcaaaggaacgacggaatgtgccgaaggagggggagagggacggcactaaaacggaaaaagggaggaggggggaattagcaggagaagggaatgtcgaaattaaaacgcaatgatttcaagcagcctaaaagtgcacctctt

SEQ ID NO: 30791 - DNA, 1876 bp, Heterodera glycines
  misc_feature (1704)..(1704): n is a, c, g, or t
caacaaagacataacagatgctccatctgttgacagtttcaaaaaaacgtataaataaatggattgagttaaccaaaaatttagtctgtaaaagagctccttggactcgacattaatttactaaaatctaacgtgtaagtggtcaccccttcgttggatattttatttcttctgaataaataaataaatttttctgcttccacagtgagcgtgctctgcgcactgcgaccgccgcgttcatcgaaaatgccagcgcctcgacgtccgcttccgactcgccttgtccgaccaattcgtccggaacaccgctgccatccgaggccggcgaaggtgagagaaccgttggcctactcccaccccccccccccctctcgaatttggacaaaagtcgacaacttttcgagacagacattcgactttttcttcgaactcgtcaccgtaattggacgaaattgacacattcacttttatttgctttctttttctacccattttgcccgattgagatgacaaattggatgcccaagaactgtttgatcggagctttgctgttgaggacgaggaggaagatgaagaggaggaagaagaagaccatgaagaaggggaagaatgggcggatggaggaggagaaatggaatatttggagagagaagaagaggaggagtgtgaaaataacgaacagcgaaaaagagtgtggattaattaatactaatgaatgatggttgaaaaggcaagggtacgagagaggggtactttcctttttatggccaagttttggattttaacaaattgaattgtaagattctttaaaaaatcattgccacatttggaccaaaaatttttatacggcttttctacaagatttaaactcttctgcctaatcaactcgtacaaacggactcgcctcccagtctcggtcgattttgtgctggtactcatccgcattatcttcacctcaaagcatatgaattcaacagtctttgcattcttccctatttttcattttattttaaaaatatttttgattaattttaaataattttgacacataaaactttctaaattatccaattcactttccaagtacaagattgcaattacccaagttcgtaacggggaaaatttgtgaaatccaagtgaacatgaaaacttaatcaaaaccgtaagccgaatgcaaaaaattttaaacttttaccataaaatggacattttttatattcagatgcaaaaccatttccaagtacaatcttggaaattcttcgccgtttttttaaatttcttacgttggatataaaaaatttcaaaatttatccaagttctctctttaaaatttattttaaaataatgcgacaagaaaaacaataactttttcccaatttattattatttcatttacctactatttcatcatttaatgagtttggcttttcgttggattactccaaaatttactcattttaataaaataaatatcattacgttattattaactgctgatttgcttttccctattttcgagtgacgttgttttctgctgtttgtcagcagcaaacattcgctgccaagtgaatagcgaatcaacccaaattataaaaaattaatctgaagtctgaataaataaaataattttcgaacgggttattatataaaaaaacttcctgaatggcttttgccattagccgttaatttcaattcccatctaanttttgagttttcttttttttaaattatagtaacaaaataaaaaaatattcaaaaaaaaatgttttgaggttttttatttgtcataatttcctttttaagacgggaggaattattggctttcaagacaagtaaacaaagtcgacacatgggatcgagcctaatctctctaaaa

SEQ ID NO: 30792 - DNA, 1432 bp, Heterodera glycines
gggggcgggggaaatggacgaggaaacaaagcaaagcaaatcttaatcgctcggcattacgtgttgtcgggagatggaagcgccgttacgcccctgacattttcgtttttcccccggggcgggggaggtgatcacccctccgaatggtcccctaaaacgtgtttcattttgcggtataaataggggggattgggggagaaaatggtgggatttctcccctcggtggatcactctcttttttttgttccgtttgtgtgtgtgggcccacagcttttgccggggattggaaagttttaggtgccatcgggtgacgaaagtgcggcggcggcgtctccgccgcatgggacgcacccgccggcgcaaaaattggccacaatttgaacagtcggagaataaatgatggaatgaatgggatgcgttggtgcaaaagcgtgggacggatcgtatcacaaaacgcatgataccaaggatcagatcctgcacagtcgtaaaatatggagacacctggttgacccaccatttgtaagtgaacactcattcaaaatctcgacttttgagcccctgtaactcttgagttaggcggaatgcatccgtaagattaaaaatccacactagaagtcgaccctgctctatcgaatggtatataacacatatgcattttccgacttacagttcgggtggttcccttgttagtcccttctgggtttttaacttaaattctgaaaaaaacattttccccaccaaattaacaaaaatagcgaaaaaaatcttgttttcaaaaatcatgaaaaatgtttgttttttctgtttcgcgctgatcacgaatagggagcacatccatcgaccaaactcgaaacccggacatgaattcgaacaaaaagtttgaaaacttcaaatttttccagtttcgcaaaatggaatgctgtcgcggctgaacgacagccgcgaatgtccgttgagcggacaaatgaggaggacggggaggagtgaatgaagttgcgaacaaggagtgatgaatggatggaaagatgggaaaaatggggcaaacgggaaatgatgaagggaagggaggacaaaaagggggcgaagggagggacggcagcaggcgagcacgtgaattgggggaaggaaagcgataaaaagcggatgtggcgccttctccgcgtgaaggacgcccgaagtagtgcaaaaacgccgatcggaccatcgcggtgcgacggacgaaacgacacatcacccaggcggacagccgatgaaatcggcgatcatttgatggaaaattacgaatttgcgggagagcaaattcgcaccggacccttcccctcgcgactaatctccggcatatgagtgaatgcaaatattttaagtgctgccaagattacatccgcgcaccgtcggctagtcattgccaggtgaaggaattgccatcctc

SEQ ID NO: 30793 - DNA, 215 bp, Heterodera glycines
atcaccgaaacgcgcccctcgaaagggccacgagacacgccgagccggacaggccaaaggcaggacaagaacggggccgcagacgacaggaggcacccgacggggaaacgagcgcggaaccccaagacgggaaaacccccaaagacacgcaaagaagcagccgcacaagagacaagaacccggagaaacgcgccaacaaaaaagaaaaaggaaga

SEQ ID NO: 30794 - DNA, 1504 bp, Heterodera glycines
  misc_feature (58)..(58): n is a, c, g, or t
  misc_feature (76)..(76): n is a, c, g, or t
  misc_feature (102)..(102): n is a, c, g, or t
  misc_feature (106)..(106): n is a, c, g, or t
aatttatataatatttttgattttcataaacaaaattgctgtcaatttctacattttncaatcaatgaattaactntaagcctctaagcacttagaaccccncaanaatgccgaaattggcaaatggttacagaacaaatgttgggcctccaattattgtggtctgtctggcaaatgtttatttgtttgctcatgcacctgatataattaattcattggccctcctcgagagtgacgagaaaacaacgccaaaaaatgtcaatttagtgccataaattttgattttcccatattttctccaaaggtagtggtttaattattattttttcatccaaattttggcattttttgtgatttttaattgcgaaataccgtctttttattatttgaaagacaattaagagagccaatatttttgggacaaatttctttttttttaccgactcatcgccattttgagtttgtttaactcataacaattcggtattttggactgattccatttctcatttcgttaaccgtcctcaattttgaaacattttcgccaaattccccaaatatttttggataatttaagcgattaaatcactaaatgatttcatttagttattgaaacattttttttatttgcttaatgattcaactaatgacgattatcaaagaacaaatttcataggtaaattaaattttaattttttcatttgtttaatgagtcaaccgaaggcaattaaaattaaatccaatggtaaatatgtaaattcctataaaaactgaaattgaatttatatttttaaacaaataaaatattttttcaaaccgtttttatgccaaatttgctaatagtaaatttgcattttaaaacaattaaattatttttttgtactggtcaaattacatattattattagattaagtttatggtatgtagttcaattgattattttctcccttaatttatgtttaccaaattacccaaaaaacagaaaaattgaaaattactttatcacccccatcagactataaatatacgatttttctaattttttcatcttaaaaataaatttttaaaaatattttcgttattttttgctaaatttatattacaaacagcctccaattgtaaatttttgattttttttttacccccgtcccgatgaaatttctttttcttaataatgaagggtcctccaatttggaatttttcactcattagccacttgtgtcttataactcaagaatcttttgtctccaaatcctggaaacttttaatggttttaaaatttaccaaattttttaccattctccctttttaaattttctcaaaaattcccttatttcccccttttttttcctaaaaaatcccctaaaccacttataaaaaacccaaattttaaaaaaaaaaaaatattaacctcttcttttttttaaaaaccccccctttattttttttattttttttttttttttaaacccccccccccccccccccccccacccccccccc

SEQ ID NO: 30795 - DNA, 1135 bp, Heterodera glycines
  misc_feature (54)..(54): n is a, c, g, or t
  misc_feature (73)..(73): n is a, c, g, or t
  misc_feature (82)..(82): n is a, c, g, or t
  misc_feature (91)..(91): n is a, c, g, or t
ttatgaacaaaaaaatcgattttttcaagtgtccgtttgggtactcaaacattnatgggagcaaaaatccacngcagaatanaagtacagnctatagggaagctattcccgaaggattcggtctccccataaatctgggcgcatcgttcgggaagactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattattaaaaatttttagatttttattcaggctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttatgtttttgatgccctcgcaaaatctggttcgcttctga

SEQ ID NO: 30796 - DNA, 1196 bp, Heterodera glycines
atattttttctgcgcatatgctatgaagaaaggggctcaaaaatagcatttctgcgttaaaattttttgatttggtgaaggtttttagtgcatataaaagcatattttggggattttcgagaataaatgcatattttgccatttttgcgtttttagaacatatttcggtcatttttggcaaattttcataagaaaaatgcaataaaaatgaaaaatacacccctaaggatcgaccttttgggaatttaaaaaatatacccttaaaaatcgaaaaattttaaattttttgtaagaacttttagaaaaaaaattgttgatataagaaaatgtaattttgttttagcatatgataaaacactctttaaaaaattcgaaattgcatatataaatttagaaaatcaaaatttttttgctattatctaaaaacgctccttagccattgttttggtgttttaaagtcaattctgtatttaacacaattttggcatttttttgagggatagaagccattttgcgtaatttttaaggcatattttagtgcatatttggcatttttcgggttttagggcatttggctgttttttagtgcatattttatgcgcatatttggcattttttagtgcatacaatttataaccctatttataacataaagcttggttctaaaaaaattgaatattacaaaattaattaattcaaaattaaaaatattatataaaattatttaattttgtcactattgctgcagctactgtgaaaatttaaattacaattttatccattttttattctctaaattttattgccatttgtctgccgccactatttccattaattcgaatcgaccattcaaatggccccataaaccaaagattcggcataattgcacgccttctctcttatgatcagtgcgcccgccccaaaatctaaataaattttccagccaaatacaaaaaatccattcgcccccattttatcccccgcccaattgccccatttacgcctctcaaaattataattttattttatattcattttcatttcattttatttgcttgcttctcctcttctgcctcctcttcatcttctcactatcattcattcacggtaataattccacgtaattttacaacaaaacattagcaaaggcgagcatttttggttttgggcccgggaactttcgaaatgactctaga

SEQ ID NO: 30797 - DNA, 1656 bp, Heterodera glycines
  misc_feature (1561)..(1561): n is a, c, g, or t
  misc_feature (1571)..(1571): n is a, c, g, or t
  misc_feature (1627)..(1627): n is a, c, g, or t
tttattttaaattaaattaaattataatttttattaaaaaattgtcagcaatggaattttgtttattattcttttcaatttgtatttttaattgctcaaaattgaaatggaggcgaaaaagaaaaaattggaacaaaaaacattggaagaaatatttggagaaaaatgggaagaaaaagaaaatgaacagaaaaagagagaaattgttcaaaaattcaacaaaattaaagagaaaattaagcaaaaagagagaaaatattcaacaaaagaatggcataaaattgaattgaaaatagcgaaaaaattgggaacaaatcgaacaaaaatttatcaatggatcaaagaattaggaatatacaaaggccacaacaaatcaaaaacggatgtacaaaaaattgaaattgttcaaaaatttattacaatgaaaaatgaatataaacaaaaaggaagaaaatattcgagaaaagaatggaagagaaattatgccgtaattgggaaaaaaattggagtctgccatgatgcaattaaaaaatggaagaaacaatttggaatgaatggaagaagaataactgaaaaagaaaaaatggaaaaaatgaaaatgtattggcaaatgaaaggagaaaatccaaaaatgagtgacgagaaaatttcaaaaatgttgaaatttaatcgacggaccattttcaattggaggaaacaatttgagaagaattaaatgaggattaaaatattattgagataaaattgcattttccatttcttagagcctatttttggggatttttaagacataaagcctaaagctacctttcgagttattagtgtctatcctaagcttttattattagacctaaaagcctaaagaatttgtgaaagaacctatttttgcctattggcgttttgtcgaaatttgttaacaaaaatgcaataaaaaccaaaaataccttccctaagaatcggcccgaaaatttctgaaaatacaccccttaataaatgaaaattttctcaaaaaatcatctccaatatttattttattttcattacaagtttggttttttaaattattttctcaataatgatttgaatacattttgttacttttcgaatagcttttcattttaggccactaaatttcaaacgttttgctttgcttttttatgtctggcattttgtaatatattttttaaaaatctttcggcagttaaagctggaacataaaataaaagccaaatattttttcccctttttatgttccattatttatttctagggctgccaaaaaatatgtacaaaaagtggtcaaaatcgtgctgagccgagcctaaaaagtatcaatgattgaaatatttaaattagattattatttaaatttatttgctaaagaatgactcataacttagcttaaacttatcaaattaatcaatcttggtgttggtcgatagctctatgtattctcttcaatcttatgtaattaaaaaatctagcaaaaatttttacaaaaagttgtaactaaaaattttgtaaaaatttagactcaataattttgttcctaattttttanaactcattanaaaaattttaatttaacaggattatatagaatctttgggctatctagtcatattanagttatatgaatgaattgcagtttgaaca

SEQ ID NO: 30798 - DNA, 942 bp, Heterodera glycines
aaaatggaatgcaatttattataaatttaaaaaaataaattaattattccttttattaattaaaaagagaattttgaaatgtacaataattgaatatttaaattaatatgaaattatttttataaacaattaaaaaaaatatgaaattctttattaaaagataattattattttttacataaattcttttattattaatttacagacaaatctttaaatataaattgatacaacagtgattagtaaattcattaaattaaaatgaaaatatttttaacaaatttaattaaaaaaatacatgaaattctatcaattaaaaaaataattaatttaaacttataaaatttatttatcaaaaaaaaattaaattaaatataattttttatttattaactcaacaaaatattttattaattaaaatcattgaaaataacgtaaaaatgcacaaaaaaataatgttacaccgtccggattcgaacctgcccccccccctcaaaatgatgcctcagaatccccaatcacacagggattcttaggtcttaacgatgtcaaaagtaaaatctgattacgtattcgtgatcagtggcccaattaacccataaagacatgtttttggaagatttttattgaaaaaaatttttcactcaaaaatcctgtccaccccctttggtcccgaatcacaaaatcacttttatttttatatctttttttaaaaatgtgataaaaatgtaaaataaaatttatattatagagaaaaaaattgcggatttttgtagtattttacttttctcaaatagcttttcagaaggcagttacgaatttttttctgaaaaatcgaatttttccagaaattctggaataatttttttattttggaagatagaaattccaaataaatctcataaaattctcccaatttttctctatttttaaagctttatt

SEQ ID NO: 30799 - DNA, 1330 bp, Heterodera glycines
  misc_feature (115)..(115): n is a, c, g, or t
  misc_feature (128)..(128): n is a, c, g, or t
  misc_feature (225)..(226): n is a, c, g, or t
  misc_feature (312)..(312): n is a, c, g, or t
cgtattcgtactgaaatcagatcaagtaagcattgccttttgctctacgagaggtttcgtccctctctgagctcgccttaggacacctgcgttacgcttgacagatgtacccgcnccagtcaaactcnccgcctgacactgtcatcggtgcgggtcgccgggccaccgggtggcccgacttaacaccaaaatggacacccttgcgggcgcactcccgtttacgannttaagtaaggaatcgatgaaagtagtggtatttcactggcgccttgcggctcccacttatgctacacctctcatgattcttcacanagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaggaacagcaagcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgatacggcgttagccggtgccttaggatcggctgacccacaaacggctgctgttcacgtggaacccttctccacttcagtct

SEQ ID NO: 30800 - DNA, 1142 bp, Heterodera glycines
  misc_feature (19)..(19): n is a, c, g, or t
atatttatgaattaatttntgctaaaaaaataaaatagtgaagctttaaaaagtaataaaaaaaatttaaactatgaattactggagttagcatcatagcggtgcttttcaactttttagattttttagtaatctctctttttgatagttaaagcatctgtatgcctaaaataacttgtaaatataatttggtgcatttcagaacagtttctgaaaaaatatctatgaattaattttgctaaaaaaattaaatagtgaagctttaaaaagtaataaaaaaatttaaactacgaattactggagttagcatcatagcggtgcttttcaactttttagattttttagtaatctctctttttgatagttaaagcatctgagtgcctaaaataacttgtaaatataatttggttcgtttcaaagcagtttctgaaaaatatttatgaattaattttgctaaaaaaataaaatagtgaagctttaaaaattagtaaaaattttaaattcagaattactggagttagcatcatagcggtgcttttccttgtctttttgatgccctcgataaatctggtgcgcttctgctcagtttataaaaaaaagttaagcctaaaatttttcgcatatttaaaaagcaattaaaaatttttagatttttattcatctccctttttgatagtgaaagcatctgagtgcctaaactaacctgtaaataaagttttgtgtgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttcgcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattaattttgctaaaaaaataaaatagtgaagctttaaaaattaataaaaaa

SEQ ID NO: 30801 - DNA, 968 bp, Heterodera glycines
  misc_feature (68)..(68): n is a, c, g, or t
ccctcctcagtttacgcgagactattcaccctcccccccccccatggtttcccctttttttagattanttttgagaagttttttcccttttcttgtttatggatcgatgcgtttgacggttaagcgaaaatgggaagagcaaaagggccactcagttgataagaacggagagagcacggacttcagtcagtgctttggtcttttaccagcagccaaataatggtcgacgctctttcagtgccgaaatggaattggcatttgtcgctttcgcttcccaattagctaaaaaccctttgcactccctcccgcccccattaactcatcgcataactttccatttcatttttgtcctccccttttttcctccgtttcccttaaatttgcctttttaggtccttgtgccttccactcgaattcttcttattcaaatggtttcgattatgcgttcggaacaaacactgcgtcttatccaactttatcacgccaattacccggaaattgcacggaataaccaagacgcggacgggcgcaatttgaagttgcaaatgtgggcacagataacggaggaactgaacagaacatttgagacggcattcaccgtggagcagttcaaaaagaaggtgcaaaatgtgcagtgcacgtcgagacagaaactgttcagcgggaaaaggtcatttgaacgggaaatgcaaaaaagaattgggagaggggggggggggtaaatggcattgggaaaatgggaacgagtgccattggagataatgggaggaaatgccattggagagaaattaggactaaaatgaatttactaattcagaaacttgggcgaggcagaagttgaatatttgcgattgttcgaatcggacaaaatttctgaagaaacattgggccaccgagcaaagaatcgtcgaatgtccgcaaataaggcagcaacagactttctgatgctaagagaaagacaataccaa

SEQ ID NO: 30802 - DNA, 1323 bp, Heterodera glycines
  misc_feature (1270)..(1270): n is a, c, g, or t
aaaaaaagcatttggataatgggattcaccaggaaacggaaaaatttagcactttttggaaaattttttacttacagatttgaaggtttcagacgcggtgtagaatcttaaaaaaattaatattattttaaatcttttataagattaacgcgatacaaattaaggaaatagtaaagttcatgtgatcttgatagaaaatggataaagaaaaggtggtttattgaaaaaaatggtgttaattcgcgtgcagaatctataaataaattaatattattttaatcatttaaaatattttagttatataaatgataaatcgaaatgtattaatgctctgataaaaaaagcatttgataatggattcaacagaaacggaaaaattagcactttttggaaaatattttacttacagatttgaaggtttcagacgcggtgtagaatcttaaaaaattaatattatttaaatcttttataagatttacgcgataaaaattaaggaaatagtgaagttcatgtgatcttaatagaaaatggataatgaaaatgtgttttattgaaaaaaatggtgttaattcgcgtgcagaatctataaataaattaatattattttaatcattaaaaatattttagttatataaatgataaatcgaaatttattaatgctctgataaaaaaagcatttgataatggattcaacagaaacggaaaaattagcactttttggaaaatattttacttacagatttgaaggtttcagacgcggtgtagaatcttaaaaaattaatattatttaaatcttttataagatttacgcgataaaaattaaggaaatagtgaagttcatgtgatcttaatagaaaatggataatgaaaaggtggtttattgaaaaaaatggtgttaattcgcgtgcaggatctataaataaattaatattattttaatcattaaaaatattttagttatataaatgataaatcgaaatttattaatgctctgataaaaaaaagcatctgataatgaatttaccaaaccggaaaaattatctcttttcgcaaaatattttttttacacattcgaagttttcatatcgcgatgtagtatattagaacactgaatatccaggcactctttatataaggtgttgaatcaatacaaagcatacttgcggaatatttgataacagtaatcgatgaatggactgaccaacagcgcctgcgtgctttgcaatcaaaaattgaggaaaaggcagagagagcctttaactcagcgctntgcatcactgtgaggtaagtgcgcgcttggttcttcgggaaccaaaataccaa

SEQ ID NO: 30803 - DNA, 1600 bp, Heterodera glycines
  misc_feature (18)..(18): n is a, c, g, or t
  misc_feature (24)..(26): n is a, c, g, or t
  misc_feature (36)..(40): n is a, c, g, or t
  misc_feature (43)..(43): n is a, c, g, or t
  misc_feature (49)..(49): n is a, c, g, or t
  misc_feature (82)..(82): n is a, c, g, or t
  misc_feature (101)..(101): n is a, c, g, or t
  misc_feature (111)..(111): n is a, c, g, or t
  misc_feature (114)..(114): n is a, c, g, or t
  misc_feature (123)..(123): n is a, c, g, or t
  misc_feature (127)..(127): n is a, c, g, or t
  misc_feature (132)..(132): n is a, c, g, or t
  misc_feature (134)..(134): n is a, c, g, or t
  misc_feature (136)..(136): n is a, c, g, or t
  misc_feature (144)..(144): n is a, c, g, or t
  misc_feature (147)..(148): n is a, c, g, or t
  misc_feature (153)..(153): n is a, c, g, or t
  misc_feature (181)..(181): n is a, c, g, or t
  misc_feature (187)..(189): n is a, c, g, or t
  misc_feature (212)..(212): n is a, c, g, or t
  misc_feature (217)..(217): n is a, c, g, or t
  misc_feature (220)..(220): n is a, c, g, or t
  misc_feature (222)..(223): n is a, c, g, or t
gggggggggggggttttnttgccnnnttttgtttgnnnnnttngcgtcntgtttgttggtccggccttttgggtgccgtgtncgtggtgctttgcggggtntgtccgcctnggncttttcttngggnttgtncntngcgctcgnttnntttgnttttctttcttctttggtcctgctttgngggtgnnnttgggttttcgttgcgctctttnttttnggntnntctctttttatttttgttttctgtcaatcagaagtagaagttgcgttaatagcctcttaatcacaaaaaggaactcatttaacgctgaaaggagctgataagaatttgagatgaaacttttttttgttcgttcgtcgtttatcacttacaaattagggaaaacgagacgacaacaacatggatggcaaatcactgattgtcaattggtaggggtggaattattaataataatacaaaatcattccgtaattattattaatattattcataataattctattcttaactcacaatcatccagcaaaatgtgtttttattctcttcataattttgtcaatgttttgttttgagatgcttaggaaaaacagcaactttggtaacaatttaaaaagagaattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattatcaaaattattaaaattattattattattatcaaaattattattttttcgattttcaaaaagaagattttgttcaaacaacgaatgagaagacgaggaagaaggagggggaggaggaggaagaagagaagtaacgagaacgtcgagttgactttgcaattgcgctatttcgatgttctttctcgccacgatcgtttgctgtgagcgcaacatcgtttttaatgctgacgtcatctcattttctgcttcattctcatctgatttctttttttcgattgttggcttggatatctcgctctttcgttttctgattttgttcatgtttgggtggtgtgtggtgggagtcgtcgttgttgtctctgtgaaagattggagctcttgcttgagcgagtcgagagattggtgcaaaatggtgttttcatcggctaattttgtgatttttttgcgtttttttttgtttttttttgtgagcttttttatttgctcttcgtaggtgtctgtttgagattttaatgcgaaaagaagcttttcaatttcgagattttttaataataattcatcattcttttgatcgatttcgaaatttatcattgaaagcaaattttccgcttcgttttcgatattttcaatgcttttttcatcgaattggtgaaataacttcccttctatc

SEQ ID NO: 30804 - DNA, 1342 bp, Heterodera glycines
taataagatttatcataaaatttcaattaaaaatccatcctcgattattggtatgaacgatactttccaaacatgcttgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcgttgctctaattaaccgcgatacaaacattcgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcgttgctctaattaaccgcgataaaaacatccgaatcaattaaatagcttctgagataataaggtttatcataaaatttcatttaaaaataaacactcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtctacagacttttggaaaaatttatttgcaatttatcaacaattttgagaagtgagttagaaatgataaacttcacgattcaaaccagttttcggtgctctaattaaccgcgataaaaacattcgaatcaattaaatagcttctgagataataaggtttatcataaaatttcatttaaaaataaacactcaattattggtatgaacgatactttccaaacatgcacgcgttttgcgctcgagctatttatcatcgggctt

SEQ ID NO: 30805 - DNA, 1315 bp, Heterodera glycines
  misc_feature (1287)..(1287): n is a, c, g, or t
ttccataatgcgtattcattcatactgggaaaaaaattatctttaggaagagcaaaaattgatcccgatctcgacttcgacagatttgttccactacgacgccggccgtgctgaccccgacaaagccggtcattttcttttcacaccccgcggaagggtcggattactaccctaacatattcaattatttattttttatcatttgctattcaaataattttatttacacattgcataattaacataatattttgtgcacaggaaagaaataagccagtccgatccggcgtgtgcgatatgattcattaatccattccatcggtggtccaattccatcccacttttccatcccaacacattcacaattagtgttaaagctaatgggcgaaatgtaggaaactaataaagtgcatataaatatataaaataaatgtttaaaaatattcagaaatgccttacggacatttgcggataatttcgggaaaagataaaaaaatttcttgaaaaaaattaacaaaaattcagaaaatgaaatggaagttttggcttcatttttaaattttttcccgaaattgtccgcaagtgtccatccacaaatgtcccactgcggcagccgacatccctcaaaatggtcaaaccgatgatgccgctgaaagtggcccagccgatgccattgaaaacggaaccgaatattctggtaaaattagttggcatttatgattattacaaaaatataatttcttgcaaaacattttttgtcgtaaatctgcgcacggcgcattcctgccccaaactctaaagctaatctaatttatcaacagatgaacttgacccagctgacatccttggcaatggttcaacaatcaattcttcgcaccgacaattcaaagcggtacggtcacttttacatgagacatttggcgtttccaattttaaaatgtcttcacaagagctcgcattttgaggcatatgccttttttttctgcgcactagttccgatatattaagcatttgaggcttctacgttgacttatcttatgcctttttcgggattttcgtgcattataatctttaaatatttaaggaaggcatcgtcccgataactgcttgaacttgggtgaagcagcaaaaaatgcaactgtccatccctcattttatggaacgaatgctgtgaacggctaaatgcacaaatcgcaaattttgtaaaaaaaaagttagggcaatttagcgtaatttttaaatttttttagcaatgcctaacacacaaattgaatttgcccaaacttngtttggccccatttgtgttgctatgttt

SEQ ID NO: 30806 - DNA, 913 bp, Heterodera glycines
ggtttcccaatcgggaaatgtgatgagtgtggtctcacttgttacacgaaaggaatcgtcgtaacagtgccacccgaaatccaaaagttcgaaatatgctgtgcagaaagctgcatagtttggcaaggcatcaaagccttgaacttcgaactaccaatcgaagtcctactcaacaatcataactgtgaggccagattttggactgactcacagcacaccttcacatcaaacacgacctgcccggcagtcgatgaatgtgatctcatcgactgctactttttcacacaacttgtgaatccaacatgccagcccgtcattgcggcaatgctggcaggaggcctgtccttaagcttcctgtgcttcatcttcaccatgtgttccatggtggatacgccatggcaggactgagaatccttttttggattttctcagtcttgttcgcgcgcttattcaagccgcgaaaagagacatgggtattgagtgaggaggagaaaaacctcctctatcctcaccgacgaatacgccggcccaggccagcaacaagaaactggccagtggccgagttagccaaatggcaatgcttgtcatggcatctctcccgtttgtacatgggggaattgaaacagtggctataatggccaaatcagagagctgcctcaacaacggcacaacgaaaatgtgccaagtcaagggaagcgtaacccttgcgcttctcccggcaggacaaccgaatgtcctgtcaatgaagaccgatgatggtctcattttgggaacccttcaagcgatcttgaggggacactctctcttgtatgcccagcatacaccaaggcttggaaacgatcatccaagatcgcttccggggccagcaaaagatgtccgccggctggctcatgtgtcggtgacttttgcccaa

SEQ ID NO: 30807 - DNA, 1720 bp, Heterodera glycines
ggggggaatcgatttgaaggggaaacgaattttggcaaagtgtcacaaaaaaggaaccacccgagggggtgggggggggagagaaaaagaaaccggtttaaaggcaaaagaaaagaagaaagaaagaacagatggacaaacttaaaatggacgaaattagcgaaatacacacataattaattattaattaagcaaaacattttctgttttacataaattaaccgatcttcaactaaaacccaaatttatatattcttaaaataatttatattcatcgagaaaatttaaggactaatttaattgacaaaatctgttgacgaaacctgccaaaccttcaaagtttcctctgaaggcgattatcgttgtgatttttcgggattactcccgtgtcaaacggaacaaagaaaaaaggcttttcaaattggaagaaatgagtaaaaaaacaaacaaagggaaaaacaatgataaaaaagtaatcgaaaaggcaatgagagaataaataataaaacttttaagttccctttggcaattcttcaaacaacaaaaataatcaaatgtttcaatggtcccaaattgtccaccatccgaagcgcacaaatgccatttgataatggaggacggcacggaagagatggaacagcgaatattcgggccaaagcacgtcggtgtcgaattttagcacacagcggggggagcattggagctgaagcagaaattatgaaaaattaaatttaaaaagggacgaaaatttgaattttctgtttttttgattgcctgccaaattagaaaatcgctgagccgacattcgctggtccgtatgaacaggtcgagcggacgacaaaagcgcgtgtccatgcgggcggacagcaaatcgacgtcaatggcactgagaaaaacaaacaaattaaatggcaaaacaataaatgcagcaatttcacagggaagaagttcgtcccccactgaattttgttttaattttttcaaacctagaaaaattatttattttcttttttcaaaaatttgtctatttctaaaaactcactttctgtccaattttcccgatcgaacttctcggcgaatggtctcaaaagtgcgcacaatttcattttgtgaggtgtaagagaggcaaatgttcaggaaagtcctgcaaacaaaaaagggatttctaggccatttttcgaacgctttcataccccaagttggggtaaatcatacaccagacgaatagcattttggtgagaaaaaaattttttgaattaagttaagagttaattttggtttgcctggaagagtttcgcgaaagaactgtgactcagaaaatgcgtactattaaatatcaatgaatatgaaaaattgtaaaatatgtaaataaatttttaaaaatatttttaagtgaaaacataatttaactttaatggagaaattatttaaaaatattaactttcaaaaaatgttcattttttgcaaataattttattgagcgtaattttgcaaattgttctgtgggccgttgttgtcacctcattttcgtagcactttcgccctctgtgctcgtcgtcccactgatctcctcaatttcctccaccaatttgcaaattttgtcgggcaacagcgaccgatcgccgaagaagcgaatgccaacgcgacgctcaatgagttcggatctgtgcattgaaaaaaaacaaaattaaaaatttattagggggtaaaatatcaaaaa

SEQ ID NO: 30808 - DNA, 1480 bp, Heterodera glycines
gtaaagggagcgagcgtaggtacggaaagggagcggcgagcaaggagcggaaggatgaaagggagtgagcggggaaggggtgtttgtccgccctcacccctttgcctttctttctctacacctcaaaacaccaaacccttgctaaaattgcactcttatcccccaccctttcgacctcactttgtttttgtcttcccccccccccccccctctttctctctttcttcgtctgtgtttgtctgtctgtctgtcgagactctcgacgcgggggatgactatgactatcgcttgtttacgctccccgtcgccaaagtgacgtccaccaaatccaccaccactccttccatccatccttttcacacaaacattttcatccagggaagctcacgagaaatggccgagtgggcatatgcaatttgcccccgggggtgtttttcagccgtgggatgaatctcggcttaaaacatcgggcagacgagactcttgagggttgctcatcggatcagtgcactctcacgcccctttcctttgatcggccgttctcttcagcacaatttccatcctatttatttcctttttattatcgtacttcttctgcacgccgacatttttttttttgatggacggatctttcgaccgaaaacattgcctaaggcgcaacgaatcggcggcagaaaatgcaaatgcgacgcaacggaaaagccccggggggaggaagggaagccgagcattggacggtgggcaaattaagggaaatgattaaatgtgttgttttcgtataaatctcacaaaattggggagggaaaggaatttggggattattatttatctgctgtttactgagggggccgtgaatccacgcactctccggcggacaacgcacacacaaacaaaaacacccccccccctgcgcacgccccaatttgaaattggagcaatcgccgggggcatcgaaaggcgacaacgccccgggcaatttgcaaaagcattacagaaagcgaattccgcgctgcgatcaaacacattctcgagacgggtgacagagaaggggaggacgcgaaaggaacgaaggaatacgaacagagacagcagcggaaggaggaggaggagggggagacggactcctccgcatcgtccatgtccagtcacaccgaaacgatgaaaagcagcaggtccaaaactgactgatcgctgctatttgttggcactttccccaccgttggtgccatcctttagcattgattctggcactaataatttgccatgttaaaactgacaccaatgaatccgattttcgctgattacccatttgctttgcagaaacagctcccattggcctttctgctcccatcggatgaaaaagatgcagaagacggcccaactgaaactgaacgaagcgggccccccccctcccaacccgcgctcatgaaaaaaaccgcttggagggggatcaacggaagaaactttgcaaaaactgagg

SEQ ID NO: 30809 - DNA, 1382 bp, Heterodera glycines
  misc_feature (47)..(48): n is a, c, g, or t
  misc_feature (51)..(51): n is a, c, g, or t
  misc_feature (53)..(53): n is a, c, g, or t
  misc_feature (57)..(57): n is a, c, g, or t
  misc_feature (61)..(62): n is a, c, g, or t
  misc_feature (65)..(66): n is a, c, g, or t
  misc_feature (70)..(71): n is a, c, g, or t
  misc_feature (85)..(86): n is a, c, g, or t
  misc_feature (90)..(90): n is a, c, g, or t
  misc_feature (100)..(100): n is a, c, g, or t
  misc_feature (106)..(109): n is a, c, g, or t
  misc_feature (116)..(117): n is a, c, g, or t
  misc_feature (119)..(119): n is a, c, g, or t
  misc_feature (126)..(127): n is a, c, g, or t
  misc_feature (134)..(137): n is a, c, g, or t
  misc_feature (139)..(140): n is a, c, g, or t
  misc_feature (146)..(146): n is a, c, g, or t
  misc_feature (154)..(154): n is a, c, g, or t
  misc_feature (157)..(157): n is a, c, g, or t
  misc_feature (164)..(167): n is a, c, g, or t
  misc_feature (169)..(170): n is a, c, g, or t
  misc_feature (182)..(182): n is a, c, g, or t
  misc_feature (185)..(185): n is a, c, g, or t
  misc_feature (189)..(190): n is a, c, g, or t
  misc_feature (196)..(197): n is a, c, g, or t
  misc_feature (200)..(201): n is a, c, g, or t
  misc_feature (203)..(203): n is a, c, g, or t
  misc_feature (205)..(206): n is a, c, g, or t
  misc_feature (213)..(215): n is a, c, g, or t
  misc_feature (221)..(222): n is a, c, g, or t
  misc_feature (225)..(225): n is a, c, g, or t
  misc_feature (227)..(228): n is a, c, g, or t
  misc_feature (232)..(232): n is a, c, g, or t
  misc_feature (234)..(234): n is a, c, g, or t
  misc_feature (242)..(243): n is a, c, g, or t
  misc_feature (245)..(246): n is a, c, g, or t
  misc_feature (253)..(254): n is a, c, g, or t
ttcaacaagaaaattctgacgaacgaaatttgattccttacaggggnnatncngagngccnnggnngcgnnggggcttcgaacanngccnggcaaaaggnccgaannnnccgcaannanaacaagnngggcggnnnngnngcgggncgccggcnggnggaaaannnncnnggcgaaaaggcngcngcannggccgnnggnngnanngaggcgnnnggaaanngcngnnaaancnagcaaaanngnngggcccnngcattgcgagctttgatgccttttgggttgcttcagctctcgccgctaacgccacaaattcgtcgaaaatcatggatggtcgacgggctaactcgagagttaatgctaactccgggttttggagagcccttatgaagtgccgaattgaataatcgtcgtaaagatgctcgagtagcccagggtaggcttttctgaccagcgaagaaatacggtccgccaaatcgtcaattctctcattgtctcggcgataggcaccagacatcagttcgtcaaatgccgacatttgcctagcatctgtctcctccagcagatttatcatcgctctctttacgctgtcataacggaatgggttatttgcaaccgcaacattgaacgcacgttccgcacgccccaaacattttgatcgaagtgcgcttaaacgcttcgcttcaggccattcttcggttgcgacatcaaaatgccggaaaaacgatcggacgccatctgcgccggaattccctttcagttcaggcagagaatttaacgtcattgagtatgaaaagttgtctaggcttttaattgcctgtgccagaatcatgtcatgcatttcactccttcgaatttcctgtatgtgatcaacataagggtaattccgatttgcaacatgaatttgttcgttatttgggagtgggcttgtgttcagttctgcgtttgcgtttcgcccatcacaaacataattgcgatttccgggttcaaaattttcaactctacgaaatatttgccgtccaaaattctgctgaaaattctccatttgttgctgcgggttgttgtggcaaagaatattctccgttcgagcgttcagagcaaggtgttcggccgaatttgttgctataccagatcggtggttagccgattgacgcagagctgtcagttgggagtgaacagccatttgacgcacaaaaactgggtgggcgccgtccaatctcgactgcgtatactgcacatcatttctcgccgacccaatagcatttccatgtccttgatttcccattgaattgccaactcttcggccaataccatgcaataaactcactggatttgattcatgggcgggggaataggtaggcactaatcccgcagtgttcaaat

SEQ ID NO: 30810 - DNA, 728 bp, Heterodera glycines
caaattttaaaaaaatttctcggggggggggggggaaacgagctgctccctttggaatgatccattgtttctttaacaaaacctttattcagtctttttaggggttaaaaaataaatatataaaatttgatgtcagaatgggaagtccttatgccattttgtcttgcaaaagccactgactcgtgagacaaaaaaccgaaacgctgtgttgcatttgtcaattggcactcaccgctccgttctccacattttggtaaattatgctgtgcttccgccaatgctcctccaatttcttcttcgattgtccttctgttggcttcgtgtaatcgaactcatcgacccgaacctaagcaaaaatgaaatggtaaaacatttaaattctgcaaaatgaaaagcaccggaaagtcttcccgggcgtgagcaccgcgcgactctcttctgttctcagcagcgacgattgtttggagggcattaatgagcagattttgcagttccaacgtttcaattaggtcggaattccaaatcaatccgcggtccgaaacgcgaaggcgtttttgttgtgcgaagagacttcgaactttctcaattccttccttaaaatggtaaaattcgtaagttccttctggacagtgccgtaacttgaagcaatggtccggttctgaacaccgccgcattttttgcattgtccgctgtaattcgagccgaaggtccgcggttgacacgtcacc

SEQ ID NO: 30811 - DNA, 1063 bp, Heterodera glycines
cgtcgctggcgaaagcgtgtttataaattaaaaataattttcatataattattttaatgaattgttttcatacccggcacatttcctgcggccattttgctcaaaatgccaagcaaataaaattggtgtggcgatattggcattgcgctggtcgcaattgtgactggaattcgtaaaaaatggaaaattgtcattgaatattccgtcatcataaatgcctccgcaattccaacatcaaactgttcagcacacaaatcgtccataagtgatgaattgttggctattgctgtagggaatttttttttaccagatttcaaatatttttgttgaaaattttataatttacattattttaaaaaattgcagaagaattaatgatataattaaggattgagtgtgttgtggtttaaatatttttcagcattttacaccgttaattttatactataattattttttaccaaaataagtcgtgtcatttggcggtgtcccaatttttctgctcctttctatgggcgttgttttattgtaatcgtttttctctataaaatatcgaacattaaggagcttttcatcatttcgatccggcaatttgtcattttcatctctaattggtaccagcagatgcttaatcatttaaatttattatttatttttaatgtttttaaacatacaatttcatgtccatgatttttgaccaacaattttgccaaatttaatccaaatgtgaagtgactctggatcatcgcataactcggttgaatcattaaaattttcaatgtctttacatgaggccaaataaacaattccaatccgcttataaataataatgccaatgaaattggcatttttgctgaaaatttaaattgtctttcctttcagcaaatttgccgatttaaatattcattcaaatacgtaaaatattcttacttattttataccttttattaaaaaaattcaaaaaaatcttaatcattttaattatatatttacttgttggtaaacgaagttttatttaagaagcacttgctgagaactaaattttaagcacttaagcaattaa

SEQ ID NO: 30812 - DNA, 1222 bp, Heterodera glycines
cagaaatgcccgtccttgtcagtctgacacaaaagaaatggcgaaaatcaaagggaatggcattggcagcgcatgcaaatgccaaccgaacacatcgacggcagaaacagcagcggaagtgaccgccgcaaagtcagggcaaagccaatcaactaattagtcaattaacgataattgactaattaattaacgaataattatgccaacgtaatgatattttgcaattgtccccggactgttcagaaggccctcccccgctgttcatccgccgttcccaatttcttttgatgccaaaagtgaggacggcgccgcctttttccccgttttgctcagtgactttcgctccgatttgtgccaattgcaagactcagtgcgaagggtaaaaaagcaattaaatgaacaaataaaaattggcgaatttggcaaggatttggaagaattggagacacttcggctacaaaatgccattctgagggaacaattgacggaaagggaccgaatcatcgcatcacttcagcagcaattgagaggacaaagctgacaaaacggaacaaaccaaatgatcagacccaacagactgatcagaacagcacactgatcacttggcaaaaggcggacaaagcgacggatcgaacgaaacattcctttggcactttcattcattttgcattttggaggcaaataaacactttaaagatttacgaaaaaggaagtcaatctttgttttttaaggtaaaactaaacgattgtggttaaaaatggggaggacttttacgagggaataactaatgaaaaaaacaaagtgccggtacgggtcggcagtcagcaaagtgaccgtgccgtcgtccaacacgttggtggtgaacgcgaggcgaaagtggcggccaaggccgtacgccgcaaccacattgtccaacgcacagaacacgtattccccccccccccccggacgggcacgactgggcgccgccgactgggcgctaccaactgggcggctcaactgggcgccgccgactgggcgaagacccactttcaaattccctttctttaggcacaaaaatcgcaaaataggtttaaatagacacaaaaattttcgaagaggcaataaaatttttgagaatttttattttcaattctgaagggtgtattttttaaagaaattttcttttggttttattttcaaaagtcatgaaagcatgatttcaaggggattttggggcgc

SEQ ID NO: 30813 - DNA, 1609 bp, Heterodera glycines
  misc_feature (1577)..(1577): n is a, c, g, or t
tttgctataaatgcaccaatccattgctgaaaagtgtcaacttatagtattttagttatgcacgttttttgaattggaattcacatttcgccaaaaacactgaccagcatcagcgccgcccgcaccaccgcggaggccgcgtcgcgtctgccgacaatgtgctgctgcttctgttcgcctccgtcaacggtggccgccccgtcaatgagctgcttgaacagcttggcaagacgcttgggtgtcatggtgttctcctggcagagaaaatgaattggtcattggtatgtgacaccaaaggagtttcgcccacctttttgcgctgtaaaagcgggtccaccaacttaatgcccaactttttgtggttggaatttgtgcgccaaacgacggaagagaaaatgtgcacggagagagactgaaagaagcaaaaaatctaaaatatgtttaaactattcccaactagggtaaaattttgttgaataagatttttgatttttacgaaaaattttgaaattgagcgactgacaataagtacccagttgcaaatgccaattaatgagtgaaaactaaataaattaaaaaacatgccatcgcttcgctgaacggtgccgttgacagataggcgcacaccaactcaatgagtcgcagacggaaaacgttggcctgtcgcgacagctcattgcgttgggaggcatgtcgacggaatgcacgggccaagtcgtggtcaagacggaacatctgctcgtcattcagttcctggcacaatgggaaacgaaatttaaaacggagacaaaaaaaggggggggaataagaaatatttccatgaatcctttccctcagattacccagttgtcctcatcggatggcacctccgtggcgttcttcggagtcgccgctttgcccatcgctcggcgcacatcggccaccaatttggggtccacgtcgggcgtctcctcctcttccactccttcgtcctcttcctctttgtcgtcctcactttcgtcttcttcctcattctcatcatcttcttcctcctcctccccctcttctttcaacagttcggcatctttatcaacaaaggcctaaacgcggaggaaaatgcataattaatagtcaaaattcaaaatctttaccaagaaatttaataaattttttgaaattgcaggctgatgactgtatttgaccaccgaccttcaaaattggttcaaaatgtccgtagttaagccatttggcgaaacgacacaacacaaaggcgcccaacgcgcgatggacccacgccgtgcgggaggcccaagcgatgaccatgtcgacaatgacgggcgccatgtcggcgaccaacgcgtccaattgcttcttctgcttttgtgcggcgtcgcccatcaaattcttaaaatggcatttttataatgcaatattcaccaatgaatgtttgccttggccattttgcgcagttccgtcgactcgttcagatattcctcacgtcgttggggcggtggtcctcgtcgtcgggcaacgcattgcccagcaaacacagcgcagcggagagcacacaaagggcactgtgacaatgaacatgcaanttttagaaaatggcaatggtacactaattatc

SEQ ID NO: 30814 - DNA, 1197 bp, Heterodera glycines
ctgtcgcttcttctctttcattctccagaactcccgtttccgcccggttcacttctttttcttccgctgatgtgttttttcgttggcgtttcctgaaaggaaaaacattaaggcgaattaaaggagtgataaaaccattacggttttatcaaaagcatcatggctttttcagccgcttttctttttggacgatcagttgtgctgaaatgcaaaacagcttttataattttcaatgaaaattttaccccccccccattcttaccaggtaaaagttgtctcgttgctgctggtgtccgaataattcaccagattaattgagtgtgatatatctgcaaaaatttttctttttttctaataataaatttgaagtttcatactttcgacgtcgacgacaaatgtgtcctccgcattggccccgggcaaacagcgggccatcatcgttggtagcggtggtgcgggcacttctccatttggcgaattggtgtcaatgcgcagacacccttctgagaaaacaaatataccattgaaaatgtaaagaaaacattaccatcaattgctgacaaattttcgtccgccatcaataaaaaaattgtgaacgagctggaagcttttgagctaaaaaaaaaaaaagaatatttaaaacaaaaattattatgctttttattgtgaacaatttatgtaaaaatgagagcaataggaatgcgacgccgtcgcgttcctattgcacactgtgatgaccccctcccccactgctatgccatcgattaactgacccacttagaccaaaagggaattgacaatttatttttaattattgatgattttaaatattcgtcaactccattgttgaccaatgaaaaatttttatgcccccatctgtcacatttacaatcaatcaaaaactgtcactttttaaatccatcaaaaattcccctccccctcggctgtcactttttaaatcaatcaaaaaatttcaccccctcccccctcgtctgtcaatttttaaatcaagcaaattttctgtcaaaaaagtacaagacaatttgaaaccgttcaataggtttgggtccccccaattaattaattaattgctaccccacaccctacggctgaccaattagtgccctcttgaccgctgaccaattagtaccccggtcagtcaattagtgactaattgacacccctccccgccagctg

SEQ ID NO: 30815 - DNA, 1373 bp, Heterodera glycines
cagtaggggtcagttccgtctggccagttccgtctcgccagttccgtctggggcggttccgttttgggccagttccgtctggccggttccgtctcgccagttccgtcttagtactcaaagggccggttccgtctcaaatatttttggactcaaattttttaaaattagagtgccacgggaccgggaatttttgccataccgggaccgggacttgccgggacctgagaaaccgggaccgggacctcgattttttttcgggaccgggaccgggaccgcaagaaaaaccagggaaccagggaccaaccagggaaattttaaaaattcaaaaaaattttaaaaatttaaaaaaaaattcaaattttaatttatatcaagtgaaaataatacaaaattatttggttttttatttaataaattaaattaatgaaaattttcaaacaaattttcttcaattatttcaaacaattaatcatttttggactaaatcatcgaatattaatagaaattcagatttgattttcacatcactttttttcggagcgctttttcaaaaaacttttgggaaagaaggggtcccggcggtgccgataggcgccgccggggaaaattttaaaaatttgggtgcaatttgttaacagattttcaacaaaaaaaggttggtttttgcgattattaagctcaattggtaggattttcatttaaaaaatgataaaatatgtatcaatttaaaaaacaaatacagtcatggtcatatgtttaggaacacctcttttttttgaataaattctttgaaaatattgcttctctggattgaaagaaaaataatcaataatctttttaatgcattttgtagcattttttctgggctatccattggtaccacacatttctcgtttgctttattcctttttgtaaaaatttgtgttttcttccatatagtcaaatttcggggtggtcatatgtttaggaacactttctttttttgataacatcaatatttggtcggtccgccgcgggctttgattacagcttccattcgattgggcattgaattcattaatttgatcaatgtaacatatggaattgaattccaagcctcggaaattgcatgccaaagttgaggctttgagcgaaagtgcttgccggcaattttctgcttcacaattttccacaaattttcaattggggacaaatccgggcttaatggaggcgtacgaaggagggggactccgttaagtcgaaaccatcccggaagacgcaaacgccgaccgccaggaagccgtcgaacgcggccaatcaatagtttcccagtgtggatggccgctccgtcctgctgaaaaatcatcccggggcaagccgctcacgtgcaaatg

SEQ ID NO: 30816 - DNA, 1121 bp, Heterodera glycines
  misc_feature (119)..(119): n is a, c, g, or t
cgatcctgtaaattacgccaatggagacaattatggaatttaatgaaatatttaaatgtcttgtaattttggggtttgcgacccattcacaatttcaattgattcattttcataattcncagggagccaaacgaagtggacgaactttgggattacgacatgcgtttggtgtactttgtggccaaaaaacgtgtgctaaaggaccaaattgaacaggcgaaaaagggcggccacggaacagttgatttggaaaccgatctcatcaacattgaggcaagcaggggcacagaaaatgccagataaattttttgattctaaaaattttccgccggcacccatattccccaaaaaaatttttggaaaaagatacgccgcaaaaaaaggtgtgaaaagcaacaacaacaaaagggcggcaatttacatggctttggacccttcacaaaattgactgctgacccccctcgactccccctccccacacagaccatttcgcggatattctatagtaatcccacggaaaaatggcataaatgatatatcaatcgagacccggtttaaaactcgaaaattagagtgaaaagggggctcctgaccttttaaaacggccaaactcggataaatttggtatctttcaacagttcctgtgagccaagtcataaaaaacaatgtataaattcgaaccgatgccatctaggcactgggacatctgagtcccagtgaaaaaggatacttcagtaccaaaaaatgacgtaagaaaaaaattaaaagcaagaaaaaaacgcaaaaaggagatgcaaagacgtaacaaataggcctaaacttaagcctacgctgaagcctaagcttaagcctaacaagggaccattcccaacttaagacggaaaacctatataaatttggtatcattggatgggtgcaccccaaaatctcgccgccgaaatctcgccgccggaatctcgccggctggaatctcgccggccgaaatctcgccgagacaaaatatcgccgccgaaatctcgccggccgaaatctcgccgcagaaatttcaaaaaaaaaatttcaaacttagaaatttttcaaggaaaaaattcttagaaaaatttttttataagaaaatttaa

SEQ ID NO: 30817 - DNA, 988 bp, Heterodera glycines
ctcaaaaagcttctcaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaaatggtctaagtaaaatcgtaattacgctcaaaaagcttctcaaacaattttagcgcttccaatcctttctacatcgcctttatacatcccattatga

SEQ ID NO: 30818 - DNA, 779 bp, Heterodera glycines
ctttccacttcagtcactgtgcgcctgcagcccggcattctctgcccgtgttcagctgctcctccgccgggccctcccccgcaaatggcgccgccgccccctccgcctccgatgtcgcagccaatttgcatttgcacaccgcgtaccaactaaaaagtacattcgtccattgtatcattgcttcagttcaacaggacccgtgctgttttccgccgcccccgcaaatggcgccgccgccccctccgcctccgatgtctcaaccaatttgcatttgcacaccgcgtaagtgccggggagagggctttttgagggggtaagacgctatcttctattcaacaatgcagggcagcaggaccagtgctgtgccgggacgggccaagcgccgccccctccgccgcaaatggcgccgcccgtccctccccctccggcgccgatgtgttgcactccgatgtgctgctcgcccctgtgttgccctcctccgccccaaatggaaccgccgctccctttggcccctccgccgatggcaatccaagtcagtcagtggtgatgggcacaaattcgagagtggagttgaatgaatgctaagagtgtgaccatccaatgcgcccccatctgcgccaatgccccccaaatggcgcctcctccgccgatgtgttgcgcttccgtctatgtaaaaccacctccgccccaaatggcgccgccgcctccccccgccgcaccccaatcgctgctttgctgcactccgaaaagaatgctgcccgctgccgccgcctcctcct

SEQ ID NO: 30819 - DNA, 1405 bp, Heterodera glycines
  misc_feature (24)..(24): n is a, c, g, or t
atgaatatgaatcataataattanaaataaggtgctaagtgagggcacccacctggaagtagtcagccaattggagcagcgccagcacatttgttgctacaaattgggaatccgttaaccaaaaattaaaatttcatatttttgaaaatttatcccctattaatccataaaaagaggataattattttttagaggattacggttgggcagaaaaggtccgatctttgtcatataaaagatggactctaaaaaggcaatgaattggtccatgtccacgcccaattcgtccaaagtgatcattcgctgctgcttctccttcatctccacgctgagcatgcgactgatcaccggggaaacggtcatcagccaatgggcggacacagcgacctgatcaaaatcattttatcaattatctgaccaggacttaccaaatttttgttggacaatatacaaagaaatcaaaatttcaaaaaaattttcccgacgacgcttattgacatcgcgggacccccttttcctcaaaaaatttttggaaaaagcgcatcgtaaacatttttttgaaaagcaaagaaaatcgaaacaataaaaaaaaaattttttttttgaagaaaaggttgtcatagaaatttggggcattttttcaatttcataatatttttgctctgatagagcgggttgaggggtatttcatttcataaaggcaaatttctgaccctccccttgcccatttatgcctgcttctaaagtcaagcccccccccccacagttagcttcttaacctgtttttcaccaattttcacggtcaaatcgtcgtcgggtgagctgtcggaaggcgccgggaacgcacttaaaaatggaaaagtaatttaaaaaaaaatggtacattaattaattaatagtcgggaggacggggacttaactcggctcccgaaaatgctttggttaagtatttctattggtaaaatcggaattttagtattattatattaccgtttctcctccgactttttctcccgctttttgagaattcgaattacaattgatggatcattagcaatgttgttgtaattaacttcactgcccttgttcaatgtttttgtctaaattttttcaatttattttttgtccaaaactttcgtattcgtttttacaagccgagaggaatgattcatatgtaattttctgacaatttatgcgcttttaccatttggaaggttaagtgccaaagccattttagtccggagtcttcaactcttcagggagtgatttccgcacaaaaaaaaatgcttacttcactgatttgttgcgtcccattttggtcccaattccaacggacaatttgtgccaatggctccaaatccgacggattggaagaagcattgccaatgtccgcgattttcaatgc

SEQ ID NO: 30820 - DNA, 1176 bp, Heterodera glycines
  misc_feature (1106)..(1106): n is a, c, g, or t
agttcaaaacgcggcgttgggtgctgagctccatggaaattgggcgccaattttggaagtttttcacgaaagaaatgggaatcgtcgatttctatggaaaacattgccaattccgcaagtccaattgccacggcaacgtcatcggattcaaacgcatcaccatctcgtaaaattgagcgattatgctaaaaattttaggctaacatttccccatccattttcacagtttcatcgaccaaaatgtcatcgcttttctccaccattttcgtccacttttcgccgcctgtccaatttatttgtccatccaaacgtttcgtggtaattatcgcatttggaagttgattttgcgcaacatttggccactgctcggaaacaacattcatagcatgggattgtccgtcggaacattccaccgtttgcgcaaattcgagccgtcatttctcgacgattgtgcatcgcttcgcgttgtctccttggacaatttcttcatcgaattcccggccgatgacagtgccacggcatcggatggacaattcgtggccaaatggttgttcactccgcttcaaaacaatgtgccgaaggtgttcgaatgctcgttgtacatggatgatgaaatgttgttgtcgatgattgacgccatcaaaggggtgattactagggcgtcaaattatatggaaatccatattttttttcctggactgtggggggcctgaaacgtacgaaaaacatgtttttagctttgtttgaagcttctaggatgggtttctatatccatatttttccatatttcgcgatttatgtccatattttggcatttaagtccatattttatgtccatattttgatatttttccaaaaaacctctattagaacggccccaatcagctaaattagccttttggcccccctaaggatcgaaaaattttcagaaaaaatgatttttagaaaaatcttatttacatttcaaattttcttaaaaaatggcaacattatgtcaaaaataagcaaagcgaaaattttgcttttcgggccgattttcgctaagactgagtaactaactttatcgttattttttcttctaaaatgatttttaatgccatgtttanccatttttgaacgttttactttacccggaaggatttgaggaaattttgagaaagcatacccttaattctg

SEQ ID NO: 30821 - DNA, 1515 bp, Heterodera glycines
gtacaagcggcgtccttgcagcaaacagttaatagggaaaatcatttggaaaccaaatggaaaaggccggacggaccccaaacagctcttctcgcaaagtcccgcggctttccttttgcagtaaaagagaaaatcgccgtcctaaaaaagaaaggcaaagtgcgcaccaattgaatgatcccaaaatgagtttccctattaaagcatttttcggcaatttaaaacatttgaaaatgccttccccatttgtccgttgggaattctctgccaatgtttttctcattgaattttgtatcataatcgtccttttaaaagagtttcaaaatctcatcactaataattaattatcgttccctttctcatttccactgtttttttcgctcctccgttacactcattgccccccttttgccccgctcccccgcgatgagtttgctcgagggtaattgttgttttttcatttccttcttccccccccccccattctttcgtgtccaattcaatttttggatttacagcgacgaattttccttttctaattcaaagattaaataaacataaaaagcgatagatcacattaattggattttatttgaatgaaattgtcatttaacttcctaattttttgatttaaatttccttttttactcttttcgctttaattccccataaaatgtcattgttttgctgggcccacctgccattggtggccaattcgtcgatgctctccgccgttcgtcacacagccaaccgcgaccatttcagccgcatcggcccccttggattggcattcgaaactgaacatttgttgctttgttggcaaagtgtgtgtcgttggcacattacgtggtgtgtcctcggtcgacgctttcgccgatgcgaagtcggctccgactcggctcgtccacacatccgccaagccgtgctctgacggtcgttccctccgccgcgcattcccaccacgtctgactctgttcttcggccaattaccctcggcttcccccaatttgccgcacctctttctctgtccatttctctcctaccaaaatggtttcgttcgcttttcccttcggcacacagccaatgattttcaattgcaaatcggtcgcccaacgcgaaagtgagcatcgcatcagaaggcccttcgccacggtcgtctcattaagtcgaatttgttggctaataataagcatttttggtttgcaaatagatggtaaatttatgatttaatttgccctccccgccccgtcccacccaaattcgtccaaacatccgattggcaccattttcgccccacggcactcgtaaacaatggaaccagcctcaatctgatagatgagtggcgaggggatggttcgttctgtgttcctctgtttctgttcaccttttccccctcgtcgtgccatttcgacttttgctccccgaggctcatcaaacatttcggtggcatttgcccaattttgccatcctcgaccaattgttgcgcatctttggcagcgaacgaaggaggaaaaa

SEQ ID NO: 30822 - DNA, 1812 bp, Heterodera glycines
ctagagtcacttaaaaattgggcatccaaattctttttttccccaaattttgaccgtctctgccccatgttcccgaaaagtttttaaaaagcgcgccacaaaacgggttaaccgaaaaactatcgatgattttggccggaccccactcgcaaaattggaaaattttccgaaaattttcaccttttttggaggggaatttttcaaaaaacttagtaatttatcataaaattttgagaaaatcgttagaaaattttcaatttttttttttgttttgagatttgtttaggtatgtaaaaaaatttcggggttaacgaaactggggggggggtgaacttatcccgatctacatccgcacaaacaattgcgccccatcttaaaaaaaaatgttcctcatccatcttccagggatggtgatgtgcctgctctcctacggtgccggccttgacgagcaggcggacagtggcaaaatgacggcactgcattttgcggtgtccaagcgcaacctgcagatcacacgcttgctgctctgcctgggcgccgacccgaacgtggccaatgcgcacggggacacgccacggcatttggccgccaaattgaacgagtaattattatttttttttggagttatttattcattttggggctacaatgttcattatttttcacccataattggggacgcgacttttgagcttgccctttcgccccgttgaaaaattaaacagttctataaattattcaaatggcaccaattaaaaatttcacctaatcaatgtcataactctctttttatccgcttaaacttgtcaatttttttagggttgatttgctgaaaagtctgatcatatgcgatgctcggcgttgtccactcaccaaggtacaaaaactataaattttgtaccatttaattttaaaaaaaaatacaaaaattcgtttttttccccgtattttaggttggctgtgtgtccggttgtgtcaacgagaagcagttgaacaagctgaagaggccgtccaccagttccatgccatcatccgccaccggcaacaccacttcaacatcgacgagtgcatcgtcaacggcgtcgttgtcgtcaagcagtagttcaacaacattggcagcgtcggccgcagctgctgctgctacggcaccgccaacccaaccagcaaactcctcacaaccaacggctggagcatcaacaacggcaccaaagccggccagctacacgtcggtgatggtggaggattttgagaaccgggcatttgacaaggaacagttccgcttcaacaaactgttggacattcagcacaatgtaaaaatcagtgtcattattttgcatgttattattattttttgctttcctatatgccgggagcagtttaaccttgtgatttttttttcaattttttaggaaattttcaaaaaacttattgttcgaaagtttttataagaaagtttaaagaaaaaagtagaaagaattttcaagcgttttttttaattatcataaattacttaaaaaaatttatccccgtttgaaaaatttttcatgaagttttttttaataaaaaatttccaataataagattttttgaaaaatctagcttaactattaagaaattatgaattggagccaattaagtggcctgaaataatttgaaaattcaatttttgacaatatcttatttgtgtgttcaggacatctatgacgaggtgttggacaagttgcccgaagtgccctcggatgagggcagtccgtccgaccacaatttcatcaatgtcctttcgttggatggcggtggcatccgtgggctggt

SEQ ID NO: 30823 - DNA, 1141 bp, Heterodera glycines
tagggttgcgtccccgacgtcggagttggaaaattcggggttcggggttgtcggggttggaagcgtcggggttcggggtcggggttgccaaatcgttcggggtcggggttcggggtttttcaatttttaccttatgcctaatagtcaaaatttttttaatattttttcggaaataatatttattaatttccataataatatttgtattgtttttatatttttttatttcttttttatcagaaattttgtatagaattaatttttttttcttgaaattttaaaattttttattacttttttgttttacaaaacatcttttttcacggcgctcttttcgaaagacttttagggagaaagggtgcggcgtccggcggtgccgataggcgccagtagataatattcccaatcaaattatcgattgattttcgatcgataatttgatcggtcatttttccctctaccccccccccccccccccccaaaaaaaaaagcccaaacctattggatggtgtcgagagagcaaaatagtgagtgaggtagaggtggaagagagagagagaaagtgagagagtgtgagaaaaagtgagagagataaagagaattgtgaaagatatagaagagagagaagggaaaacaagtgtgagagagagttatagagagagagaagtggaatatagagataatatgaaagaatttgtgaaagatatagaagagagatagagagagaagggaaaacaaatgtgagagagagttatagagaaagagagagaaaagtagaatatagaaataatatgaaaggaattgtgttagagaaacagagaaaaattggtagccgttaaaaataaattaattatgttatttattcccaacaaaaaatatcaatcctatgattgataaattttaaagatttttttacttttcatgtcctttttataccatgttataaattatgtttaattaattaaaattttcagggtattaaccataatttttggaaatctaagcgcataaaaaagcgcaattttgcccaaggcgtttatggcgcaggggcgccgtgtttgctgaggcattggttcatacggtttgctataattatcgttaatttataactacgaagttattgcgattgaaaaataaattt

SEQ ID NO: 30824 - DNA, 1572 bp, Heterodera glycines
  misc_feature (1512)..(1512): n is a, c, g, or t
  misc_feature (1518)..(1518): n is a, c, g, or t
  misc_feature (1522)..(1522): n is a, c, g, or t
  misc_feature (1524)..(1525): n is a, c, g, or t
  misc_feature (1538)..(1539): n is a, c, g, or t
ccgaacaaaaattcaattgggctatattttttatattctctaattttatttattaatttctttgaaatgaaaaataataattgaaaaaaaaattgtttgaaacagaattattataaaaatatatttacatatatctaaacatgaaaatccctcagctacgcatttattcatttcttccaaatgtatttatgattctttgaagaattaaaaaaatgaattcaaatttgtattaatgtactgtataaaaaatagtatttttttgttgcaaaaaataactgtgcgtgaaggtcatttgtgttcgatgaagcaaaaagggaaaaactttccaattcgattcaaataattggtagaaaattataaattaaatgtaattaaaaaaatcaagataatttaaatgtgattttaatagttaatttaattttaataaaattgtattatttaattaattacaatataaataaaattaatgtaattaaaaattaatcaatataatttaaattgaaattttttttgtatgaaaagataaatatgattttaatagtaaatttaattttaataaaattgaaaattttataattgatatttatttcatttctatttattgcgcagtttaaaaaaaactataaacttgaaaagtatacaaattggagactcatttcaatttttgttttttcgtactcaaaccaaatcatgtgtccaaaaatgagacacctgacaccatttttataactaaaattgtttatttttgaatcatatgtatactattagataattataatatcgggacgatacttacaagatttaaaaaaaaaattaaaatttccttctaagcttactaaaattttggttaaatttattttataattattaattaatgaaaaattgaataatttttacaaaatttaattaaagggttttaaaagaggttcaattttctataaataaaaatttattttttcatagaaaatagttcctaaaagtttcaaatttcgggggtgtaaaatgacaaaatttgaagttcctgacacaggtcccgggtaactatttttagtcaatttatttatatgtaattatggcctaataaatattaattgatgacagcttgacaagtggaagcagtaaaaatttgcatatgaaatgacagggagagaaaatgtgataaaaaataaaaatgtaaacataaatggaaatgccatgagaatacttttattgagaagagaaatgaaagaaaaatgcatttccccgcgttttgtcgcggttaatttttatgattcggtagaaatttcgcgagaattttttaaaaacccgcaaagagttggtgtaaatttagattttgttttttaggtttctatttaatttaaatttcatatagttttcatcattttgtcgaatctaaacccaataaattccaaaaaatatcaaagaaatggatatataaaagccattcatgattaatttcataaaaggacataaaaatattataaaaaaatatttaatttttaattaaacaantactanaaanannatttaatgaatannatgaattcattttattttaattcttatttgcct

SEQ ID NO: 30825 - DNA, 2097 bp, Heterodera glycines
  misc_feature (10)..(10): n is a, c, g, or t
  misc_feature (322)..(323): n is a, c, g, or t
  misc_feature (336)..(337): n is a, c, g, or t
  misc_feature (339)..(340): n is a, c, g, or t
  misc_feature (349)..(349): n is a, c, g, or t
  misc_feature (2020)..(2020): n is a, c, g, or t
  misc_feature (2028)..(2028): n is a, c, g, or t
  misc_feature (2049)..(2049): n is a, c, g, or t
ccatcaacgncgggaaaatttttatcgaatgcttttggtcttacaatatggcgatagctttttgaaaggttccaaaaaatttaaaatatttttttttgatttaattttaatttttcgaatttcatttaaagtatttactgaataggtcccacccttgaattagaagtgcactctcaaaggacctacggacagatgactcacaaagacaaaagacacacggacaaaggaccgacaaaattaatcaaataattaataaaaaaaataaataaaatatttaattttgtcactttttgggtgtaaaaaccatttaaaactgtacaannttaaaattttccnngnnttaactctngtcgggtttgagtttggctatatgtagaaaccctgttaatttatgaatagtcattcaaataaacactaatcaaaataagatggtcacgtcgtttaccgaactgaacgaaagtctttttaatttgatcaatttatcaggtataatatgataaaaatttgggtatatatttatatttgtgggaccttctccgggacttttgctttggggccccctgccgggggctttgggtggggggggcccccctgcaggggtcctttgaaggggaatttgtttttgggccccttcccggggctttttgggggggggggccctttcgggggccttttcccgggttttttttttgggcccctcccggaaactttttttgggggggttttttcccgcccaaaaaaaccccccccccgtttttttttaaaaaaaagaaaaaatttccccggggggaaaaaaaaaaaaaaaacaagaaaaggaatttttttttcaaaaaaaaaaaaaaaaagggtttttttttttttttttaataaaaaagggggttaaaaaccgggggccgaaaaaaaataattttttttttttttattttaaaaaaaaaacttttttttttttttttaaaaaaaaatttttttttttttttaaaaaaagtttttaaaaaaaaaaaaaatttttttttttttttttttttccccccccccccccccccctttttttttttttttttttttttttttttttttttttttttttttttttttttttttttttaaaaaaaacaaaaaatatttttttttttttttttaaaaaaaaagagtttttcttctttttgtttttccccccccttttttttttttttttttacccccccttctcaaaagcccccccccccttttttatccaaaaccgggggaaaaaatccccctttccggggttgtttttttgtgggttttgggttttgggcctaaaaaaaaaaaaaaaaacaaaaggggggcccccccccccccaatttttattttttttttttccctttttcccctttccaaattcgccctttccctttagggttttgtttctttttttttttggggaggcaaatttttgcttccccattttgaccattttccttcctttcacccaaacaaattattaatctgttttctttttcaaccatttgcatattcgtaatttggatttgttcatttcttagatctaaattttagtgcataatgcttaatgcacttccgcgtttttttaaatttttttacttatttagttaaaaattttgaattttaaaatgagttatcagcaaagggaacagggaggttatgatcgccgaagaggaggcggtggcggtgattatggcaacagaaggggtaaatttatattattatttttatattatttatttgaaatgtaaacataagatgatcgcaatggaggtggtagctacgggcgaaattctggagggtatggccgagacggaggagggggacagggaagggatggcggaggaggatatggacgggaaggtggaggagggtatggccgtgatggtggaggaggctatggacggggcggtggcggtggttatggccgtgatggtggaggaggtggcggaggatacggacgagacaggggaggcggcggcggtggaggtttttgaagggtggaggtggaggaagntttaatgnaccgagaccttggtagaaganagttacgatgatggcaattcgaggaggtatatgactctagaggtcccc

SEQ ID NO: 30826 - DNA, 1821 bp, Heterodera glycines
aaataaaatatatataatcaacaaagaaaacataatttaatcttaaactcattagcaaaaatttgaaatcttttgagttttattaatttataaataaaccaacgaattccataaaacgatttcatgttctattaaagttcatatgcgcaatttccatcggcacgcgcctccgcagagaaatgctcagaattgaggagaagcaaaatctgatggaacatccaattttgtttgatggacgagtaaatggcaacactccactaatggtacaaaaaaagccattttgaaaatgtttatttttaatttccctctaatcttaaaaggttgcttgtgccaatggttccactgaaattgtcaggtattttcagtttattaattaattccctttctgtttatttttaaaatatttgcttgacaaattcaattaaattcccaatttttcatctacatgaggccaaattggatcagaattggtcagaggaacgtttcattgccaaactggctagtgactcagaccacagatcatatagcccataatggattcataacagtttaccattatccattaattactagacctttgacatgtgcaatcactaaatcgtgtcagaactctatatcttctgtgtgggaccgatttcgaactgaatgtatggagaagtcaagtttttaattttttgcgattttttgaaatttaattattcatacctttaagggtcatatgagatggggtgtgggttcgagcccgcttggctgcgatttatttttttatgctaattgctggaaaatcatagacaaaatgatggattttgcaaatctgacttcagattcgtgatcagcacattttttaccctaaactcattggaaagaaaatacttaaagaagattaaaaattttcaaaaaatctagtacttgatggaaaaatcatagacaaaatcaatgcttttcaaaatctgagttcaggtttgtgatcagcgcactttagccccagaaaaaatgctttttgaaattttagtatttttttccgtcgggaccacaatttcacaccattgccaaatttgcaaatagtggcggcagagaattattaaataaacatatgtatacaagaaaaacatgtaattcaaagaaatcatttaaaataccacaaatattaaggaaacaaaataaactaaaacttttttcctattaataattcaaaggatcaatcacttctcaacaatacatttgcgctgatgatcactttggtcggaagtgccatcgattagactaaaacgaaagaatggaaatttataaatcataattaattgtgttaatttactgactcgtctccgattccttcctcattaattgcaatgtgaattgtgttcaaatggtccctaaacttcaactcaatcgcttccttctcccaatttatccatttttctcatctcgggaaattggacaacgaatcagcaaaaaagcaccatcgttattggcacttttcaacgtcaattgctccccagtcaattcattgaccaaatcgaacggcacaacggagtcactcaaacgaaaaatgacaatgatgaaattgacacgagatgaagcactggaaaatgcctaaaaggagaaaaaacattttgaattataaaagaattaattgtgatcacttttttcagtccttcgatttttgatgacctttcctcctcatcaagatcgatacagcacttgagaacttttggcacaccgtccaaacgaggcaagaaagcggggaaaaataattttaaatggaaccccccccttttttttaaaaaattttttttcaaacttttaaaaaaatcataaaaa

SEQ ID NO: 30827 - DNA, 1286 bp, Heterodera glycines
agttacatcgatcactccgtcatcgcttttcttcccttaatcaccaaattcactaaaaaacctcatttttacgggtataaaatgacaaaattttagtcaaaaagcaacaaattaagcaaaatcagtattgagtctacacaatttctaatatctttaattttggaggatgaatttttcatttcttagctgagtcgctctcagttggaatatgtcgaaaaaaagttgccgaaattttggatttttttttcgaggatttccaaaaattcccgtaaaaatcctcaatattgtaaaaaatgaaaatatcaagaaaaaagtccaaaaaatgtaccaaatatgtaagaaaatcccgaaatcttttgttttttataagatgttttcttgtcctgtaagcttgttatggatcgccgctgatcacgattcgcgttcggattagggattcgggattggtcaaaatgaatgtcatattcgtgataagcgatccttaaaatcccggagaatttcattattttttattcagtatattaattttagtcaaaacaaaaaaaataaaataattacattaaattaaaatgcatttaataatatcgctttgacaaattgccgcttgtggtaaatgaataggaagaaagaaagaagaggatgctttttggcaagaaaagaaaaaataataaaataacacatttgatgtgaatttaagaatgaaaatgcataaataaataaaaaataagaaaaaacagcgtaaggcaacgaatgaagcgcaaaaagagaattaaaaagtgggaaaaaagaacagaattaaatattcaactgtacatccgcatcaaataatcagacagcaaagagaaaatcagtggaaaaacgacaattaataattaatgaatgaatgattggccttttttacacaaaattgggcaagagattttgcaatgccattgaaaaataataaatttacaaaaaatgaaataaaaaacaactgcattcaattaagtgaagtgattgtccctgtcgtacaatgtttgttttgcaaatgccctgctgctttctgtcgcccgttcttctgccccccttttctgcttcccatttgtctcattaattaattaattagtgcacgtaaaagttcagcgcccctccggcgccgctttcttcgccattgtccgcttccgccgcttcgtcccccgcggcgccttttcccagcatttcctccggcagttggggcagcttcagctgctccgcctgggctttaaagggcaaactctccacgcgatttagaggctagattggctgaa

SEQ ID NO: 30828 - DNA, 639 bp, Heterodera glycines
ctgagttgaaaagggacttgtacgagcggatggtcatggtaacgctaaaaggatggttgtattctgtggaacatcaaaaacggttaaaactaataaaatttaaaccataaaataatattctttttagcggaatgccacatgtccacatctgcctaattctggactgggaggcaatgcgcgtcggaggaaagactcgaacaccagaggactacatcgacgagtacatctgtgctgagattccaccaaaacctgatgaaagttcaagggacgagcatcaacaacggaatctttacacaaccgtgacaacaaaaaacatccacacttgtgctcaaaatcgttgcctggtagatggaaaatgcatcaaacattttcctgtaaatttctttattgaaaaacaaataaaaaaaagcaattaaaatatagaagccgtatgagtatgacaatgtctactcggagaatgcttatccgcgctatcgtcgacgtcctcctcctccaagtgccgaagaagctcaacaaaatccagagcaatttggccgagtgttcgagtataaagaccgctatggaaaactgattaagaaggacaatgcacatgtcgtcgcattcaacccatttttgtccgccaaatacaaatctcagtat

SEQ ID NO: 30829 - DNA, 1362 bp, Heterodera glycines
tttgtttttcaaagcgtaaaaatgcctaattatttccgagaaatttcggcatttaatgggcacggcacatgcttatacaaaatgttattatgtataccataaaagaaatgtttcccattttttgatattccttaatttattttttcctattttcacaccgttttttatgcggacaaatgccgcgatcacacactttgcttgatcaatcaatgcttgattattattattcattcattttgtgaaggcaacaatgaggtgtcagctgaacaagcaattgggcgccccaattttgaagacttttttcactcaattttcttaaggactctaactgtccttgaaattaaggacaacataaaaacaaaaatttttttatacaaaaagccacccaattctttggcgcgtgcccaattagcctcaattctggcaaaaacgtgcaccccctcactcgctatgtaacattttttaaaatgccaaatttactaattgattgacatttgtaacagaaaaaattttatcttcctctgatcaccactgatcaattgtggccaaatgtatggatggtattattcagaaaaatcatctgttgttgttgtttttggccaaaagtcgcttgtcatcatcgtttattgatatgttgagcataaaatgggagtttgttcacactttggcttgacatttattggaccggcaaattatttggttgtcttaagccgggaggttaggcggttttttaattgtaccaaattcgtgcaaaaatttcattaaaatttacgaattttcccggccaagccttctctgttatgaatttgggctgacaaatgcccaaaatccgttttttcgacctgattgatacccgggttataatttcttatcaaaacgttcagccattttttcgtttacgacaaattccaacgaaaaatataagtttaaattagaaaaatggtagctgttttttttttgataaatttaattaaaccattcaaaacactaatcacttctgacagcacacatttttgcccaacaaaaaaatgtgaccaaccgaccgactaatcattggattttgacagtaaatgcaatggaaccaattttgttgttgtttttatttatcaatttttactatttatttttaaataaaataatgttattttgtcaacacattgttataaaaaacccaaaaattccaaatttagtcgggcaaacaattgatattttcatatttaactcaattaaggaattgataatacggaatcgctaatattccttactaaataatttctgtgtgataagaaagaaaaatacaaaaataactaaaattcttttttaatttgaaaaaaaatatttttttttgatttaatttatgcc

SEQ ID NO: 30830 - DNA, 1664 bp, Heterodera glycines
tgtatgaacctgtaagcctttttctcaatatctatcaagccaaataaattttggacttctttgtatatggttaattgtttagattaatacacatcatttttcaagcgcagttttttttgctgttatagtgttttcagcaccttagaaaatctatgaacctaaaatatgcaaaaaaatgtgaaaaaggtataagaatgcaaaaaacagcaaaaaggcaaaaaaatatgaaaaaaagtagtaaaaattataattttagaacaatttttttaaatttaacgaaaactctcacttttgcgtgacaacttagaaataatttttgtttctcatttgagttttattatttattacttatagatttgaaattttacaaatttattgtatttaattttttatttacctaaatctgtttatacatatattactaatgatgatttaattattttagtttattacttatttgtaaatatgtgcataattaacattaattattttctcatttatctcctttctctgttaaaactcatgtcgtcatgtttgttcatttttttacattttcgaaatttaattcttataaacattgtgtttaaaaatagaattttgaacttgtaaaaatattatatttaataaaaatgttcatttaattccaaaatgtcaccaacccaaaacgtcaccaaatttagaccaatgattaaatttaagcaaaaaggatcagtcccagattaatcattaactaacattattttaaatcgaaaaaattattataatataaaattgacagtaatttattcaaaataaaactttacctttgaccagggatccctcgcgccagaagtcttaaaccgaaaatattatgccaaatattaaaaaaatattctgtttccggacaagaacctagtgattttcaattacaaaattccgttgggcttttccctggtgtttttttatagattttatttaaaaagttgtaattacgcgtggcttttgtacatacatagtcttaccaaatttcgtcttttatgtgtattgaatatggtctgtgcatgtgattaatacgtttgcgtggattttttttgaattgatttggctaatgatatttgcgccagaaatgtctgtgctatttttctaccttgaataaaattctcattttcgattaagcttgatttggtcgacagccttggcttggaccaaaaggccaccgaagagacgtttcgattcatttctgagcttgtcagacaacagcagcaacagaagccgcaacagcagcaaaataacagcaataatattccaacttcgcaacaaatgtcgtctacaatgccggaattggagccagcaattgagttgaaaagggatgaaccggcaacaacgcccatggaaagggtgggcagccccaaaactttatatgatagactgatcactgatttatggagttttagctgatccaaccaccaattggcattaacaagaggaatgaattggcttcacagtttggcaacaggaacgatgacggaatgacgacgccgcccgcttttttcaatgccatttccgatgagagcagcaaaaaaggcggagcgaagcgcaagaacaaattcgctgagcttcccccgactccgccgccttctcaactgtccaatttctccgctcaaaatgcttcctcttctctgtcg

SEQ ID NO: 30831 - DNA, 765 bp, Heterodera glycines
cccaaaataaattaaagaaaaggaatgaatttaatttcaaacggaaaagcaaattaaatttttaaaaagtaataaactaaaattgaaaaaggaataaatcaaatttatatttcaaatttttaaatgattgataattagggacaaatttgataaaaaaatgaaatgccaactcactggccaaaaggcaaaaaaaaaaaaaaaacgcgggaaaaatgaattgctatcgcttgtaaattcgggtggaaattttgcacaattggaacgatgaaaaattgggggggggggaggggagggacacagagaacacaggtggccaaagaagcgggaaaatgagatgaggaggaggcggaaaaagatgatggccaagtggggggtggggggagacaggcacaagatgggacgaaaaagagtgggaaaaagggggagagagggagggaaggaggggaggcggaaaacagaatgccaagaaaacgaaaacaaaaaaaaagaatgcgcatcgagcgaatttgtttgatggaaggttatacccaggaaaagctaaataaaaagagaattaaatttagaaatatttaagaattcgtcctaacaaattttattttttctaaaatttatatgtcattaaaaagtataattgtcagttaatgcaaagaaatggtaatatttttaaaactaaaaaatgaaataaaaattattgttacaattattttattaatgacatttaaataaaatttaatttgttagttaatggaaagagatgatgatgat

SEQ ID NO: 30832 - DNA, 1532 bp, Heterodera glycines
attctttaagttctttttgttcagatttgtgttcttctttaggcgttttttgtccttctccaatcccttcagattttgtttttccttttcaacgtttgcttaatttttcaaaatttttatgatttatccatcaaaatacaaaaataaataccctttttgtcctccgacttcaaatactccaattcgtaacgtagtcgttccaactcgtgattaaattggttgagacgttgctcatgctcttcatgaattcgcatctctcgctgttcatactcactttaaattcacaactaaaaaataaaatttccattttaaactaccgaatgtgtttgatgcctatttttgcacagaattctgtaaagatttcgtcggcaattgcattcttgttttgttccaagcgttcgatttcgattttacgctcctcaatttcaattcgacggctttcaattcgcgtctaaatttttaatgttaaatatttataataaatgaatgtttattgatgctgcttttcccttaaattgtaaaatttggctttaattacttcgattgtctccggctccgcactttcgacctccgcgtcctgctccaaccggcgcagcgtttcattttcgctcttcttcaattcttgctgtgtgaagcgtagacgtgcctccagtgaagtgatctgttcccgtttcatctcaacatccaactcccttttcccggttcggtgcagtttttgcaattcttcctgcaacgccgttcgacggtctttcaactttctgattgcattttcatcccattttttcgcttttgcctttaagtcggcacctccgccgcttataacaccatttggctaaaatacaaaataaaagaaattttgaaaaagtcagcacctgaaattgagtcccgtccaaagcaactgctcgaaatcgttctgaacgaccatcggttccgtaagcaagctgacgagcgtggtctggcgtttcacagacaagtgaatttccgcaaacaaactaaagccaaatcacaacattaatctttcattaagatatttcattatgtaatattgttggattaaaagaatgaaactcacttgcaatgcctttcgcacgtgttgcgcgttgccaaggacattaatgacgtcaaacaccaatttgacacccggggggtcgcgaatgtcgcgcaaatgctctttgatctgttccatgcgaagctcagaaagcggaaggaatgtctcgggcggatagtgctgttcgcgcagataagcaatgcattctctgcccgtctccgcattatcacacacaattgaaatcatatgtttgccaagaacctttgcaaagagaaaaaacccaaaacattaaaccgaaagaaaaagcaaataaaaacaccgcctaccttagtcaccgctacttggtaacgtttttgcgacggttgacacaaatcgacgattcttccgtacactttttcgggaaacactctcttcaggttctccactgcttcgtgttggcgctggttgcgctccgtgtcgaaatagtcgcccatgagcgtccgat

SEQ ID NO: 30833 - DNA, 872 bp, Heterodera glycines
tctcgcgcaaattccgacattttttcaatttccaacgcaagtgtccctcttttgttgccctttgccttgttccaatcagaaattcgtccatggcttgggaatttcaacgagtacagcccgggaactccacgaaaaaacagatacggatgtgaagtgaactgataaaggccaagcacttcttccattgttaatacaccggatggaactataaaaatttcaaaaaattcaaaatcatttattttaaatattttctgattttttaaatatgaataatttcaaaaatttaatttttatactgactcaaagaataattcaataaaaatttccgattttaaaatttaccgacgaatagtgaaaaattctcctcaagtatatttggaaaacgaattttgaacagtgccggaccaagcgcggcacgacgattttttgaggaacattcaatgccattctgacgacatttttcatcagcccaacagagtgcctaagtagaaaaaaaaataacgaaaattaaaaaatgctaaataaaaaataaaaaaatgcaaaattaaaaattactgctttccaaatttcaaattcatcgctgagtaacaaatgatcactatcgagaagattgcacaacattttctggtcaatttgcaaaaagtgctctaatccaaataattgggccgcattttgccaaatgaaacgcaaacatttgatggcaaaatcctttaaaatttattaattttttcaaaaaaaaaatgatacaaaataggggttaagcctaagcctattaagataaatttgtcttctcacctccaattcgaaaaggagagcctgggcatatgcaaagaaaacattgcgcaattcggggatggaaatttgcaaagatg

SEQ ID NO: 30834 - DNA, 1069 bp, Heterodera glycines
  misc_feature (955)..(955): n is a, c, g, or t
  misc_feature (1049)..(1049): n is a, c, g, or t
ttgtagggctcaaccgtatatagtaatgcgttttcgggggaaaacctcatgtggaaggctgtaggaaaaagagatagccatttttctgagaatatctattcttagttatggagccattttccaaccgaccatttgtagggctcaaccgtatatagtaatgcgttttcggggaaaacctcatgttgaaggctgtagaaaaaagagatagccatttttctgagaatatctattcttagttatggagccattttccaaccgaccatttgtagggctcaaccgtatatagtaatgcgttttcggggaaaacctcatgttgaaggctgtagaaaaaagagatagccatttttctgagaatatctattcttagttatggagccattttccaaccgaccatttgtagggctcaaccgtatatagtaatgcgttttcggggaaaacctcatgttgaaggctgtaggaaaaagagatagccatttttctgagaatatctattcttagttatggagccattttccaaccgaccatttgtagggctcaaccgtatatagtaatgcgttttcggggaaaacctcatgttgaaggtgtaggaaaaagagatagccatttttctgagaatatctattcttagttatggagccattttccaaccgaccatttgtagggctcaaccgtatatagtaatgcgttttcggggaaaacctcatgttgaaggttgtagaaaaaagagatagccatttttctgagaatatctattcttagttatggagccattttccaaccgaccatttgtagggctcaaccgtatatagtaatgcgttttcggggaaaacctcatgttgaaggctgtaggaaaaagagatagccatttttctgagaatatctattcttagttatggagccattttccaaccgaccatttgtagggctcaaccgtatatagtaatgcgttttcggngaaaacctcatgttgaaggctgtaggaaaaagagatagccatttttctgagaatatctattcttagttatggagccattttccaaccgaccatntgtagggctcaccgtatata

SEQ ID NO: 30835 - DNA, 1285 bp, Heterodera glycines
ttcttcgattgttttttgatgctttttcttgactgtttttgtattatctttgtgctaattttgtttgttttttggctcattaattcattcattttttgctctcttaaaattattattttttaataataataatttttcttcattttttacctcgcttccttttctttcaaaatggcattttgcagttgttcccaagtgtccaattgttggtttttcagcttttcgtgcatcagtttaatgcaattatccttataaagattcactagtggaaagaataacttctgcattatctaaaaaagaattaaatttcacaataagtgattgtaataggtgagaaaagtactcaaagtcaaaaattatctaaatttgctaatttataaaaatgaacaaagatttttctggtaaaattctgttagtttagaaagtggcattgaaattgaaattagatgcaaaaatttataaattatattattaaaaaaatgttaattataataaatcattttttcaaaataatgattttattggaaaaaatttttcgtttttctaaaacaaattttttagtgccaataaattgtataaaatgatcaataagatagtgggtttagccaatttattgatttttagctactcatttattagctaagcaacgaatatacacatgaaaattgattttcattatttttccatctactaaacagtttttaaagcaataaaaattaaaaatgtaaccctaagaaacgctttttttattttttaagaaaaagcagcatctgatagagcatgaaaagagctatagaaaaaagtaaattaaagagaatttattttatccttcagctagaaaacttaatattccaaattttgcctctttgaattaagacttttttggagcacttactatgtatatatttttgtttaccctttctttgtgagggttcggcctcaatattttctgctcggtgccatattcaatatcatcatccatgccattgtctataaataattttttaagatatttaattgtcatccgctaagtgctcaccgttgtcagtctcttccgtcagaaaagtttggcatttttgtccatcttttgccaaagtaagtattggaacttgaacaccttcaaacgattcgcttcctttttccaaatttgtctccaattgtttcttcgaatggtttttgatgctttttctcgtcaatttattcactatctttgtgctacttttgtttctttgtggctcattaattcttccattttttgctctcttaaaattattatttttatttt

SEQ ID NO: 30836 - DNA, 1002 bp, Heterodera glycines
cagacttttggaaaatatatttgcaatttatcctcctttttgagaagtgagttagaaatgataaacttcacgattcaaaccagttttcggtgctctaattaaccgcgataaaaacattcgaatcaattaaatagcttctgagataataaggtttatcataaaatttcaattaaaaataaaccctcaattattggtatgaacgatactttccaaacatgcacacgttttgcgctcgagctatttatcatcgggcttgtcaatccaaagcgaaacaaaaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaaaaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaatttttggtgctctaattaaccgcgataaaacattcgaatcattaaatagcttctgagataataaggtttatcataaaatttcttttaaaaataaaccct

SEQ ID NO: 30837 - DNA, 972 bp, Heterodera glycines
gaccgaccaatcaatcagtcgttgtatgtttgatcaccaccatctcttgtaattattggcttgtacacacaatacaaacaacaaataaataacttggtaatgctgtttaagtaatactcataccgtatttatgcccattttttaatcattgggttaattgcccccccccctcactccatatcggtcatttatcctaattagtctgcgtttcataagcttcattaatttatattttgaatattctttttattgcgctgaacagtactttcccatttcgtgcaaacatccaaagattaaacaacaaatggcaaaaatattcgaagattgtccaatattaattattgctttatgcccccaaatttgctcgttacagttcttttatcaaccgcccgcctttttttaaatatttttttcaatttgatagatttaactttttaattatgtcaatttgctctgttttgtactgttaatggcattttgcttaaaatttctcttgttgctggtgtcacgcacatttaatggccaatgcttcacaattataccttcaaaaaatattttaattgctcttgaaattttattgaaaaatggctgaagggcattcaaatttggaacaaattgtgcatcaattataaaattgcctccgcttatattttcacatatcaaaaacggaaaaaatgagaagcgacaaacgccgatgggtaagccttagaattttttggaatactaaaaaattaattaatttaaggctttgtcattggctcatttcctgctatttctaatcttgcaaaatattctgataatagcaagccgaggcgatgagaaccaaaatgccaaaatggggggacaaagcggacatcagaatatgatcattatgccgccagatgtttctccggtgccaattttggccacaatttctgctctcccacatgatgctgcttctttctccatgccgattaccctcaaatcggccca

SEQ ID NO: 30838 - DNA, 1589 bp, Heterodera glycines
ctagaaaaaattgaaaattttgaaatcatgtttcccccttccttctcccaggggtattattttgtaaagtctttttttcttaataaacttttcaaaccccatttttcgcaccgtgaatgttatttttattgaattctgaaccggttaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgcccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattccccgaaggattcggtctccccataaatctgggcgcatcggttcgggggggactgccccgaaaacaaaaaaaacgatttttttcaagtgtccgtttgggggactcaaacaaattatggggagcaaaaaatccaacgcaaaaattaaagtacaggctatagggaagctactcccgaaggattcggtctccccataaatctgggcgcatcggttcggggggactgccccgaaaacaaaaaaatctattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatatgggcgcatcggttcggggggactgccccgaaaacaaaaaaatctattttt

SEQ ID NO: 30839 - DNA, 805 bp, Heterodera glycines
aaaaacaatcccttgctgataggccgggtggtcaaaatttaagcccccaatcccggacaaattggcccacctttttttgctgctgttgttctgcgatcagcgcctgttgctgctgaaagggtccattcgcttgtcctctcatgccaaggtgtcgactatttggcgtcacaattaaacagacggaaagcaaaaggacagccaggcaagtgcctgtctgggcattgcgctttgacgattgtccaatggaagcctttgaaaagaaaggacaaacgaatgttttgctaattagtgttaatgagttaggtaatttacactgaatcgcccccgcccactaaaccatgggtaagtgtggctaattgcaagtccttgtccagcacctgcatgttgcgcagttgtgccgcaagctgtctgttttccgccgccatcacttcgatttgctttttcaattctctgttttcgctgtcgctcatgaaaatgcgttcctgcagggcctcaatgtaatcctaaaaacatcaaaacaattcaactgattcccttcttcagatttcgcctgtttttttcttctgctcgtctgtgccgacattttatttcggattttgcgccgaattcgcttcaattcgcgctcttcggattttgtcaatgggtaaaaatccggcaaagttacgccctcctaaaatgggtgcattattagaagttaaacgaattggtcagattcttttcataaaaaactcacaagcgaacattccgagctgtaactcggaaaaagggtatgtattatataccattcgatagagccgggtcgact

SEQ ID NO: 30840 - DNA, 1368 bp, Heterodera glycines
aaaaatattgccaattgaaaaaattgtacaaaaagttacttcttttttgttgttcaaatctctttcccaggcggggtttaacaaaatttgataaggaaaaatgatggcacttgaaaagaaaaaaaagaataataaaatggatatttacggaaaagcaaaaaatgaccaaaaaaacacagccctaagaatgaaaaaatttcttaaaatacactataataaaattgaaaaaaattttattagaaattcatcccctaaaaatctttttttcttgaccaagatttggttaacttaaaacatccatattacaaaaatttttaaatatttgaattaatttcgtttattttgcgttttttgatatccccccgtaatagagccaccctccccctcgaagggaagtcctcggggctctgtctgttttactaaatttaaatcgttttatgagagttccattgaaataaactttaaaaatttggttagtgctaacgccatccctttttttcccaaaatttctcaaaaaatacttggttaatgccaatgccatccatcactttctttttcccaaatttcaccgggactcatttgagcatcagtaaaatgattcccacgaggagtggggggggctatgtttgttgagattgagggtcaaataaataataataaaacgcatccaagcagtcagaggtcacattttcagcacagaacacagcaaagcacgaccaccaccactcaaccggagagcaaagaacgcggaggcgaagggataactgaccgcccgggaatggccaagtgagttccgccaactacgtcccagtttagtttaagaagccgtaacttcttttttcaatgagttggattttttataagtttggcactattaaatgctctattagatcaggagataacgactggaattaaaattgccttcaatttaaaaaaaaaatacaaaaattttttttataatttcctatctttggtctcatttttaattgaaaaagtcagcaaaagcgcaaacaacaaaatttaattcactaaaataaaaaaatgaaatatttttattatcccaaaaaatactgtttaaaaatgtattaatctcgcggctttttgttgtttttttaaatttgaaaatgaggccaaaaaacaggaaattaccaatttttgtaagtttttcaattaatttcatcgccggacaatacctaaacatttgaatattaatactaatttatttttcgagcggttccaaaaacatataaaatttgataaattaataaaactgattgtttcttaaacttggctgggcctctgttggcgggactgagttcggcggccaccgcttgggcgccggtggtgaacagactagggttcgagccc

SEQ ID NO: 30841 - DNA, 1001 bp, Heterodera glycines
attttttctgttaaaaatagttccataagaacccacccataaaaaggggcttttgcgcaacaatctcccctctggtgtccttcattttagaaaggcactgaaccgtatacaaaaactctcacattctaaaataactcagttaaaacagcttttaattttaattgttctgaagccaataattttgtctgtaaaaaatagtcccatatgaaccaagacataaaaagtgcctttgcgcaacaatctcccctctggtgtccttcattttagaaaggccctgaaccgtatacaaaaactctcacattctaaaataactcagttaaaacagcttttaattttaattgttctgaaaccaataattttgtctgtaaaaaatagtcccatatgaaccaacacataaaaagtgcctttgcgcaacaatctcccctctggtgtccttcattttagaaaggccctgaaccgtatacaaaaactctcacattctaaaataactcagttaaaacagcttttaattttaattgttctgaaaccaataattttatctgtataaaatagtcccatatgaaccaagacataaaaagtgcctttgcgcaacaatctcccctctggtgtccttcattttagaaaggcactgaaccgtatacaaaaactctcacattctaaaataactcagttaaaacagcttttaattttaattgttctgaaaccaataattttgtctgtaaaaaatagtcccatatgaaccaacacataaaaagtgcctttgcgcaacaatctcccctctggtgtccttcattttagaaaggccctgaaccgtatacaaaaactctcacattctaaaataactcagttaaaacagcttttaattttaattgttctgaaaccaataattttatctgtataaaatagtcccatatgaaccaagacataaaaagtgcttttgcgcaacatctcccctctggtgtcctcattttaggaggcactgaaccgtatacaaaaactct

SEQ ID NO: 30842 - DNA, 1240 bp, Heterodera glycines
  misc_feature (50)..(50): n is a, c, g, or t
cgatgtggtgcagccgacagaacgccagcccatcgaaaattaaaagtttnaacttgacgaaaaaagtgccacatattttaaaggtttattttatgcaaaaacggaaaaatcccaaatattttcaaaagaataaaaaatatatattattcaatatttataaatccattcacattttttaatacaaaaaaaaaatcattaaaattcattaaagaaagaatttttgtgcaaattaaaaaagttgcaggtcttaaatttcgtttctataattttgaacaaatatttaggccatttttagtaaaaaaaaaaaaaaaatcaaaaaattattttttttcttaaaattattctgtagataaaatttaatttgataaagaaatcacttacgggcaaatgaattaaattaaatatttttaaatatattacccaaaatcttctggcgatttgagtaaagttgccgggaacaacaaaatgccaattgcaatgatcaacagacaaaaactgatgttcacaccggtgaacactttgacaaattgttggatattttttgaggataaaagcaggaaaacgacagcaatgctgaactgattgagcagcacaaaaaagttggcaattcgtctaaaataaaaaaatattaatagataaataatataaacaaataaaattaaattttgaacaaaattattaaaggaaaaaaaaattcatcaaaaatgctatttatagttattaaataatagctgaaattacctattaatataatcactcaagaaaaaaaaaacatattaaattttataaaatttatcaattattatttgttttaacttttaattaaacaataaaaaatttaaaaaaatgataatattattttattttccctcttattaattcaatatttttatttttgataccaaaaacatattatttttcttattgttattatttgttctattcaattggaatggttgtccattctattgaaaaagggtgtgtgtaagagtatataaacgaaacaattttggacaaaaatattatttcaataaaaaggattattatttaaattttttcaattattgtacaaaaaaattttttttagaaaaaatgctttttatattggttcttctattaattgaaaaattgttattagcaaatggagctcctctttcgacaaaaaatgatggcatcgaagcaaaacaaaataaattcaaagaaatgacaggtatattttaataatatagaaatttaatga

SEQ ID NO: 30843 - DNA, 2010 bp, Heterodera glycines
  misc_feature (23)..(23): n is a, c, g, or t
  misc_feature (1818)..(1818): n is a, c, g, or t
  misc_feature (1852)..(1852): n is a, c, g, or t
ttatgttcataatcactttaatncatctgatgcacaaccgttcaccgtttgaaccgttttgcacagttccaggcaatttttaaacattttatttaaattaattaattattatttttaggtcgtatgagtttgttgagcagcacaacaaagtacaaagtgagcattggtgagattcaacgtcgtatcaacccgcctgaatgtttgaatgcatcattaattggcggtattttgagaaagtcagtaattttgggggtgacaaattttgtgaatataataccaccttctaaatttagtgtaagacaaatttagtaaataattgtatttttagagaaaatttaattaattttgtaaaaatttattaaaaatttttatattatcaagaaatgaaaatatttttgtgctaaataataaaatcccacatcataaaaaagaaaattatagaatgtgagtaaatattttggaatttcgttttactcaaataaaagcccccccccacccctcaattagaagctccccccctatatgccaaccttcgaggggggttgaaaaatagaaaatactctgaggcttagtttcagtaaattttgttgttcatctttttttttttggtttaatgagataaaacctttaaaaaaaactaaataattgatcattattttattcattttaattaattgccattaaattttttccctaaaattagggctaaatccaaggacggcggcaaagcattgagggaatcgttgaagcgaattggcctttcattgccggccggacgccgaaagtcggcttgtgtaaccgcattcactgcattagttgaggaagaagccctccatatggtcggcattaattaaaatttgtgccattaaaaaacaagcatttttaattttcaaatttatttgtccaaatcaattttaaaaaatgccaaattttatatgatttattaaaatgacaataaaatttttaatttaagcttttttaattttatagacattaaaaggagaatatttttttacgccatttaaattaatttctttagcagtttattaatttcaattattttttaaataattttattattttatttaaaatttgaatttactaatttttgattacatagtatttttgacactttaaatttttaacatttaaggccaatgattttaatgctgttctccaacacgatttcccggccaaggacatcggttttttcctcaatgcgcaattcctcagatatgttggccaatcgccgatggattccgaattggtggccagacgtcgtacaattttaaattgttcaaggtttttattgcaaaatccgaaccttatgattagtggatttagctgtccttggctttcataaatacatacatctcccgtatttaaaaaggctaatttgtaaggaatattatcagaggttttgaaattgagtttttattatttgtactaatttcttcatctcttattaatgcgttacccatattttcgtaaaaaaaataaataaagaaattacaaaaattgcattttttaggatttttatcaaggagatcaccagccttttggctgcggaccgaagcccaatttgcgatcgtcgacctgaattgatgttggacccgagcatacaaaagcaactcacgcatttttcaatggcaatttttatgggttttttgtaaaatttttgaatcaaaatcttattaaatgctttaaattttttaaaatcccatcgataagctctgcgttttctgccgctaccgtttcccaaaaaattaaaaaatacataaattttttaaacaaaataattgttctaacttttattanaatgcgattatttattttagattactcatggctntggaggaattgcaatggtatttttcattatatgtttttttttgaatataattaataaatcttataaatatttatttataaaaataaaaattttttgcagatttcattgttggaagcatttggccacctgcttggatgaatcattaataaatttggaaa

SEQ ID NO: 30844 - DNA, 1853 bp, Heterodera glycines
  misc_feature (34)..(34): n is a, c, g, or t
  misc_feature (99)..(99): n is a, c, g, or t
atgttttgcatttttttctccttattttgatacntaaaagtaaggatcatttccctttatccttcgtttcaatgcctctacattttgccgtgattactnttcgagtttcttgacgttaaattccattatgtttattcgttttgttttctctccgtgttaaaattgatcacatctgatcaaaatcctctttctcgtcttattaacaccgatttatttctgcaagttttcgataattttttattcgttttgcggcgcatttattttgacttcgaatttcaccgctttgtaagacaatttcccccgcgccgtttctctcgtctctttctctctttgatcgaatgcttactcttgcatttctgcttattattcccttaattgggtttccgaccatttcaaatacccccaaatctccaaaattacaattcgattggatttcccctgccacactccaaaatcaaaattttgcttttcctcctccccatggcaaaaccacgtaattagagagtgatttcccaggtatttggtgagaggggacagaagaaagtcattcattcattggcaagaaaatgggtaaaaagcttctgcaaaagcaaatgccgataaaaatattaataaagcatgtgatttattggtgattcttattaatgactcaaagtctttttatgattaagcaactgttattttaatttgatttgaagcttcaaagatgcgtttttatttaaatttcggcattttcaaaagaaaattcgaaaaataaactaattaagaccaaaaattttcaggaaatgaatttttaaagagcgaaaaattttgaaaaaagtcgaaaattgtcaaaactttttcatgttgaaaatttcctatttttttgctcaatttaagaatttaagaaataaaatgatattgaatattgaatttttcataaattttttgtttttcgtgaattaatgttttttcccttttattctcaaaattaaaattagaagttgattcttgtccatattttaacttttttttgtccttttacgcatttcccctttttttgcaattgaattttaaaatttttcgttgatttagccataagcaaaaacaattcgaaatgaaatgttttattttctttctttttgctgcttttttattgttgaaaagctgtgaaaatatgcgatttggcgacgtcgaagcggcgaatccctttttatcaaaagaaaaagcaaaaggaaaagcggaagaaggagcaattgtaagcagcaaaagcaaaggcaaaggctcatactttaattaattaaaattgaattaaaaacgaataagccgatcaataatataaattatctattatttggatgggtttattttgtttatcattataattaaggaaatgccagcgcttcaattgtaaaaaactcaaaaaatggcatggaaaacccaaaaactccggcgaaaaataaggaggaaaagcatctgaaaattcacccattacaatttgttgacgcaatgatcggaaattgaatcaaacaaagtcaacagcagaagattattttagaatttttctgtttttggtgattttcggcttttttgtgttagcatttcgtagcgaatgacactttttgcataaagtttctttctttttaaaattgcaatacggattttgtttaaaatatatgtaaaaaaaaataaatcagttaaaattttagcaatgaatatttaaattttcccaaatttattttatttttaaaaatattttcttttgctgggatacgacgacaccgaagcgacatctgttcccaaaaatataagcatttgttttgggattaattaaggccgatggattgacactaatgcaattaattgtttttgtc

SEQ ID NO: 30845 - DNA, 828 bp, Heterodera glycines
acctaaaaatcccagccctggtgattatggcgttgaacagatatgactcaaaaatgaataaaacaatttaaaaaaataaaggaattgcagaaaaattttttggcatattgtcaaaaacaaatgaaatagtacaattttagacagcagtccgtccattcattcattgtgacaaaatgattatgaaattatcagcaaattccacccaagaaatcacctattatattcgagaatttagaggaagaaaaaaaaacgaaaatttaccaaaataggcacccctatcagtctcatctcatcaaacacagccaaaggaaaggccgggcagaagccgataaaggcgaagaaagaaggaccgaccgaccgacggccgcccattaaatttcctttctaaaaggaaatgcgtatgttttggggactgactgtgtgcgggccccgacttttggtatcaaaaaatgttgagtaactgtataattggtagtggttaaaaattgtatgtaacggtgatggggccgactcaatgccggtatttttggggagggaaagaccgattaaaaatgcccggcattttttaagggtaggtcggcatttcgagttataattcctagatttatttgtggttggcggtgtcatagcaatttctgaatcccggcattttggggggtcggggaaaggcttgctccgattcctgaccccggcatttttggggccgaaaggtcagttagattttttgaggggcacgaggtggcattacaaattattgcggtacgcaaatttccgaatcccggcattttggggggggtcggggaaaaggcttgctccgattcctgaccc

SEQ ID NO: 30846 - DNA, 830 bp, Heterodera glycines
ctattttatctttagaaattgaataaaataaaaaaggccgttatttggaatgacagattactttttatttaattattaattttttaggttggcatttcaaccaacggttggaccttggttctttccgtttctcatttctcctattatttgtcacttccgactcagtttggaaaactgctgatcaacagctggctaatggttcaattctttttagtgtttgggttatgtgttcaattcatttatcgttttttggtgctgaacaggtaaaagcgcataagtctttcttttgacctacgggagccatttaccattaattaatgtcattgcgtttttttatatttgctaagattcatctttatattaatataaatatttaatttttctcttaaatgagattttttaataattttatgatgcttaattattttatttaggggcttaaaaataacaatgaaaaaatatgttgcaatgctttcatttgcattttccatcgctattttgacttggacatatgattttattgtttcaaatgaccatataaatctttccttgcttaaagccgaagaaatatttcaaattgaacaacttttgggtggcaatctcaacgactttgtgacatattgtcaacgaaatgtgagctgattcaaaaatttaaatattttaggttttacttaattttaggattattttcccgtgaaaatttcaatgtgggcttcttttgtcgaaaatatcatttgttatacgataattatcattgtggatataaaatggccagatttgttcatcaaaatttggacaaaaattcgacacgaaggcaacaaattaaccga

SEQ ID NO: 30847 - DNA, 1946 bp, Heterodera glycines
tcccgaaaaagcgataaattgaccagttttgtaagaaatttttcaaatctaactgggagctacagactttttttaatactgattttaattccttttattcagaaatgatgcacagcaacaacacattggcaaatggctgttctacgccctgttgatgctgttgttgctcttttccggctacacattgtacggcgatcgacgccttcgtttggccggcaacaaaacgcaacagcaacaatcggtggaggaaattgtgccacaaatccatggaaaaccggaccgggagcagttgttgaaactgaaacgtaaggcaaaaaattaagggtatagaaaatgtttttaactgctatccttaaaagttgcctatttccctaaaatttacctaatttatcccccccccctctctcctcacctcccggtttaatggcaaaacgtataaaaacgcatagcatgtttgtttaaccagttactaccaagccacaaaaatttgaaaatgaaatttctgggactttcaccccctcctccctattccatccccggcaaaaaaacaatcaaaggggcaaacaagaaattttgtagaaaatcagcggttctttccatttatcccatatttgtcctttagcatccgatgaacttcatcagacgcatttggcccagcccggcacaccaaaaaaggacattgtgatggaccaaccggagctccatttgacgcaatcgcttcatccttcaccgccgccgccgccgcgtggcgaagtgccaattgtcgacgaaatatcggcacaaccgcaattcatctacaacacgacaacaccgtacagcttctacgaacatttgaccagagctggccaatccgtctgggaattgatcggtataacattttaatgttttcccaaaaaaaaaattttttttaataattttttctcgacttataatatttttcttttttcagttgacacatttattggcacatacgaattgttgaagcgcatttttttcgtcatcggtatcggtatttgtcattgtttattaggtcaaacaacaaaaacaaaaaaaattggtgtgtctcaaatttgtgactaaaattttacaatttttctttgggattgttcaatactcataaagggatttaatttaatttcatcatttccagtcagtatgccgatcaaatttgcaaaaatgttcgcccattttatgagggcggtggtttcttctgtttggctttcgctcaaatggttggcggaacaaattggtgaattttcttgataaaactttttgcaatgcaatatttttttttgtttagttggatttccattcactttcttggctccacttaaagaggcagtgcaatttcgcatgcaaaacattgcaaattctgtcaccgaatttggacaaactgtgtaccgaaaaggtaaggaagttaagaaaatggggggagggagtggtatcatgacaaaaaatgttttttttcctatgtttcccgtatttttctcgaaattttattatttttcaaagttttcttatttaagtcgcggaatggtttacaatgttaccaaatgcaatccatgagcatcttttgtccatgtggtatgcagtccgttggatggtgttccagctcagtcacacgttgttccttgtcttcgatggcattggttatgcggggcaaaaaggtgtcaaaaaccaattttttttttaaattaaaagcattaattttagtgcttgatggttgcatttacgcatacaatgcgtttgtttcttcaatgcattggctctttactaagcgtacgtttataaaaatggctaattttgcaatagaatttattttattcatattttcatatatttattttagttacaaacactgttttctttgtgtgggaaagtgttgtcaatctctgctgctctgttgttgaccaaagtcagtttcattagtatttttaaattaattt

SEQ ID NO: 30848 - DNA, 1737 bp, Heterodera glycines
aaaatcgtcccccgtgaaatttgcccctcgccacttatagatagcattttactttttggtttttgttttttcaaaaaaaggcaaatttaatcccaaggaaaccaaaaatattgaagatttaataagccacattaatatatgtagatatagtttaaaaatcttttggattattttaaaatttgaacaatgccaagaatgtttaatttggttttgcctaggaaaaaaattttgataataggttgggctagtcaattaaaataagattttgaggaatttggaagcttttggcaagaacaattaccaactcatttgtcagacaaaaaatttctcgaaatcgtcaattgggttgttagagatttcataaacccgtcaaaatgaaagtttattagagaaaacaaaagtttcatacatttctaaatttttcattcttgatggtacacaattggcacaccaaaagttttaaatttaaaatattagtccgaattttgcagaaaatcttacttttttcatgataaggcctaccagtatgcaaaattttagttttcaatttttaaaattaaaaattcaaattctattcatcatctattcccttatggactcccttctgttttctcttttaccatttttgcattagcgtcaaaattattgtgcaaaaatataattattttattatatttataagacaccaaaaaacagaggtaacaaaattaattaaataatcaattgaagcaattttttttttgcaaaatttgcaagagtaagcttttttgtttgagtaaattcatctcatacatatgtaaataaacgaatctgaattaaaataattttttttttgttatttaaaacgcaccaatttgaattggtttaaaaattaaatttcataaaatgtttaaaacattccagcaatacactcaaaaacgcttttaagataccattggatttattaaagaaaaccaacaaaagcattcaacaccaaaaaaaccagttacaataacaaagcccaaaatggaacctgttacggtatccaaatccaatgctgaacctgtcactgtatcgaaatccaaagctgaacctgttacggtatcgaaatccaaagctgaacctgttacggtatcgaaatccaaagctgaacaagaacggtatcgaaatccaaagctgaacctgttacggtatcgaaatccaaagctgaacctgttacggtatcgaaatccaaagctgagcaagaaactgtatcgaaatccaaagcggaacgatagtggaggcggtcgaacaattgaatccaccttctccaatgaaaaatgaggagccaaagcagaaagtcatagaaaagcagcagaagaagagcagaaaaagcgcaaaaattcgcactgatagtatctatgttggcactgttatagaaaatgccatgggcactgataaacaaaacgaaaagaaagccatcgatgtgcaaaatgacaaagctagtactgataaacagattcacaaagttggcacagatagacaaaatgacaaaatttctgatggaaaagatgccaaggttgacactgatacacaaagtgccaaatcgggaattaatggactaaatgccaaggtgggaactgatggacgaagtgacaaagctgtcattgttgcaaaaaatgccaaagttggcactaatggagaaagtgacaaattgggaattggtggactaaatgccaaagagggagctgatggacaaaactacaaaatggcactgat

SEQ ID NO: 30849 - DNA, 1644 bp, Heterodera glycines
tgtgaagagcggagggtcaaagaccgcgtgaacatgacgctttctacgcaatcgacgacgacccttccgccccctctacttcctcttacttaatacgggtgggcgtttcttttacacagattggacttggttgttaaaaaacattttcactaaaatgtttaatacattcttctccagattgttgttgacaaattgctcaaagacacaaataccaaacacacaatcagtcttcgaaacaatttactgcaaaaggccgaagaagaatgttcaattatgtgaagcagaacaaattttatttttcatcttaaattcatttttacttctttctatttactgttttcttctattcccggtttcgcatatactatgtagtataaaaatgtaatattatttttacttttattttacatcgcgataatcgatttaaaatacatattgattcattccccttacttagtgactgtgaaactgaaatgttttaatggctcagattgtttagtttttagtcgaattcgagaaaagcaataattttctccatttatccataagcagcatagaacgcgatgagcagcagtggtggggcattgagttggaattcgccctgctcgtcgacagtcggccaacccaagcagcagccaatttcttcgtcgtcattttctggcaaacaacgccattcaccaatctttcagcagcagcgagtgctttcccggcaccatgggatgccattccaacagctagcagacgaattgttggcattgatcacttacaattgcaaagatgcggcggcgaatggagcagcctttgagaaaattctaaccattttaaagcaattaaaacagcaattttatttggcggaagaatcccaaggcaaaaagtatgtcaaaacttcgcgtcaggatcagtcagccgaggacaactcagctttacgagaatttacaaaaggcaactcgtacaatggcttaggcctaagctttaggcgaggcttaggcttgcttgggcctaggcttaagcgtaggctttttaagttttattgtacggctgatgtgagttgtcctcagctgactagtccagaagcccaaaactttaattccttaaatatcatctccatttaaggcaaaatggccttcagattttgcaaaatgcctacgaaattctgaaccatttgttttttctgaggagtggcgctgtctttggccacaattcgttggcgctgcacgtcgaccgaactttgaaagcgctcaaacagacgacgtcactttcccacgaccaatacgtcggcccggtcaaggcccttgagaatcgtaaattgcaagtgatgttctgtgagtttacagcaccttcccaggtttccgaattggacccttttttttgcaggttttgtagagtcaatcaccgaattgctcgtccacgacatcgacacttttgggttggacgtcgacgcctacgagaagtgcgggaaaatgcgcagggaaatcgccaatgctctgatgaacgtcgtcttccagcaaagggaggccaagctcaggctgtgttcgaacctcgcctttctccgccgggtggcggacattgtggccaatgttccgtccctcgaccaggtgaagcggcattcggttgacgcattcttttgcaattactccgtccact

SEQ ID NO: 30850 - DNA, 1131 bp, Heterodera glycines
agcccctgaatttagctttgtatcagttttttttcctttattaaggaggaaaagggtatataaactcaaagtcaacaattggatttggcctttctttttaggaaaattggttaattatcgtaattaagtaattgagattttctttaaaacaacattcagatttaccctgattagtcatctgctcttgttcgacttgtgaaaggaggggagaatgttgaaatatgatgactcaaattgtaaccagagggtgggataattaattttttagaataaaatgtccagcccattcggataaatctcaatataatggattttctttcaaattagggtcaggaatgcgaatgcagtacgtttttagcattttttatacaaccccccccgctataatgaatttttaagcaaattaaataaaaattcaaaaattttcccgttacatttctgtcaaaaaaatttcggaaaaatcgtaccgcaaatcattgaaagtaaaaaaaggcacgacttatatggccctaaacacccggcacaattttgggtgactccaccccacccaagcatgttttaccggcatccgcagaaccatcgggaccaagctgcactgacggatcggcaactgctggcacatgcacagcaccggcgtcagatgggtcaacagtacctgcgaattgaaattttttgaaaaaattgagtttgtcaatatgaattcgtccccctcactcggtgataccgaaaaaaattgttaggtttacagagacaaaaaaatagcaatttttcaatgaattttcaaaaaaaaatttttttttgattttttcacgaattttcaagtttttttttgcggcgatattaaatcccgacgacatttcggaggcgacgtccccccccccccgctataatgaatttttaagcaaattaaatataaattctaaaattttctcgctacatttctgtcaaaaaaatttctgaaaaatcgtaccgcgaatcattgtaagtaaaaaaaggcacgacttatatgggcctaaacacccggcacaattttgtgtgagtccaccccaccccagcatgtgttaccgcgatccgcagaaccatcgggaccaagctgtactgacggatcggcaactgctgtggcatgcacag

SEQ ID NO: 30851 - DNA, 1096 bp, Heterodera glycines
tctgcatttacaccactaagaaaatgctaaattttaattttaaaataacaacactgaaaattttaaaaaaatcgttttttagcattttcatgtcaacaaggtcacatcaaaccatcttaaatttgctactgatttgccgccaaatattcgtccacatagccctcaaagatattggcaagcgtttggatgacttaattatccacattatcgctcattaattggcatttttttacattgttgtgcccaggaaatgtcctggagattgttgcggtcaatagtcgcaaaaatggcgtcaaattgaatttcgaaaatctccggagtaagttccccgcgaaattggacttctgtcaagccaaaagagttgtcgagacggaagtaagaggcgatgtctgaaaatatggaaaattatttctttgtcataatagtaatggcaaattacagtcgaatgatactgtaagcagtaaataaccaaaaatacggtaaaagtgtactgtaaaaaagaaaaagcactggaaaacttacgatccctcatgttgcgcaagcggttttcaaacagacggaacgacattaatttaatccgacgttttgcctgtccaagccgttgcctctaaatccaaaaaaattgtttaaataaattaaaaattaattgaaaaaacattttcttccacaattttttgtctgatcaattcatttctgatccattgggcttgttttttgtacaaaaaatggtcaaatgcaaaagaaattcgcacattggcccagcgaatatcaaagggaagtgccgccacaatttcgacatttaattcggtcggcatttttctttttggcatttttaattgattttttggcataaattttgtaattttgggaggaatttggcgaagaatttgtcgctgttttgggtggagggcgaaatggaagggcaaatgaatgagtgaatgattatgacgcccacttttgcgcactttgccctccgagcagagactaaaaccaccgctgagaggagggtggagggggtcaaatgtttaccaaaacgaaaccatcttaaggtgccgtttaaaaagttagaaagtgatttgcagaatggcacccgtta

SEQ ID NO: 30852 - DNA, 1012 bp, Heterodera glycines
ctgtgttttgtccaatttgacccttcttttgctcaatttgttttttcatcccccataaacttttccctaaaatatccttcaaatgtttttcagtttcgtctcatccatgtcaaaaattttgtcataaatttcttccccttcttttttgatccgatcaaaaagtgcgttctttttccgctcaacaatgatcttatggccatcccatcgcataaacaccgccgaatcggcgccgattttgtgacttactaccaacgttagatcttattcctcaatcgcacacagaacattctcataatggtcccgaagaaggtcttcatttatgagtcctaaacatgtgagatagagaagagaagctttccaacccgggaggaagattaggggactaattgaggtgataatgaccgtaatgcccgagctaattcgattattagggagtgccggtaattcagccggcggtggcaccacgtccataaggctagagagaccgattctctcgtactcaccccgtttttcctcaataactccttgcttgtctgctaattacatatttcatcaatccactataataatccgttgcctgctcaagtagttaaggatgatatccctatttgccactatccgtaaattcttctcccgtcggtcctagcttttcccaatgcttttcatactgttccccccccccccccgaaatgaaaaaccaaaaaattttcaagcaaaaaagggcaaaatttctgaaaattttacacattttcttatcatattgcatttaattttccaaaaattcttcccggcggcgcctattggcaccgccgggccccaatcggatcattattttttgaaaatggaaaattgtgattttttcggcgcaagcccgataataattcctgttttttggctccgcgctgaagaatttgaacataacactgtgcaaaaaatgttttttggcccgaagagcaaaaaaaaaaagctcttcgggtgccctccccgaaattttttcctggatacgggcctg

SEQ ID NO: 30853 - DNA, 1067 bp, Heterodera glycines
cctcattttaaagcctacctcgaaactaaaaaattatcccccgctcctatgacaatcgcgggatcaaattcgggttcagcgcagccaatttccccattcagcagattctcagttggatacgatcaataacagtataaaaaactgattggtaaaaataccaccgctttcttctgtaaaaagtcaactggacgaacggctgggccctgcttccgtctggctacagtctcgagagctaatttggcaaaagcctaattttaaagcctacctcgaaacaggtacaataaaattcctaaaaaattatttgggctcgtatgacaacggcggaatcaaattcgggttcagcgcagccaaaaaccccattcagcagattctcagttggatacgatcaataacagtataaaaaactgatggtaaaaataccaccccaaacttctgtaaaaagtcaactggacgaacggctgggccctgcttccgtctggctacagtctcgagagctaatttggcaaaagcctaattttaaagcctacctcgaaacaggtacaataaaattcctaaaaaattatttgggctcgtatgacaacggcggcatcaaattcgggttcagcgcagccaaaaaccccattcagcagattctcagttggatacgatcaataacagtataaaaaactgatggtaaaaatacaaccccaaaattctgtaaaaagtcaactggacgaacggctgggccctgcttccgtctggctacagtctcgagagctaatttggcaaaagtctcattttaaagcctacctcgaaacaggataaaaaactgattggtaaaaataccaccccaaatttctgtaaaaagtcaactggacgaacggctgggctctgcttccgtctggctacagtctcgagagctaatttggcaaaaagcttattttaaagcctacctcgaaactaaaaaattatttgggctcctatgacaatggcgggatcaaattcgggttcagcgcagccaaaaaccccattcagcagtggatacgatcaataacagtataaaaactgattggtaaaaataccacccc

SEQ ID NO: 30854 - DNA, 872 bp, Heterodera glycines
ttttcaaaattgagtgactaagtagttttatttgtgattttttccaagttgaacatcgcccttcaagagtaatcgatcaactttttgcaatcaagaacccattttttaaagaagtttagtttccatagataaatatagtatgtagttgctcatttttaattttggacccatagttttaataacagcaaattacggacaatttttgagaaaaagataaactattttagtttttgtttgttaatttaattggtttgacatgccggaaaaaattaagctctcggttaactaaagcgtggaagtgaaacaagataaaaaattttcttggtataaaattcttgaactgacttttatatttaatttagctaattttttcgccaatttcacagtttaattataagttagaaattctataaaaaagaaagaaaaaagttatgtcaaataagacttctctccaattgagacagatcgctttgcatcagcttagcttcactaatttcaatttgggaatattgaatttattaaaatttcttattatttttttctttatttagacagttctatcgagaaatagtggtccgcaaaagtcggtccgcaaaagtcggtccgcaaatgtcggtccgcaaatgtcggtccgcaaaagtcggtccgcaaatgtcggtccgcaaatgtcggtccgcaaatgtcggtccgcaaatgtcggtccgcaaaagtcggtccgcaaatgtcggtccgcaaaagtcggtccgcaaatgtcggtccgcaaatgtcggtccgcaaatgtcggctaaccaaataaaatacccaataattgtcgtattttagagaaataatcccggagtactcatttttatcaatttggaggtccatattca

SEQ ID NO: 30855 - DNA, 1330 bp, Heterodera glycines
  misc_feature (24)..(24): n is a, c, g, or t
acacatcttcttaatttataaaanagttggcaagaaacctgtaaataaattcaaattaccagtccatgaagaaatgagtccttactcgagtatctggacacgaaataaaataataatcgttgattacaaattactcatttcatgttaatttatataaattttaaaaaataagaagaaattaaatgaaataaataaaacaataataatttatgaattatttaagagtttatttaaataataaattcttataaaacttttaaaacattaagtataaaaaatacatgcgatgataattgaagaagcagcaaaagaccaaaaaaaaattgacaaaaaaatcaaaattttatttgccaagggtttcagttacggcatattcctatctgaaagcgcatatcgttggagaaaggcgtatattcggggagggactttgggatttgctggggttcgggttgagattttggggtcaaggaaagatttacttaattttcaacaccactttactgacaaggaattagagaataaggcaaattgcaattaggaactcaaataacagtaccaattaagcctttgggcgtttgttgttgttgaatgaaagtccacggggaaaagcaccaaattttgtagttttattacaataattcaaaagcacaaaatataaaaaacttgagagaacacgaagaacaataaaaaggaaaaattaaatgaaggatcaaaatattttaaattaacgcgaaaaacaatcgttgcaaaaaacaataaaataaggataaatcattatttatcctacgtcccccgccgtttgaagaccagtgtcctcacggtctgatcgccgcgcacctcccccggatcagcgaaagacgagcgcctgcgagttttgacgtcggcgctcaaacagcggatttgatgaagcgaagaggcgagagctgaaatgaaataaaggggaaggggtgataggagggactactctttttggacgaatgttttaagcgataaaatttattaaatgagaaaaaaaacaaataaataaacaacaaaatgaaacaataatgaggtcatttataagtaggtctgaggcagggaaatacaatcaaaaataaaatttgtccggcacaattaaggtaatgacgatccgttcagaaccttccacgtttagggggaggggggataatccccatgattttgccaacggtaattgcggtaagccccccgattttggaaattttggccgcttcctcgaccacgattgaagcgcctgtaagcattttgctcttgacgggggtgaggaatgattggcgatggaattgtacattgagcaaactcggagcacgcg

SEQ ID NO: 30856 - DNA, 1789 bp, Heterodera glycines
  misc_feature (209)..(209): n is a, c, g, or t
tatagaaaaaaaaattaattttcttaaagaaatttttttaactttttctttcgaatggcccccaaaaataggacttcaaaaacaccaattagaaataaaacattggcataagaaaatttttggtttcatcgctattaaaaaagtaataatttattaataaatgaaagaaaaataatttataaacataaaaagaaaatttatataaaatntattaatatacattgattgatatagtcgcgtttatgagggatatagaaatgccagaattttccattgaattgatgaaaaaaaagctcatttcctaacaaaaatttattatataatttaatatataacgtaaaggtcgtccgtcatctgattaaaatttaaaaatgacttttttgcataaccatttacctccttctcttctctgctggtttatagtgtaatggggacgtaatttgttaagtttgaacaaagttatgtctagggaacggatttatatgtgctaaaaaacgccaaatatgtagtgaaaaaagtcatgaaaagggtcaaaaaatgcaaaaaagaaaaaattgaaaatttttgtgggcattttgccaagaatttgattgccaaaaaagtaacttttgcaaaaaaaaaatcaaaatttctcaaaaaatcgctaaaatatgtgccaaaaaatgatcaaaaaaatttttttttttaatttactgccacatacgaaaagacaatgatgaatgaagtttcttgttcttataagcgttccaagaaattaataaatttaagagcactgaacgcgaatctgagcgtatttgaagattttcatgtatttaaattttaaatttaaaaattgaaatctttatcatttgctcattgattgatttccaatggcttatttatgcttaaataaaaaagacatacacaaaaagctcttatttgggcatgatataaatggcattcaaatgttgtaattttgagacgcttctcccgtcgatgggtaatttcctaaaaaccatcaaaaagggcgttcttcaaaaaaccatctaacggaaaatgattgacaaaaaattattcataaacttgctcaatgctaaacacaaattttcaattattaatatcattcggtaaagtctaagtgttctctattcacctgcaaaatttcattaactttcaaaaagttatgagtagggccgcaacttttagtgactaaaaatctcgaaatagttaactaaaatagtgagtaaaaatgccaaaatagtgaaaaaatagtgtcaaaaagtccaaaatagtgacgaatagtgacataattttcagccaaaaattgagcaaaaataatttttatcaactagttgcagttgaaaatgagtaggacagagattttgaagggcaaaaaacccaaaattagtaccgaaaaaataattttttaaattaaaattcttgccaggaaaatgaaaattttttcatttcttaggagtgtattttcaaaaattttcgaccgtttcttaggggtgtatttttttgaaaattttggggtcgattcttagggatgtattttccgtttttattgcatttttgttgagaaattttcccaaaaaatgtcgaaatagtgataaaatagtgacaaaacgccaaaatagtgatttttaactattttagtgacgagacgccaaaatagtgatttctagtgacgaaaagtgacgtccaaatgaaaaaattttaacgcagaaatgcgttttttgagctcctttcttcaaaacaatagagcaaaaaaaaaagttttttcactaaaagttgcggccctaattat

SEQ ID NO: 30857 - DNA, 1191 bp, Heterodera glycines
  misc_feature (819)..(819): n is a, c, g, or t
ggacccaaaaatttttcggctaacgcactacctctacacttacacacttaggaaatcgtgcgaaacaattatttattttctttgattataaaaaactaaaaactttggcacgtcataactcggcactcagactcatttcgcagaaaataaaaaaatttttcttaagaaccatgggtgctctatccacccaccaaatttcatttggaaatcccacggacacctggggaccttcctttgtcagaaaccatgtggtcccccctttggtcccaaatcaattttatttttataatcttttccaaaaaaatagtagaaatatgaaataaatacaattctatagagcaaacaattgcgggttttcccgggcattcaaatagcggatttacggtaatctaatttaaattgaaataatatgcataaagaaaaataaacttaattggaataaataatttacctaatttttttcttaaaaatttctccttctccaccaatttccttctctaatttttcacgcagaactccattcttacaaatgtattttttatttttttggtagtgaagcgctcgcaaaggaaatgaattttgattttttaagaaatagtaattatctcactacttaggtatatatacctaatacaaccccacacattttgcaacgacttaattcattcatttttctgttccaaatgaacgattggctgctctcctcagctgcccttcatgaaaacgttgttcaaaacggcgacaccgctgaaaatggaacggtttgtgtgaactttttttgttgaaaaatcgcttttgggcggtcccggggggggcggnggaaggacccctccacacccgaattttttagaaaaatagtattcttactgaaaatttacggtttccttgttggtactccctccaaggcctacctcacccaaattttccaaaaaatgtcgcttaatttttccgaaaaattagcaatttttcgatgaaaatccttaattctcttttaaaaattggctaaaaatcgcaaaatttgtcatttcttggacaaaatatgttaacaagccgataaatactacaaaaaaatttcgatcatggttctacctggcgccgtcggaccacactatcgcagaaaaaaaatttaaaaaaaaacgccgcaacaaaaaaaggaatcctcaagcggtaaaagtgccaataaaatcatag

SEQ ID NO: 30858 - DNA, 1101 bp, Heterodera glycines
  misc_feature (1058)..(1058): n is a, c, g, or t
ttaaacacaaaaatatgcactaaaatgctaaattcagcacaaaaaatacaagctcagcattaagcatgaaaataccaatttaagtaaaaatcagcatgaaaaagttgaacctagaagcttcaaaccaagttagaaatctttttcatgcttattagcacgtcccaagttagcaaatcagcaaatacaacaaaatttgctttaatttccttcggattaagtaattcaaaacttaaaaaataagtctccgtattcaagccctgggatcccatcccactctgatggacacacttaatgggaaagtggctttattctcgggacgactaacaactgaattgataatagcgtaaatggtgaacatattaaatacatgtgaaagcgaaatatgatcgatcaatgattggtcggggaaagggcggtagaataaacggcaaatgaaatgcttagaaaaatggaatgtgagtgaaaatcctagggcttcggcaatcaaacaggaaaacccggatctaccttacaatgtaaattttaagtaatatttatgtgtctgagataaagaagaagaagcatccccgagaggaagattaatggatcactggagagggcagggttgtctggtttttgcttattaaattcaatttttgaaggtcaagaacaaaataaaattttgaaacttatacctaaagctataaaaggtgaatatttggaatacacttcagggttttcgcgggttaagaaaaatgtcgggtttcgggattttgttttcatgttggatctttttacgaacaacattttaatatttcattaattaaattattctaaatatttaaatcaatatgtaaatcaaaataaaatttttgctcgattataaacctatattttggcaagtcacttaaatatcgttaaaataatttctatctgtgccccgtctttgctacttttattttggttatttttcggctttttaaggcatatttcagtgctgttagtgcatattttatgcgggtgcaccccaaaacgtcgtcggccgaacgtcgtcggaagacttttgccccatactttgntcattgtcaatcaattaagcattctttgtgttgtcgatagctc

SEQ ID NO: 30859 - DNA, 897 bp, Heterodera glycines
atgccgccatccgatggaagaagttagccaagacgtgatttacaatgcctttggcaatttgattaaatgtcacaaaaattagtgccaatttaaaccctttctaatagctaagggatcgagaaacccattgaaaaataatgccaaccgcagggattgtctctcgtaattaccaattaattacggtcattagtccgaggatttcacttagtgccaataccgccaatagatgaatgacattaaatcgtaaaatacttccgtcacccctcccccctccacagcacttccctggtgggttctgttactgctcgcaattgccctgctacagaccgttgcttttgtgtggctgtgttgccgactgcgcgcccgacgcactcgtcggcgctcacctggcgccagtggcaaaaagccatttgagagcggcggtgtcggctcagcgccgccgaatggttgcggtgacaatgcgccgatcagtgcctattcggccgcctccattctgatcagtgcggcaggtggcaccaaaatgcaacagcagcaaaaacaactgcacaaagctaccgtagtgcctaccgtatccgccgcggttggcgagcagttccagcagcacaacaacatcggcgggaacggtaaaaaccggaacaacaattcgtccactaccacaagcggtcaatggacattaacgagcgggagcgattcggcggtgttcggctcagtctcatccggaagcaatcggtcgtcggccgcctcgtcgccggtcggtggtggccaactcagcgccggaattggtaggcggggctcagttggtactgtgcttttcctggtcagaagtgatcagttctgtcctgttctgtgaccaggacagtaaggtttaagcctgacaacacccaaggggcaaataca

SEQ ID NO: 30860 - DNA, 2366 bp, Heterodera glycines
tttattataattatcgtgcgttaatgttaatttagtgcaaataactaggaaatattattttcctcctctactctcgctcgctctcaatttttcttatctctctttctctttcactctttttttctcattactttcaacaatttttctctctttctctgactccgcttttctttatgtgttcgatggcgtcgcttggaaagtgcaataaaccgatgagaattgctgaacatttggttggttgagtgttggtgagcatcgctgaaccggtgcactctaaaacgttgtcggccgaaacgtcgtcggaagactttttgaaccataactttgttcattatcaatcaaattaagcatttttggttatcattgctggtggcactgaaatatatttgatctcttcagacttgaccagtgtcccaatgtcgtatgctttttggctttcagcgttgacctggtttactggcttcccttgctttttggccaattgggccctgctttgtcttacaaatcgcagcccagtgtccaacattgccgcactttcggcattttgagtccttatttgggcactcattgtttcggtggccattcctcccacatcggtggcattgcatttgctgcgtcggtgcgctgctctttcttcctcgctttttgtttcgctcgtcttcgtttgctgactgcgccaataacggttgtgtcgtcaacagtcaatgaaataaatattgatttatttcaacacaaataaatataataataaagcgaggagagggagcgggtcacaatataattggaataaaacaaatgaatgtggggaatgcacggaatgggtgaaaaggggggtttaaatggacaacacgaagcggtcaaaacgatgatcgataaactagcatctgttggcgttaattaaaataattaacgaacacaacagttgtgtatattaatcatgatactaaaaatttttaaatatcaataaaacacaaacaaaataaaagaagactttaggtttttctaaattgataaaatcataaaataaaatgataatacaattcatcttgttttcaaataaatttagctattgagctcagatttttaaatattaatttacagaagcgaaggaagagagcgcgtatcaaaatatgaatgaagacatagcttggcaagaagaaaaataaagttcaagcaaattattttataattgtaattttattttataaaaataataataatttaatggctgtaaaaggaattattatacctacagaaaatttaaaaaaataaggctaaaaaataaataaaagaaagatgaaattaaagtcgaaaaaaaatattattttctatacaaaatgaaaaaaagtatacaaaattattattttttaattcccacattaacgtaaaaattttgacaaagcaatatgataattgttgtataatattccgaatggtaaaatgtaacaacatgatcaagtacagcgagtttaagttagaaaggataaatcacattgcgtaagccaatttataaatttaattggattaaaataaattataaatttatttgaaatttatatttgaaagcgattagacaaataaaaattaaaacatatttacatggcaacattaaatgaagttagtaattatttaaaaatggaaatactcttaaactatatgaaagtttacataattacttcaagggtttgtgatttttatgaataaaggataagaaattatgaaaaagtataatttattacatagaacccgcacttaaaaaggaagttaatttaaccaattcaaattggattaaaattatttggaaaaatattggaaaatgctaggataaaaaaaataattaattaatatcaaaatattttttttgttgtacatattttgataaaaaccattaaattcaaaagaatgaaaatagaaaataaataaattcacaattgggaaaatttttttatgaaagattatataaataattcataaaattctattttggataattaaaaacaaaaaatgatatcttaaaattcgactggatagctgaacaaagtttaaaatgacctcgacaacttgttgtatatggattacaattcttattcacattagaaatttgctaatatataacataaaaacttatttttataatgagaagaatgaaaacttagaatgcaaattaaatataaaactattttaaagaaaggacaaaacaaaatgaaaaaaaatataataataaaaaagaacaaagttttaaataaatttcttccgaatttacattcaagaaagtcactttatttttcatgctcaaaaattttcttattgaatttttcttcaattcctattgagttgagagcctggccgtttgaggagttggatga

SEQ ID NO: 30861 - DNA, 1056 bp, Heterodera glycines
tttttcagctaacatccccccccccgcagcggaaaatcaaaaattctttccttttttgtaacaatgtggccgaccgatggtcaatgcgtttgttgtctcgttatgatggtggtgcgggtgaaaattttgtacaacataatgccaaaaaaagggaaaatgggcttgaaatttttttacgaattttccaattcattcccttaaatttacttttttaaaaatatttttaaattgacattaacttttttttattgtcaatggaagagttttcacattttttggggcgggaaattaatttttgagttctaagcctttttcgactgaattttaagcaatatttaaatttaccaattttttaggtttatcaagctttaaccctggtttttaaggtgcttttagaatggggcctatgcttatcttaaatttatttttaattactttttaattttttctataaattttttaaaattattttttaaattgagtactttttaatgctaatgaaagaattttcacagtttttgagattttttgggactgtaaataaatttttgagttttttcaactgaattttatttttatctttaacaaggcatttaccccggttttaagatgcttttagaattggtcatatgcctattttaaattcatttttaattactttttccatttttctttttttgattccccctaattgtacgcgtgtaaaatcgagttgttagtaaataatgcccaaattatgtgattaaattgattgagtggcagaatctttctgctgctggtaattaccgaatttttcacaaccaacacaaaaaaaaaatttttaattttccattttttttatttttcacattttttcggcgccaaataacgcaacataaacataaacatgcacattgtgcttggcttggcttgaaccacgctcaacagcagaattacgcctggggcagcaactgcctgagtgggtggcggcggcgctttacgcccggatggcccccgggggcacaaattggcggcgcgcgccaaccatttttggcccccgcggccccggggctataa

SEQ ID NO: 30862 - DNA, 890 bp, Heterodera glycines
agcccgttcatgattgagaggatgccttcaaaaagttacaataatatgatggttaacgagatgggaaagcatttttgagggaaaaaccggaccaggttcaaagttcgaacctctagaccttcgttaaaccgatttgatatggagcccgaatataatggaactaaaactgtgatagtaatattaatattaggcaaaaaagttggtaataattaactttgtaaaaaacaagctaaaacactaataaaataatataaaatttttattattaatcataaaagaatttttataaaaaagtaagcctaaaaatgaggataattaagcctaaaaatgaggatattaacatttaattaagcattgaatattggtcaccttctgtttaatcccttcctttttagccaaatttttttgtgtgtgacgtacttaacgattaagtaaattattaaaaataggataaacaatgaaataaagaacaaagaattttttagcactatgactggtcccaattaatttaattctaattagggatattccatacagagtcgcatatccgtgaccgtattcttgctttcgcgttttccatcacaaaaatgcgttaccgtagttcttgcaaaaaattaaaaattcaattaatcactggtctattagccgttaattacggccagctgattttgcaacccttcaccacaccttgaggaaattcggtgcagaagaacacactcagaaggaccaacagaatttttgtggtccgatcagattgggctgaatgccgtcggtatgccaatgttgtgccggaacacattagcttccgttttcggcgattcttctccagctcgtacagcaatgccaatgtgaacaacagtagcagaacacatgggatcaccttgaaaaat

SEQ ID NO: 30863 - DNA, 1737 bp, Heterodera glycines
attactagggctgggatttttatgttttaacatattttttttgcggcttagttatggcgagagaagcccaaaaatagcattttctccgaacaattttcgaattagagcgacttataaaaacataaaaacacatatgttggcattttggcatataaataaatatcgcacatatttcggggtttggcacatattttgcacatattttggcatttttgaaaaaatatctaagaaaaacacaaaaaattcaaaaatgcacccctaaaaatcaactttcttcccatttttataggctctttcaaaatttctttatttatttcgtgtaccgaaaatcgaattcttcattaattcgttactggatatcgaagtttcttgctggcacttactcaactgatggaaaaattatctttaaaaacaatttatcaaaaaaggactaattttatccccaaacacctccaaatgttttttatttgcaattgtgcgggcaaaaatgataaagaatgagttttttggaatttttatgcaaaaataccattggtttttccaatttttagcacatattttgcattttttaacacatatttaggcctttttttagcacatattttattacatatttcaggatttttagcacataaaaatcccagccctactaatcgcataaaaaatggttttaaaaacagaaaaaagagaagaaataatacgattgcatttcggttttattattgttgttaataatgcaagaccaaaagttaacgggggaacgttttattgaccgttttttgttggattatttttcacaatttttgcgttatttaaaggccaattctttctcattttaaacaaaacttaaattatcaaataaaatattgaaattgtcatttttcttcttcaattttgccgcattgttctttttcaatgttttttggtgcgatttgaaattttaaacttaagcttaaaaacttctaatgatttaatttcaatttacgttatttggagttaaacttagctttaaactcagggtatttcaataaaaaacaaatgtttggtggctttatcccccaattttatagtgcttttctgaagcgggcgtctcctgcggcctcgacggagtgtgccgcgatttcgctaagaatggcgaggacaacgtatgcaaaaactgcaaaagctgcacactgttgtaacaaagtgttcacgagtccgtacgttcagtgtcaaattccgggatggcgtgccaaagggtacaaaggcaatgtgccggtcattatcggagtgccaaagaagcgtgacgttggtatgccaatttcaaaaagcaggatgtaaaaatgtcattttaaatgcctatgaattcttttttttcattcttcctctccacttttgtaacattaaatgggattctcattaaagggccatttccttttttagctcaatttgtattttccagcacatgcttaaattacctttcaaaacgggattctggttcacaatttaaaacaaatttatttgttttcgttgcaaagatatggaaatattggaaaaacatttagtaaaattaactaaaaattctaaaatatttattaatttaattttaaggctgttccaatagcaatccgtgcgcaggaaatggctacaaatgtgtggcctataagaagggggacgacaaacttctgctggagggtccgtatcgttttggcgccgacgttttggcgccagcacgagttttcggactataactttttt

SEQ ID NO: 30864 - DNA, 1115 bp, Heterodera glycines
  misc_feature (36)..(36): n is a, c, g, or t
  misc_feature (67)..(67): n is a, c, g, or t
  misc_feature (70)..(70): n is a, c, g, or t
agtaaatgaagtgtttgtttcgtgtctaaagtatanaattttgaatagctcttttctcgtttttgtnggnaatattcggcttttcctctcccctacttaaaaaagattcacactttccgaccatttgtccaaaattcgtgtaaagtccaaaagtgtcatttaattttggtttgcctctattgcagtttacatgtccaaccgttgaccacacactaatctttttcttgataaagacctacattcttggtacttttctaaagtttaaagtctacaaagtttttgtaaccaatttgtgtcaaagataataaacaaaaaattatcgccgaatatactcgaaaagctgactttggatattctcattgtgtttttcttgtatttaagattccctaaactttaatctttcagatgtttgtggcctaagaaaataaggatggtcactgattaaacgcgtaaaaatcgtttggcgagtaaagcctttgggttttcacgccgtaaagccattaaattcaaaatcccccccccctctaaaaaaactcacgtgacgtaagagccgaagttccgtccgacgatgcaatgccatgtcgggttgaacttcttgtcaaactcctttttgatgtacgcagcgatgtccttctcaatgttatacctgacaaagggaggacaaattgcgcatcgaaaagaaagaaaagaaaaaaggcggaaacacttaaaacactccaatttttgttttccaagggaatcgttggggaaaagtttaagcatttccgaagagcaaacgaattgctaaaataagtaaacgcacttctccaaagcctgcgtagcgcactcaatggcctaaaagggaaatggaaatgaataaaatttaaatttagtaacggataaattcaaatccaatgaaaaattgagcttttggttaaactgaaaatgattatttttgggggcctttgttttatttttgttacaaaatgcgatactcttttggaaaatcctccatttttcattattctcaatttgcttggtccgacctcctgctgcatctcttcggtcatatccgcgtttttaatcaccgcctttctgtcgcccataattacggaagaacaaaatgcaagcgaacg

SEQ ID NO: 30865 - DNA, 933 bp, Heterodera glycines
tcataattcatgcccggtttgtttttgtgcgctccccacagcttggacacctttttgttgtgggaaataacagtgaaaatttctgatcagaaaattttctttaatcatcgatgagtgagaatgttcgctaattagtcaattagtgtacaaattattcgaaagcaatttttttgccagtcgtccaaactaacgtttttcgaaatcttatgatgaatgctgttttttcaaatttttcctaaaaatcgctgaaaatataccaaaaatttatttcaagaaatctaaaatggttttgcatatgtgtatcctccatacactcactattttggagtcgatcagcttgaaaatgcctgaaatttttggggaaaaaatatttttctgccatttttcgtcaggtccggtccccaacgaaacagacgaacgcttttcctcgtcaagccatttgatgtagcggggacagtgttccttgctcgacaaaagatacagtaaactaaagcatggggcaaaaggcattcgtttcaaaaaatatacaaatttaaaaagagatttaattattttaacagcacttacaattcccacaaataagtgacgtgacctgaaaatgagtacattcatttcatgggtgattctggcagttcaagaaatctacggcaaattcagaggcccaaggaattcagaggccaaaaaaacaattcacaaatccggcattttgcgtcaaaaaatcacgggatttgggactccaaaaattctctatttaaaaaaaacgtaaaaattttatagcaaattttgttgtacccgtttttttacatttggacagttttgaaatcaaaaaactcgaatttcgtcggattttgtaatcggaaaccttcactgattcaaataaattaattcatttttaggtcaaaatttaattaccctctctgccgccgtactttt

SEQ ID NO: 30866 - DNA, 1953 bp, Heterodera glycines
aagtaatgggcgagtcaaccatggccaccgtcgcattacgcatgcttgcatttcgtatttgaagcacacgtccatcaattcccggcgcatttgcactgcgagcatcggattctttcttgagactgtttgcagttgttgaacaatgcatcgacctgttgagacggtaagttcattatacgtcatactgtgacaataatatttctaacaatgaattcgaatgtaattacttcctgttacttatttacgacataatgcttctcggtatgttttgaattcggttttggggatggtggcaaatatcgagacccaacgtaacaaacccaccaaatgattcggctatgtccgagccaatttctccgtccggctcactgctatccctccgtgcgtctgatgaaattctccatccgttggagaagtcaacggatgccgaagactgatgcggttggtcagttttgcattgcgaaatgatggaattggccaattgagagggcgaataaacggggaattcgttgtcccgcttgaggtgttccatgtcagaatttacttaacgaaattcctcaaattccttcttgttttttcattatcctcacatttgtccgttccgatattgctgctgttgttctgcgctttgattgtcccaagtgcggtgaccaaatcggcagttgacatcgctgtcccaactccgcccgtcattggtcccatttcgctgttcttctcccgctccgtgtcataatcaatggatctttgacgctgaatagcggtcgatgcgtgacaattattcaacatctgttgttgttgttggaattggccgagcaaattctgtgaagttttcagtgcagcaaaattggccattaaaaagtcttgagtggtaaacggttggggcggtgtttttgcacgggtagcagtggtgggaccgttcgtttgaactcttcaaaaataacttacaaataaacaatgacacaaagtctcactcctgtctctcagccattgctacgctattcttccggacactgcgcttcctacggactttcggcaacgccgtgacggacacattcgattcttttcctggtgaactgtgattcaaatgttcttacggtacattgccattttgtgcttttcggtcttacccctgctcttgattgccacattcactctccgtcgatgtcggttggtgcgcgagttgtgcccgaacgccgggcagcaaaaactccattcgcttccaataaggccatgaaatggtgttcagctgcccctcgtcgaccgttctcccgcctccttcctccaacaatttcttcataatgcgcgtgaaacagtagcgcaatttgccccattcctcttggatttgtatccctaaaaaatgtttttttcttttacccaaattcaattatccctactcgaaaatgtttcaatgtcatccgaaagaagtacggcgacctcattgaaggcggactgacgcgactgattgctgcggaatccctcaacattgcagtcccaaatttgtggcctttcgtggatgtaatctttatataactcaactatagaggcattatcacaatcagtgaaggattgaaaaaaatggtgaatgtcaaaggcaaaacagtaaaatggaatacagtaaaatcaatcggttgaaaatttaaacaaaatttattgactcaccgatcagtcgcattttctgctccatattcaatgcaatactcgcccgacaactggtcttgcgttttctctgttgtgcaccgaattccccatcatcttcctgttgcatttgctgttgttgttgaagttgtaaatgtttttgatgttcaattgcaagtgtttgtaaaattgtattagccattaaaaattatgatgaacgacaaacctagacgcaaaatgtaataaatttttaaaaataaaaatccgcagggaagaatgataatacataccataaagagtcaaaacaaaagaaataag

SEQ ID NO: 30867 - DNA, 1597 bp, Heterodera glycines
  misc_feature (1485)..(1485): n is a, c, g, or t
  misc_feature (1489)..(1489): n is a, c, g, or t
  misc_feature (1497)..(1498): n is a, c, g, or t
  misc_feature (1520)..(1520): n is a, c, g, or t
  misc_feature (1541)..(1541): n is a, c, g, or t
ttcttattacattgtattttttataaatttatattttatatgggaaaatggcaacaaatcaggaatttgtgccaacgcgctcaaaaaatttcggaaactggaattgagaggctaaaaaatttttggcaatcggaacaccggcggccccaaaaaatttcgcagtctgcggtaatcagcgtgccgacatattcccggacaatacccaacaggtagttgcataagctactatagagtttgaaattttaaattcaatcaaacaagaaaaaataaaattaaattaacaaattgtttttttcgtcttttgtctctatacgattatttaattttttgtatgttctaattatggtaaattataagatgatcattaattattacagtaaacaaatatggtaaaagtttaacgttagtttatgggctgccagacattgtgtgttttctatgggtataatatattttgtctctattcatttcttcctatgcatgaacggtaaataccgaaagcactgataaccaaaagagccgtacaaaaaatcagtccgcaaatgataaggacatcgatgattggaattctgtagttatgcaaattgatcaaaatttaaaaatcaatgtcacagccttaagtttcggaattttcggactcatgcgcaaaataataaattattaaaatcaattaaaaagcaatttaaattactcattttgacagcaataacatttttacattattttttttttggaagcatattgttaaatatattatgccgtatttcctttcaaccccctcaaaaggggggctttatttccagtgcggctctaatttagggagcagggatatattttaggaaatacgctaaattggattggaacaaaaatttttaatttctcatttcagggtcaatgaatacccacccacttttcttcataaaatcaaatctattcccgactttttatgatgtgccaaagtgagcgaagtccagccataaaatggtccatcaatttggccatttgttctctgttttcatcgttaaaagcttgaaaatcggcaattcttctgaggcttccaattaaatttgggtcaaaaatgttcaaattttgcaattcttttatgattggctgcaccaaattctgtgaaatttcctcaaaacttttaccattttccaattggtggcaaaaaattgccttaaaattttccattttcacgacaaatttgccatatgttttgttatcactttccaatttttgtaaattcttttcaatttttgtattgcacaaaaattcaatggcactcttttgaagccatttgttggcagaatttccttcaaaggcaccagcagtgaaagtcaaattttgcaattgcttaaccattgaaaagggatctaaaatattaattaattttcaaattataaataaatctcaatatttaaatttttcatttaaatctttagttaaaaaattaatttcacaatttttttttttgaataatacttntaantgataatnnatattctttttttctacctaantgatgagagaatatttctttnattgctaatgcgataaaaaattagaaaaatcgaaaaatgaaaagccatttaaatat

SEQ ID NO: 30868 - DNA, 921 bp, Heterodera glycines
tgggaggggaagagtcaaaaatttgaatcgattattccttaagaatggagggcggcgcgggcaagtggtcggatggcccttgatgttcataaggtgatgcgacatttgcggcgctgacacttgcggcgccgacacttgcggcgctcagtcaaagcgacacttgcggcgcagacatttgcggcgtgacacttgcggcgccgacacttgcggcgacgacacttgcggcgccgacacttgcggcgcccagtcaaaaggacacttgcggcgccgacacttgcggcgcccagtcaaaaggacatttgcggcggcgcaaaattcaacgaccccaaaaatatttcaacaatttatttccattaaaaacattgataatgactctctcagtcccattcttcaaagcctttcatccctaggcgatattgcaacgcatgaatgtgattaattatatcagcttggtttttgttttccttatggtcaaaatatatgcggcggggatcgcaacatgctccactaatgtattcaccgtgtataattgaaggaaattgggaggcgtcacttaaaaattaaattcccaaattgaaacaggttttttgtggcccggatttatgtttccaaaatgattgaagtgcattaatgagcaataaaccaaaagaaataataataaatgttgtaaaccaaattggagtccaagggtgaatgggtctttttatatattttcattttttattttctgaattgattacttttttcaaaaaataacttatttatttttggtttttttggagtcttaaatttgttaatctttatttgactaaagcttatcttattcatttttattaataattaatttcttaggtggcataacagagttataaaacgtttcactaccccccacccagcatttttcaaagtataaatgagtac

SEQ ID NO: 30869 - DNA, 1215 bp, Heterodera glycines
ccgccccccccgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggaatgccccgaaaacaaaaaatcgattttttcaagtgtcctttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtactcgaaagattcggtctccccataaatctgggcgcatcggttcggggggactg

SEQ ID NO: 30870 - DNA, 1628 bp, Heterodera glycines
cgccctcggattgaaggaaactggtgttggtgcgggccgggtggtcgccgcgcgcgtacaaagtacccggagtcggtgtcgcagtacagcatgcggccgccccgccaaacccgccccctccctcaccccgcccgtgcagatgaaggcgggcgtgcgcggtgacgaagcaggcgaccgccaaagtttgtggtgtccggcgcgcgcacaaagggccaccggcgccgcaccacgcaccggtccagctgctcgttgaggtggacaaagtcgaccacatcttggcgcgggtcgcccaacagctcgtggaactcgcgcgcgctgcccgtgtagcacacgtcgtcccgctccgcgcgctgggccagcttgccccacagggagttcagcaatgccttggcgaccgcgcgcagccccgggttcggctgcacgcggcccgcctcgagtcggatgccctcccggtccgcgtagcgcgcaacgtagcgcgcgcgctgctccaccgtctggcagtcggccggccacccgctcgcctccaccttcagccggagcattgtgtcgacgtagccggcgaacaggcttttgcccgcctccaggctcgcccagcggtcgtagtgccacacttcgtacagcgccagcaccctgtagccgagctgtagcgccgcgttcagctccacatcggtgtaggcgtgcgtccaggcacgttgcgccgcccggtgtcgacagcggggcaccgtccgatggtggcgctgcaccttcttgtccgcgttggcccactcggcgcacgcggcgcacagcggaaaagtcagccgccccgtgcgcgtccggtagggcaacagggcgtggcggtcgcccagctcggcgggcaagggcggcagcacgcggcagtggaggaaaccgcggaaggggttctgctccgcgctcgtccacggcaaccgcacccccgcgtcgcggtcaagctgctctgcgctgagcacccgcggcagacccacagggaaggcgcggtacttcatcacgaacgggtacagcgacacctttacaagcgggggagagttgtgagagttagcacagccacaccccccccccccgccccatcacttacaatgtccaatgcgtctatttcctctcgctctgtggacgtgtagtggagcgcgaacggatccactcggtcgccgaacagcgcgtgccggggcagggccgtcgggccggggaccggccggtgcatattggagtaccggaggcgctgtcaggtggcatggcgggggatgcactggtgagaggggcactcccacaccgtgttaccagtaatgaagaggagctgctctatatcatcagtgcatagtggagtccagtactattacttttcttggatttcgatgcttactgtacatagaggaatatgggaaatagtatttaacatttgatgaaatgttattttatgaaaatggctttttcttgcacgttactcacaccaaaagtgtcttatttcaactgtacataaaacgagttggagattaaataaagaatatttggcgagtaatttgatagctcaggctctgctctttttaatgaatctatattttgtcggatgggtttagatttcgggactatttgggttttttgtgggggactcatttagg

SEQ ID NO: 30871 - DNA, 1195 bp, Heterodera glycines
aaggggggcaaagaaaatcttttaaaaaaagaggttgccctaacttgggcccaggcctgaagttccctggttttccttggcctggcgctttattcagaaaaccaaagtccaagcttttttcaaagttcgactcttcaaaaaaaaacaattccatttggtaattatgcggagaaaagaaaaaagaaaagaagaacaaatatttatttggcggaataaaagaaatttgtttgaactgtgtgcccttttcggtgtcctccgccgcgtgcatacagtaggagcaaaatcgaaaaaccctatgtctttgtctctcttcccttttctctcttgcgctgcctgttccttcctctctgtctctctcgcactgtctctccccttaactttttctcttactgcctgttcatttatttttctctcactgcctctccctacacactctctctccctcactgtctgtctttttactttctctctctctcactgcctcccctttgctttctctctctctctcccgcactgtctctaccttcgttttctctctcttgcactgtctgttcctttctctctgtctctctctcactgcctccctctccctttgctctttctccctctcccactctgtcccattttctctctctctctaagttcaactaaaaaagagacaatgcaaacataaaacaaaaacagtgattggaatggtgtgccaaaattctttaaattttcccaataatttatttttccactccctgcagcacaccttcagcatttgaccgtttgaacgcactccgacaaaatcctgcaaaatgtacacactcatttaagaggacaacatttaaaattttgaaaaaaggaaaaacttacaattagcccatgactacagtatgcccctcaaatgccatccaaataccccccccccctcccctctggaccgcctcgactgctgacgcccactgttaagcgactgagtgcacttatttatgggggtaattagcgcgctaattgatgagactgaccaatttcgcctcgccacacccattgcagcgggcgtttgcacttcgcttccggcacgttgtgaatgcatgccatgcacacctcctcgataaggttagtctgaatgatgttcggaaacattgcgccgacgtccgacaagtggcaaatgtgcgggagttcggtgcgcaacggtcgctcaatgagtgtc

SEQ ID NO: 30872 - DNA, 1492 bp, Heterodera glycines
  misc_feature (1345)..(1345): n is a, c, g, or t
atttatttgatatctttcaaatattttatgggattttcttttaatttcgtataaaggtttatttggaaatgattacattgaaataagaaataattgcataacaaatatttgaataaattgtgatataatcaaaaattaatgaatgaataaatgaatattttagtggtttaaaaattatacaaatttgcttctttttccgtgaaccaaaaatgtaggaaaagaatcccactgaatatggggaagaagcaaaattaaaaattgaacaaaaaataattggcaaaaacattggaaattttgtcaaaaaagagacgaaaagtgaaaatattcaggaaaataacaggaaaaagataaaaatggaagaaaaagatgaagaaatgtcgcaaaaatttggtcagccacaaataaaatgggaggaaaaattttttaaataaactgaaatgcaaattaattattattaaataaaatttgaatttttcgttttaaaattaaaatttagagaaagattttggaggcgaaacaaataaaataagaagaataaccaatcgaaatgatggccaaaaaaagcaattagttgagcaatttgaggaaatgagaatgccttttcagcgcgcgggtgcccattcaacgagggaatggatgaaaattgagagagaaattgccgaaaagattggcacttcccttacatcaatttacagatggaaagcccaattgggcttgaccagtaagaaaatttgtatttaaaaaatgtaattaattaaactaaagaaagataaaacgctaattaatttattttaaaccagaaaaaaaacactgatgaaaacagacgcaaaattgtaaacaaatatatgaaactaaaaaaagtcatcgctggtaaacggagaagcaaatagtgcgcaaaaggggggaaaaatttcaaaagaattggcaattcataagagaccgattaaaaaatggaaagcaaaatttggactaaatgataatgattaaaaatacataaaaataataaattaattaatcaattgaaaagaaaaaacattttgcagagaaccgtcgttacaatgtacacaccagggatgggccaaattgaaaaataaaaagcgaaatgcgaaaagcgaaatttgcgaaactgaaaaatgcgaaatgaaaaaaaaagcgaaatgcgaaaagccaaaatatgcgaaaatgcgaaaagcgaaatgcgaaaagcgaaattttttctacaaatttttaatagttaaaatcataaagcaaaaatcatttttttaaattttattccaaatttaaaaatcaataaaacgctttattgaggcgcgctttttccaaaaaaactttttgggaagagggngcaaggccgcggccggcaggcgccgcccgggaattttttgaaaaattgattaaaaatttgattttgtgacagattttcaccaaaaaatcatcaaattttgtgatttttgtatcatttttctaatgagaaataagagttttggcgcgc

SEQ ID NO: 30873 - DNA, 767 bp, Heterodera glycines
  misc_feature (714)..(714): n is a, c, g, or t
tgcccctcgaggtgcgcgagcgaggagcggagcgaagcggagcgacgagcgagtgtaccgagtcaatacgaacctgatcaattcttttgcatgacgcgtagggtggggtgggggtgaacggctaggctaggctgttaccggtagctgctactgcacgaacatccagacacgcatctgcgcctgagctgctactgcactaacaacctgacgcatctaccccgttactggctacaactcgacgggatagcctcggctttctataaagcgcagccatctaccgggacgcctagttatctatatataaaaataacgggggggctaactgctttcgggtttgttggcaagcgaatatcgagagttgagtaacgagaccggtaccattcgaaagctctatcttttctgcacattttgagccgcggattgtaaaatgtcacaacacttttttttcgagaaaatcgcgtttgaacaaaaaaaacccggctttttacaattggccaaaaatgggttgtaaaatgtgtgttttcaccttatttctcaggaatcgtaagagctacgcttttgcggtaagcgaacaatttgtagagctcgtcgagctgaagggtgagaaaaaaattttgtagctctacgacaaattcgaacaaagttataccccggcaaaggtcgaaaaaagccgattttttttgtgagttcctcttccggtttccaatccgtttncaattgccttaaaggcggaatgtccggaatttcgaccgaccggatggattttg

SEQ ID NO: 30874 - DNA, 1346 bp, Heterodera glycines
tgatccgcctcaaattgacttgctcaaatgtccgtttccggcgcggtcgagaaatttttaattatccctaatccccccccccccccccttccatcaccccgccccagttcaaatttacaggaggggggagatgtgagggcaaaattttgcccgatgatggaatgtctgaaatgttttgtaaacccattcatcattaaacaatatttgtgatttttttcaattttcttgcctacgcaattttacgaaagacgctccaagcattttgcctgtgccgaagtacgtgttgcataaaatgtaaacaaatttaaattagtggtggtgggctatataataatttataaaaatgaataaattttctcgaaaaattgtttgttttttttctttatgatttaaaaaaacattacaaaaacctcaaaatttcaagaccgggcggcgtctttggatcatatttttcaaaaaaggctcagcaaataatgaaaaagtaaaaattttttaatcagtttaaaaaaaacaaggaaactgcatagaattttaaataattgaaatgaagttgaaattaattttgtaaaattctctaccaagatttttgtgttgaatttgcgtttttattatatttaatttgattcaaataattaaaatataaatcaaaaattacattattatctgcaaaaccctatctcgatcatttggtcccggtagcgatattgttagttatttattaagagagcaatttctccattttgccacttttgacgacatatttggataaaataccaattccaagcccagcaaattcattcaatgaaaagctatgggtgaatcggatagatcattaaattaaattttgaaataaattttaaattttctttcttttattttggcttaagaaggagacaggttcttatttttctataataaaaattttttgaaaaattgtttatttacttttttttttaaagttgttgatagggtgcaaagtagggcccggattcttagttttttaactgttttttctgcgcctttaactcgacgagaaatgcacgaaaaacacatttttagctcggaaattcttcgttttaacgccactattcatcactaggaatcactattttggagcttcgccactaaaaaaaactattttggaagttggccactaaaataattttttgccactattttggcgtttcgtcattatttttgccactattttggcatttttggaaactttaccaaaaaatgcaataaagaagaaaaattctccccaagaatcgacataaaaatttccaaaaatacacccttaagaattggaaaattttcacaaagaattcttccccacaatttttttt

SEQ ID NO: 30875 - DNA, 1120 bp, Heterodera glycines
  misc_feature (68)..(69): n is a, c, g, or t
  misc_feature (88)..(88): n is a, c, g, or t
ggtaatgaaaaaaattttgaagaggctctcgggacggattagcatcggggtacgagatagaaatgtcnntaaaaagagatagccattnttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaaggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggtgttacgagatagaatattgtcctaaaagagatagccatttttctgagaataattcaca

SEQ ID NO: 30876 - DNA, 1288 bp, Heterodera glycines
  misc_feature (54)..(54): n is a, c, g, or t
  misc_feature (88)..(88): n is a, c, g, or t
  misc_feature (116)..(116): n is a, c, g, or t
  misc_feature (119)..(119): n is a, c, g, or t
  misc_feature (147)..(147): n is a, c, g, or t
  misc_feature (223)..(223): n is a, c, g, or t
  misc_feature (239)..(239): n is a, c, g, or t
  misc_feature (251)..(251): n is a, c, g, or t
  misc_feature (373)..(373): n is a, c, g, or t
  misc_feature (380)..(380): n is a, c, g, or t
  misc_feature (387)..(389): n is a, c, g, or t
tgtttgccgctgtccgtctttgtcccgctgctttctcttgacgccgggagcggnaaaaacggcacccaaagcccgagtttatgaacgngccgaagcagaagcggaactgaacgganaancccacgagaagcaacaaccagacaaaancaacggctcaaacccaccacggaaaccgggcgaagaaagaaagcgcggcggaagacggcacaaaaacaaacgaggnaacagagaaacaaaanccagaaaaaggnacaaacaaaaaaaaaagaaaaaaaaaaccaaaaaaaacaaaacatatcaaaaaaagccaaaaaaaggggcaaaaaacaaacacaaaaagaaaaagcacagaacaaaaccccccgcagaaaanagaccanaaaagannncaaaaaaaggtcaaaaagagtgcaaaaaaaagaagaagcatcaaatgctttctttataaacacagctcccataaagtgccatcacttttttttgtttccaaatggttaaaggcgctgaaaagttgttggaattggtcggcccggtcggtcggtgtccatccaaccgacccatccgtccccgttaaattgacaccccggggcatgcaaaagcggcacaactgacaaatcccctgtggcatttgcccccggcgggcgtcaaaaacactcggcgccgccaaaagtggacggacaagcacacaaaaagctcatccattttttgtttgaaaccggtcagaagaagcgatattaacacagctaaacacagccgagaaaagaggggggaaagtgtaataagagtaatttaaaaatggaaaagatacatttaaattggatttcaggactaggaaaagtggataaccgaaagggataccggagataacaaaaactaatttttgatcgaaaaaccggcaaatccggcctaattgaaagctgaaaaccacgtcctaaaacaaaagacttaagtaaaaatgtcaaattgagaaaaatgccaaaaacattgaaagaaggcggaaagtcggaaaagaataattattaatggattttcattgaaaaagtcacgagcagcagaaaatggcggcactatcaaaagttggggaggaaagaaaatgaatggcaatgaataaaaaaggagggggaatagggaaaatggggaaagaaaagcaaaatggaaaaaagaaaaacaatgcaattttaatgtgaattaaagcattaaacagctagttgaatttaagaccatttaaattttattttcattttcatgccatttttctaaataattcaaagagaattttaattaattt

SEQ ID NO: 30877 - DNA, 1013 bp, Heterodera glycines
  misc_feature (8)..(8): n is a, c, g, or t
  misc_feature (82)..(82): n is a, c, g, or t
  misc_feature (117)..(117): n is a, c, g, or t
  misc_feature (1006)..(1007): n is a, c, g, or t
tggcgtgncagcgggagaagatgggtgttgttcaccatttggcggcgccggaggcgatggtggcggtgccacccgaacgcgngatggcatgcactgcaaaatttgtgatcgataatntaattcagttttttttttggaatttttaatagattactaagaaaatgtttcaatattttcattcagtttcctctttccccttttcgcgggtacgccagcgtacccggtacccattatggcatgcatgcacataatcaaggatctttcatttttcagggtttaaggggggagggcggtttttcagggagggtttgaaaaggcaatttttggcgttttatgtcacaatttttttttaaatatacaatcaagcggtttttttttgttgaaattttgcccggaacagggcccgggtaccctcgcttcaaaagcagcaaccatttaggcattcttatgtcattcttttttttgcccaccattttcggcagtggcgcaccccatttggtccggcgtcaatgttatactcagctcgtcggactgcagttcgcacaacaatttgtgcgcgtcgaccacccgttggagacgttcaagcgctgtccgaatgctgaccggaatgtacacaaacttcaacaacgctgggggcggctgctgctttaattgcaataaagactaacaatatgtatattattaattagctgccgattaggaatttggcgggtgagtaaatctttcagcgatttctttggaaaaattcttgaaaaaacttagtaatttatcgtaaattttgaaaaaatcgctccaaaaatccaggaagaactcactcctgttgaatcgtcaatgttagctgctgtatgaataccagacggggtggtgctgaacccgcacactgtggcgggccgttgctgtggcaatgactggctcaagttgttgttgctgttgtagttgttgatgctcgtgttctacactacctttacaagaattttaatcaatttttacccatttgacctgcagnngcatgc

SEQ ID NO: 30878 - DNA, 1204 bp, Heterodera glycines
  misc_feature (1198)..(1199): n is a, c, g, or t
aaatgaggagaagccatgtgcctgcccctgttcatgtcttcgtgccaaaaaattctaccgagtaattaaatcaaaaaacaaaatgaaaacaaataaagtggagaatttaattttgttaaagattgagtgtgacatgatgaaccgcactaccaaaaggtgggcaaatgccggccgtgttacgcttgggctgctctctgctccgctactgtttgttcccgggctaaatactctagttgttgagccacaactgcagttagtgggacaaggtactgtaacgatttgtgaggtgtttattattgcaattttaaaatatgttaggtttgctccatttgctgacattttggcatttttcggggataagttccccttccccgagtggtgccatccccgtccccgagtggtgccatccccttcccctagtggtgtcatccccttccccgagtggtgccatccccgaatccccccattcctccatcccatcaattgcatttttctgcacatggattctaagtaagtgccaagggtctggctacgcccttggcctcctcctcttcgtccctgttgttcttcaataccgtagtcatagaagtccatgaactcgagaagcacatcgtcctgctgaaatgttttattgaaaatatacgtggaaaacggaaattgccttatgtagtctgataaaggagtgacttttgctacgctaagcttaataccttatgtgtctgacaaaccaccaaacgattatttttaatctttcgccccctatcccaccgttccacccgcccccggatgtcccccacccatatcatttgaaattttcaaaaaaatttcagcagttttttgggaatatttttcgaaaaaacttgcaattcatcataaaattttgaaatcgtgagaaattatgtataattattttcttgaaattataagtttccttattttttgaaaaattcctaaaattttaaaaaaagttcgagagtttataaaatatttaattaagctttcgattccatccccgtgcgcaagcaaatttggagcagttcgtttcccccctgttttaattcagaaattggttaatcgactcttggcccgggttattgtgaaatttctacgcctattaaagttgcactttcaaaagcagaggataggagcacagaaaacatcgaaaatttaatgaattccacccaactttccaaaaaanntatat

SEQ ID NO: 30879 - DNA, 1528 bp, Heterodera glycines
aaattctgtttacacaatgttcagtagtttgaataaaagcatcttcatcatttatttgtggaagagttccctgtaaaaattatcatattatcggtttattattaactcacttcatagtcgtttcatgcttttagcagttgttcatctaacattcataattagtagttaaggaattttcggccaatctgtactctatcggcttgttcggctttaacgttttctaacctttatggtttacattttttattaactcatactttgttagttcgtccacactcatactttttaagcttcgcccacactcatacttttttagcttcgtcatagcaccgaaaaataagggtgagagtgagagtaaagtgaatgagtcaaatgaacagaaagacaaaggaagggagagagagaagagagaaggaggaaaaaagagagagaatgaggtgaggagaggagagaagggtaaaaagatagagagagagagagtgcgcgagagagaaagaaagatggggaaagagagagagagcaagaaagatggggagaagagagagagagagagacggagagtgagagagagatggggggagagagaaagagagagagatacagtgaggtgagaagagagaaaaggaggaaaagaaagagagagtgaggtgaggagaggagagaagaggaaaaaatagagagagtgcgcgtaggagcgagagagaatgaggtaagaagagaagagaaaaagaggaaaaaggagagagagacggagagagagaaagatggggaaagatagagagcaagagagatggggagaagagaaagagagagaaaatggagagtgagagaatgaggtgagaaaagagagagaaagtgtgtggttaggagagaagagagaaaaggaggaaaaaaggagagagagagaaacagttagttgaggagagaaaaaagggggaaaagagagagagagacggagagtgagagagatggggagaagagaaagatagagagaaaatggagagagagagaatgaggtgagaaaagagagagagcgttaggtgaagagagaaaaggaggaaaagagagagtgtgagagagagagagatacagtgagtgaggtgaggagagagaaaagtgggaaaagagagagagagacggagagtgagagagatggggagaagagaaagatagagagaaaatggagagagagagaatgaggtgagaaaatagagagagcgttaggtgaagagagaaaaggaggaaaagagagagtgtgagagagagagagatacagtgagtgaggtgaggagagagaaaaaaagtgggaaaagagagagagagagacggagattgagagagagatgggaagagagagacatacagtgaggtgaggagacagacggagagagtgtaaggtgaggagagaagagagaaacggaggaaaagagagagagtgagagagagagaaagagagatacagtgaggtgaggagagaaggaggaatcgagaaagatcgagagacggagagagagaaagatggggaaag

SEQ ID NO: 30880 - DNA, 1640 bp, Heterodera glycines
ctcgccttttagcgggggcggaaaatgcttcttcttctgttgctgcttctgctgttgttgttcgtgctgttgttggagtgtgtgtgtgttacatggcaataagccttggacagacaacggcggacggggacgcgacgacgcaaaagaaaaagcatccattcattcattccgaaattccaatcacccgggggcatctctatctatctcatccacccgccacattcacccactgtccatgattgaagaaatggaagggatatatcgatatcgatgttcattcgtcctccggctgatcggatggggggggaatacggacacaactcagcagtctttcccggctcgaccctactgtctgcgttcccatccaaggaattttcaattttatgcttttacattattatatcggagattgagattcattaatcaggcattgattttgattttttagaacctaaaaattgcaaaaaacggcgtgtaatagaattacactccaaaaaatccaaaattttgtttattctgtattattgttgcacaacaattcacaattggaatatttgtagaattctgactttttcggaaatataaatttcgacaattgtcgattgtttcattttaaaaaaaagttaatttttaatggatatatttttcaaaaatttggtcgtttattgtggaggatatattttatttttatttgagtaaatcagtaaaaaaaaatctaatcccaagtcatgaaaggatcatctttttagtctttatactgtatcacaaaatatcctattaaagttcacaaacccacaataactactgtataccgtacatattgtcgttgttcattgttttcctatctctagaaaagggttagtgaatggatttgtttgcaatttggagacaattaaatagaaattgataagcaatgttaaagtaatccatgtgctttttcctgggatgaattgtcctatggccaattccgatcaatcgatttaaacacattttcgtttctcttctgtcatttgtttggccaatgttatgtgtatttatctatttgtttatctatctatattcatccattaagccaatcacttttccctccagcagcagcagcagaggcaagggaaaagctgccgtccttaaaccacacaatttcaaagccaaaaaacaaaaacaacaaagtagcaaattgacaaactgagacaagcaacaaagcaatttaaaaaattaattcataaatggcccagcaacagcaacaacaacaacaaccggcggcacaacaaccggcggcagagcaacaagaacaaggattttggtcagaaactaaaaaaaacaaaattttttttttgaaacgattaaatccgtgctgagccgaaccttaaaaaagcatcaatgacattaatatttatatttaattaaaattttatttgaactctgttttcaaataaatttgattaattttgagcacttttaattattcttctgcaaataaaataaaattaaatattactatcattagagcccggatttttaggtttttacctattttttgcggctttgttatgatgagagaagcccaaaaatagcattttctccgaacaattttcgattcagagcgactttttaacacctataaattacctaaaactgga

SEQ ID NO: 30881 - DNA, 1593 bp, Heterodera glycines
  misc_feature (26)..(26): n is a, c, g, or t
gatgaagtcgtcgtgccgcaaccacncggcaattcgccctcacggtacaaaaatcctctttaaaggctcgtcatcagtctctataatgaattttctaccgtacaaatactgtttgaacttctccacgccaaagattactgcgcgtttttcttttttgatctgcgcataatttctttcggctggactcaatgttcttgaagcgtaagcgatcacgccaaactttccagtgtttccatcttgtgcaaaagaatcgctcaaacttcgtcgtcaaatgcatccgttgccaaataaagtgactttttgggattaaaatgggccaacagttcgttcgacgacaacatcattttgtctgctcgaatgctttttgctattgttgtccccaatgccattttctctctgatcgacgtaactcgttcaatggcttcgaaattgttgccattgacggaatgaatttgccataatacccaaccattcccaaaaaggatggcaactccttaaaattttgggggactggcattttctgaatggcttccaccttttccggcgacgtttgaatccgttctttgtcgatgatgtgccccaaataagctatttggttttgcataaaggaacatttttcctttttgacacgcaatccaaatttttggatgcgttcacatcttccatcacttgttggaatattgctgccgctgacgcaacaccataaggcatacgcataaattggtataggcctttatgcgtgcaaatggtcagacattcattggctttattgtccaacattagttaaagatacgcctccttcaaatccagctttgaaaacttttcgcctccattcaatacgctgaacaattcttccgggcgcggcaacgggtattgatggatgtcaagccattggttcacagtgactttgtagtcgcaacacaagcgaattttgttcccggcttttggtataatcacaacgatgttgcccaatcggaagttgtcacctgctccaacactccatctttgacccacttgtcgatgactttctccacttcgggtctcaatgcaaaaggcacgggacgcggtttgcacttcttcgattgcacttccggcttaaatttcagcgaaatttgccttgtgcatcggccgagtccgtcattgaagacctcaccgtactttagaagcaccgcttccagctctcgatccactgccttgcacttgacttcattgatcgatcggattccgaacgctttgttgagatcgatttgcaattcaccaatcaaatctctcccacacaaattttttccttcgccgtcaacgacataaatttcggcattcacttctttgccgttgtacaccacatccgttttgaacgatccaaggactttgatcggcttttttccatatgccatcaatcctgaagtttgtccaagtttcggccttccgatggacatccaatcattcttggtgatgagtgtgacatctgcgccacagtccaattcgaaatctgtcgcctttttactcagctgaagttttatcatcgctggtggcaccgaaatcgatttgacttcttcagacttggccagtgttccaatgtcgtgtgccttttgg

SEQ ID NO: 30882 - DNA, 2437 bp, Heterodera glycines
  misc_feature (1467)..(1467): n is a, c, g, or t
  misc_feature (1485)..(1486): n is a, c, g, or t
  misc_feature (1505)..(1505): n is a, c, g, or t
  misc_feature (1553)..(1553): n is a, c, g, or t
  misc_feature (1559)..(1559): n is a, c, g, or t
  misc_feature (1573)..(1573): n is a, c, g, or t
gctggctgattgtgagctgaagccttcccgaaaactcgataaccaatgccgacaatgcaactcaattcgaaaattttcgaaacttaaagtgatcagaaaatggatcagtgaaaaatgtgtcagtgaatcagaaattctcaaaaaaatgagacacggttaaaatgatgatttgaaatttaggcgttaagtgatttgggaacaagcatacaataatccaattacatacagtatgtttgtcttaggagtttggtcaaatttttttttaaattttttgaatggtttgaaaaaatgaattgacgaattcagaccgagattcttatataattttgacctttgtactacaatacttatgcgacagaacgtgatattttaaaaataattaccctgacgcattgagtcaaatcataatgcggtagaattaaacagaaatatcactccccacccaccagtgcgggcgaaaactttgtttttttcctctttgcaaaggtttttcaaaaatttttgagttggaaaatattacgttaatgcttgtgatggggtgctgccaaaaaatagtcaaaattttgattgttttatttgtttataaaaaatgctaaaattttcagaaatttcctttttttcccatacaaattttcggagggttgtcccatcaaatcactttatccctgcctatatgccctttttaaatgcctgtgaatttcagttggcttcgcttgaaagttggcttcattcggttgctggccatgtgctgtcaaagcccatcactttgaatccaaccgctgctgaaacaaatgaatttttaatgcatttgcgccgcttttcaaacgaaataacagtaaataaatgttacaagaatttatccaggaaatttgaaatttttttaaatcctacgcaattttcattactaattgaccaaaaaattactaaattttccccggttgaacttaacggcaccgcccaacccaattttttccaaaattttatcccaaaacggccaaaatttgtcgaaactggctaaaattttctatttttttcacacggcaccaacaaatctgaaaaattacaatggatgaaaattttttgaaatctcttcgggtacctctaccgaattttttttttctggtcagggcctggttacagcaatggtattccaatttcgatcacaattcactaattaacgactaattatcccactaattggtgtcaatatacagtacaaagagcaacaattgcgctcgctggtttcaagccaacaaaaatcgcaacattttgtgccagcggaggagcaacggttggacgccctgcacgcgggcataagtcgaattcggcaaattgttgaacaaagattgcaaattgggcaaacaatggaacaggtgaaaaagtcaataaattgattttaaattttaattaaaatttatttttatgataaaaattatatttaaatgtgatattcattttttataattnaaatttttctttaatatnnaattaattatttttaatanttgatactcgtgaaattttgttattatgtattttttttatttatttcntatttnaatatatttaattnttcctaattttgtaaaacaaaaaataatctttcaaatttacataaactttttttttatttgtcatttttgcaatattaaataaaactgttttggttataataataatttattttattttttaatataaattatttcttggacatttatttgaagaaatttcttatatttatttaggttcgattttgacatttttacaattaaaaataaaaataatagcaaagttttatttgaagttgcaaaaattgagccgcgaattggacacttcacttcactttctcagcactttgtttaaaagtgaaagtgccaaaattgaatcagaggaacaatgccaaaagcaatttgaacaaatgcgcaatttgttgcagcaagccaacgaacacatttatcgggaaagacaccaaagtgatgatgataattaacatcaaataactcgagaatcctgaatgcctagcaataccaaattttgaggaagtttataagtgtccaaaaaatatttaccgaattaaaaaaaaacggtgccataacacccaaacgatacaatcctcaattttttaggccatgctttttttcttacttgatcaatccacatattcttaggtaatatgaaagcttgaagcctacacaaattttttcctttattttattttattttagaaaatattttctattttcgactcatattcccaacatattccagggtagccaaattcttatggaaatgccaattcaattcatgttaaatttaaaccctataaccatctgagctttgtgaaaaataaaattcaaattctccaataaattttttcttttcagccgataaactgatttcgctggcaaattcggctaatggcacggatgcttgt

SEQ ID NO: 30883 - DNA, 1106 bp, Heterodera glycines
  misc_feature (1015)..(1015): n is a, c, g, or t
  misc_feature (1044)..(1044): n is a, c, g, or t
tgttaattgctttttgacccttattcatattttaataataaattagaacttaattttacctaattcatcagacctaaggttctaaaataaacgaaattaattttatattgtcgaaaggacattaatttcagcgaattatttcatagttgttgcacaagtctataacaaactattttgcatgctttctaaaggataaaatattactagtttttgctccaagtttatatagggctaattgtatcgcgagcgaatagcctaatggcgaaacctgcataattaaacgaagcaagtagtaacagaaaagcttcgttgattctgagaggcgaatctcgccaaggattatcgtcctcttttttgcccttggaccattcggggttgtagtgcagaaagaaacaattgcgatttaccacctgttaattgctttttgacccttattaataattttaataataaattagaacttaattttacctaattcatcagaacctaaggttctaaaataaacgaaattaattttatattgtcgaaaggacattaatttcagcgaattatttcatagttgttgcacaagtctataacaaactattttgcatgctttctaaaggataaaatattactagtttttgctccaagattctatagggctaattgtatcgcgagcgaatagcctaatggcgaaacctgcataactaaacgaagcaagtagtaacagaaaagcttcgttgattctgagaggcgaatttcgccaaggattatcgtcctcttttttgcccttgcaccattcggggttgtagtgcagaaagaaacaattgcgatttaccacctgttaattgctttttgacccttattcataattttaataataaattagaacttaattttacctaattcatcagaacctaaggttctaaaataaacgaaattaattttatattgtcgaaaggacattaatttcagcgaattatttcatagttgttgcacaagtctataacaaactattttgcatgctttctanaggataaaatattactagtttttgctccnagtttatatagggctaattgtatcgcgagcgaatagcctaatggcgaaacctgcataattaa

SEQ ID NO: 30884 - DNA, 1323 bp, Heterodera glycines
cctcttctaatctctgttgtacctcttctaatcgctgttgtacctcttctaatcaccgttgtacctcttctaatcacagttgtacctcttctaatcaccgttgtacctcttttaatcactgttatacctcttttaatgacttttgtacgtcttttaatcactgttgcacctcttctaatcagatttgtaccccttctaataatgctgtacctcttttaattgctgttgtacctcttctaatcactgttgtacctcttctaatcaccgttgtacctcttttaatgacttttgtacctcttttaatcactgttgtacctcttttaatgacttttgtacgtcttttaatcactgttgcacctcttctaatcagatttgtaccccttctaataatgctgtacctcttttaattgctgttgtacctcttttaattgctgttgtacctcttctaatcactgttgtacctcttctaatgacttttgtatctcttctaatcactgttgtaccacttctaatcactgttgaacctcttctaatcactcttctaatagctgttgtacctcttctaatctctgttgtacctcttctaatcgctgttgtacctcttctaatcaccgttgtacctcttctaatcacagttgtacctcttctaatcaccgttgtacctcttttaatcactgttgtacctctttaattgaatcaaatgggcaatttgacataccccaaaataaaatcccaatctgtaatgcagtatctaaaagaatatttttcagataatagaaatcgtctatgatacaataaaataaaaataatgctttgaattcataatttttgttcttttgaaaagttttgttaaaataaaagtcgcttttaccgagaagtctgagtaaacagtaactgattcattcttattctcatggtgggctcaaatagaattggattggggcaaagacgtctttttgtgtaggctggttcgctagttcagcaaaaatattcaaagcccaggatatcgctacaaattatatatactctaaagcagcgaataaacaaggagagtcatcctgtcttcgaatgggacatacattaagcataatcgaaatcagaaaggccattgtcgccaaaacagaaataccagactcataagacgactccacctcttcaactcttccgatcgccgtattcccgtcaatttgaactcaaatttgaaatttggcagacaattttcccattttcgacttttccaatcgattgatccactctaactgctttttcggcaggcactggacatcttagcacgtcctggccattccatttttcatcgacctc

SEQ ID NO: 30885 - DNA, 1986 bp, Heterodera glycines
  misc_feature (7)..(7): n is a, c, g, or t
  misc_feature (28)..(28): n is a, c, g, or t
  misc_feature (91)..(91): n is a, c, g, or t
gcaattntaaaatttactaattcctccnctaatgcggcatttatttcccacattaaggattttacttccattattttcccacccaaggccngtagtaaccaggggcgcaggccatggggggcaattgcctcgtgaaatgaaaaattattatttttttttttttgcagaaaaaagggtttttttttaaatttatacttaacgattttcccgttttcccacggcgccaaaaatttagaaaaatatcattgaacaaaaaattattgggcccgaaacgcaaaaaaaaaaaaaggatcttcgggtgccgctcgcaaattattttctcattacgggcatggtcccaactcattgcttaattaatttattaagcactcttaggcatttattccccacattaatgatgttccaaaaatacatatagataagaatgaaaagctgtaatatattaattagtaaactaaaaaaatattcatttaaaatgatttaattatatttttgcttttttttgttaatatgcaaatttaaaattattaaatgtgcattttttgggtgggcaaaatctttaacaaattcgggaaaaattcccaatcatttgttaggaaatttaaaaagtaaatttaaaaagtgcttttaatttttgttttttttattagtttttgcaaaattcaatttaagaaaacatttagaaaaaaatctcgattgattagagtcccggtctcggggttcaaagtttgggtctcgggaaatttctgtctcgaacaacatgctttcgaaggtaattgagaccaaatcgaaattagaaaatgtgaataggaaagaccattaacaattagccttatttaacgtaattacttacatttattagcatatccctctgaagcccccgcccccttttggtgtcattacaattcgtaaaacttgccctttgtgcagctcagcacgaaacaatggtgctcattttcttggcactttttgtcctcataatcttcgtaaatgtgctttacagggtgcgactcaaaccgtgcctttttgcatctgagaaattcgtcatgagttgtcgtggttgtcgtcgtggttgtggtgtcgttaggtgtcgttgatgctttcttggtctacactatatcatgctatgtgctttagagcccaaacgaaaatcaagtgtatgcaaatgtgcttcttattgctgtggttaagatatcatttatgtcgtaaaatactaatagtcttatgaaacttataaaaactattcttcgacggtcgacttctatgtgaatttttattttaggggggattttgctccttcaaaagtaacggggctcaaaatggcaatttctttgccccgggccctttcccaaaaggaaaagatcaaaaagaatgcccggtggttaaaaagggtttttttaaaaatttttccagggaaaaaacttttttatttttaaacccggggaaaaaaagccccccccccccactttttttttcccccttttttgtccccccttttttggcaaaaggaatttaaaagctcccccggggggggggggagggtttttcccaaaacccttttaccccacaggggaaaaaaatttttttttaggggggggggaagtgggggggggggcaaaaacccgcgggcccttttttttttaaaaaaaaaaccccccccccgccttgttttcccccctcgggggaaaattttttttttttttattctccacaaaaaaaaaaaaaaaaaaaaaagggggggggcccccctccccccccccccccccacttaatttttttttaaaaaaaaaaaaaaaaacaatctttcctctttctaataaaaaaaaaaaaaaaaaaaaaaaaaaaaaaaatagaaaataatattttttttttttttttttttttttttgggggggggggggggggcgggcttttttttttttttttttttttttttttttttttttttttttaaaaaaaaaaaaaaaaaaaaaaaaaaaaaaaaaa

SEQ ID NO: 30886 - DNA, 1107 bp, Heterodera glycines
  misc_feature (25)..(25): n is a, c, g, or t
tttttgagagaaattttgcatcganacaaatgctttgcagcatgagtagaggggcgggagagcaatggccattttattgttccgagaatttttaattttcaaagattaggccagaaaagtggctcctcttttttgagagaaattttgcatcgaacaaatgctctgcagcatgagcagaggggcggagagcaatggccattttattgttccgagaatttttaaatttcaagattaggccagaaaagtggctcctcttttttgagagaaattttgcatcgaacaaatgctctgcagcatgagcagaggggcggagagcaatggccattttattgttccgagaatttttaaatttcacgattaggccagaaaagtggctcctcttttttgagagaaattttgcatcgaacaaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagtagaggggcggagagcaatggccattttattgttcagagaatttttaaatttcaagattaggccagaaaagtggctcctctttttgagagaaatttgcatcgaacaaatgctctgcagcatgagcagaggggcggagagcaatggccattttattgttccgagaatttttaaatttc

SEQ ID NO: 30887 - DNA, 1220 bp, Heterodera glycines
tgcaggtcgaaaaaagaaaaatatataaaatattataaacctaattaaaaaaaattaactttaattaaatatatttatcaataaaaataaataagtattattaaattcatcaaagcacacctaaaacgacactacaacaagattggagttcaaatattaatcaatctaataaaaatgcaattgatataataattatttaaagaaatttaagtattaaacagcgcctatcggagtgaaccaaaattcaactttaatagactttgttaccgagaggatttcggggacgctgaccatagtttcaccaattgaatttctaaattaaatttatcaaaattattaaatgtcaaaatttgaatttcgttttttttgtttgtttgatacaacttttaaattaataaataatttaaattatatattattttaaaaagttgaattaagcaaattccaatcttaaaaaataaaaattccattaaataaaacaaaatgacaagaaaaaaaattgactgacaagtgagtagcacatattattttaaagtgaatcaaaaaataaaatagattaatacataatattattctttagaattaaaattagaaattttttagaataccaaagcattttgcattagaaaggcaatatttttgtaaataaaacttcaataaaaatgatggtaattgtaaaaatatatgattcattaaacattgatttgtacaaaatttaagtataaagatttaaaattttaaggaaatagcacaagaaaattttcttttgaaaataaaatgcatccgaaaattcattgatgaaggtaaaaactcttagaacaaataaataagctgcttaaatctcaataaaaaatgaaaataaataatgagacaaaattctaatcaattaaagaaatgaaaaacattcccaaaactctcttacccaccaaattgaatgtggtgcaaaaaatacaagtaaaaaatgggatacaattctatgaattaaagaaatgaaaactatcatttgaatgcattttcttgttaaaaagaatatggaaaacataaaagtaaaatttgataaaaattttaagaaaaaaatagttttgaagcatgggtgagatcacgaaaaataatttttagttttttttaatattttcaaaagataataaattaacagaaaaaataaaaattaatggaattgaaaaaaagagaaaattattcatacggacaaaacctaaata

SEQ ID NO: 30888 - DNA, 1030 bp, Heterodera glycines
tttctcctcattcattttgttcatttgacaatgacttgctttggcaaagagattcatttcggcgtgcaaatagtaattggtgtcctcataagaaggccgcggctgcacttggttaagcattgaccaattcatcacccaaccggagaagagaccgcccatgacggccatcagaaaagtcagtgccaacccggcaagttggaagaatgctgcagaggggaggggtgccaattgacggggattgtgccggatccgcttgcccccctcccctcctctcccattttctcaccctgcgtgcgcaaatcgcgggtggcaccgggagccgcagctcccttcctaaattgtgagatattggcctcaatgcattggcatttccttgccatttggggtaaatggcactgtactgctccacaaagttctctccgtactcttccggttcatagagaagtacaaaaagtgcactaaggaactgagaatgggaagaaggaaaaatggtcaagaaaagcgagtggagtaaaaaattggccatttgggacgccggtggcatgacaattcgtacatatcgtaactcgtataagatttttaattaaaaaacatttaaaaatgttatacgaattgccattaactcttaccccggcgagaagcgaaggaaggccatggagagagtgggcgccgcaagtgtcgttgatggagaggcgcttttccaggatttttggctgaatgttgtttgttctatgtggtcattttgcttcattgtcttgccattattaatgacaaaatgaccaccctgacagtaatataccgtaccgtaccgtcacataaacatggccaagcacagaagttaaagcggcagctgcaccaacgataatggcatggtgcgggtaaaggatcacattggcaacggcaccaattgctattcccccggccaaagaagagctttggatgtgtgccatattggagcggccgaggtggtcggccagggaggagagcagaaaaagggagtggtgcaagcagcctgaagaaagtcgggcaa

SEQ ID NO: 30889 - DNA, 1031 bp, Heterodera glycines
  misc_feature (187)..(187): n is a, c, g, or t
aagctgcttcaggcgctctcagaaaacagtaaaacgctcctatttcagcactagcgctgagatatatcactgactttctgcatataatgcattctccgcagcaaacttcgcgttctcaagcgtgaatagttaattttttgtgctgaactgtgttagggttctccttgcagtgcgctcaactaagtcntcttggagttagagcatttttcatggtattttcaagaaaattgtgcaatgtgggcgacccggaacattttagacagtttccaaaccaaaccactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattt

SEQ ID NO: 30890 - DNA, 1016 bp, Heterodera glycines
agcaacaaagcactttgatctgtgccggtttgcctctgttcaaaagttcggacgacgcgagcgatttgcgcattcaaatggcactcatccaattcattctttcgctgggttcaatttacagggattgaacggccaccaaacaatacgaagggattgggagttccctcccaagcacatttttaataaattggatgaattattcaatcgtttcttcaatagatattatttattgtagtatttgaggagccacacttttgtttaaattgacgtgataaatatttcgatgccaatccttcatgagaattgcgcagtttcttcccaacaaaacgagaagaaaaactaaaataaaatgccggctttgtttcaactcctctgcctctctgagttcagtttatttgtcagtttttgctctttctcagacggttcctcagcaaatgggaaaacaaaatgaaccaaagataattcgaattattcttattttattattttccattttttcacatctcaaacttaattttggcatctccgatctgcttcctttaattagttttgtgctttgaattcacagtacagttggtcgtgtcttctgattttgaagcggtgcatttgcatattatccgattatttacctgaattataaaaccctttaaaatgggtttgttggcactctctccccgcgtttttgcaaatgcttcgcattttccgttaattgcccatcaattaaattcaaattccttttgccccttacttcgtccctttttgtctgtcacttattcgttttttgcttttctcttatgcccattggttttgtaaagtgttaattttctccctctgctgctgatgcgttgggtttggtctattaaatatttattttgtttaattacctttgccccccccccctaattgccccttaaatgtttggccacccccttaatttccttgccattttctcttcttaatcaaaaatgtctttgctgatccgcgctcgtcctttctctccattaattgtcctctct

SEQ ID NO: 30891 - DNA, 1135 bp, Heterodera glycines
agtgcttagtgatggactagcgagtgatgtccgtagaataaaagccaaggcgtggctgcgtcctgtccactatttccctagtgcttagtgatggactagcgagtggtgtccgtaagaataaaagccaaggcgtggctgcgtcctgtccaacaatttcctagtgcttagtgatggactagcgagtgatgtccgtaggaataaaagccaaagcgtggctgcgtcccgtccaacaatttcctaatgcttagtgatggactagcgagtggtgtccgtaggaataaaagccaaagcgtggctgcgtcctgtccaacaattccctagtgcttagtgatggactagcgagtggtgtccgtaagaataaaagccaaggcgtggctgcgtcctgtccaactattccctagtgcttagtgatggactagcgagtggtgtccgtaggaataaaagccaaggcgtggctgcgtcctgtccaactattccctagtgcttagtgatggactagcgagtgatgtccgtaggaataaaagccaaggcgtggctgcgtcctgtccaactattccctagtgcttagtgatggactagcgagtggtgtccgtaggaataaaagccaaggcgtggctgcgtcctgtccaactattccctagtgcttagtgatggactagcgagtggtgtccgtaggaataaaagccaaggcgtggctgcgtcctgtccaactattccctagtgcttagtgatggactagcgagtggtgtccgtaggaataaaagccaaggcgtggctgcgtcctgtccaactattccctagtgcttagtgatggactagcgagtggtgtccgtaggaataaaagccaaggcgtggctgcgtcctgtccaactattccctagtgcttagtgatggactagcgagtggtgtccgtaagaataaaagccaaagcgtggctgcgtcctgtccaactattccctaatgcttagtgatggactagcgagtggtgtccgtaggaataaaagccaaggcgtggctgcgtcccgtccaactattccctagtgcttagtgatggactagcgagtggtgtccgtaggaataaaagccaaggcgtggctgcgtcctgtccacctattccctagtgcttagtgatgga

SEQ ID NO: 30892 - DNA, 1329 bp, Heterodera glycines
cgtgcaaaacagctaatttttatttatttttatttgatttgatttaattaaatttattttattttattttaatttattttattttattttggtttattttattttaatttaatttattttatcttattttattttattttaatttattttattttaatttattttattttattttattttattttggtttatttcattttaatttaatttaatttaatttaatttaatttaatttatttaattttattttattttattttattttatcttattttattttatcttattttattttattttaatttaatttaatttaatttaatttattttattttaatttaatttaatttaatttattttattttattttattttattttattttatcttattttatcttattttatttatttatttatttttttatattttcagaacaattctgacgttttccagaattttcagaactgttctggtgtgtttcagaattagcagaactattcggacgcttaccagaattttcagaactgttctggtctgtaacagaattatcagaattattctgaagcattccggaacaatcagaaaaattctggtgtttaaattgtaaaaattgaatgcaaaaacacaaagcaaaacacaaggcaaaaattgtaaaattattcgaaaacacatggtaacatgttgaaacacacgttaatgtattgaaaacacacgtgaaatgtcgaaaacgcaagcaaacgtgtcgaaaatacacgtaaatgtgaagaaaacacgtgaaaaaccggaaccggtttaaagaacgcacgtcgaaaacacatgtaaaccggttgaaaacacatgcaaaaacacaaaatccatccggtcggtcggaattccggacattccggatgaatttacaattgtaaacggattgtaaaccggaaggcgaaaacacaaaaaaatttggcttttttcgacctttgccggggtataactttgttcgaatttgtcgtagagctacgaaattttttttctcacccttcctctcgacgagctctacaaattgttcgcttaccgcaaaagcgtagctctgacgggtcccgagaagtaaggggaaaacacacattttacaacccatttttggccagttgtaaaaagccgggttttttttctttaacctcgatttaaaaaaaacttttgctggtgcgaattttttccacacggttagaattgtagagaaaaccgagctctttcgaatggtaccggtctcggtgctcaactctcgatattcgcttgcggccaggtcgttttgtggctagcccccccgttattgttatatatagataa

SEQ ID NO: 30893 - DNA, 1826 bp, Heterodera glycines
agtcaaaaaaataattaatttaaacttataaaatttatttatcaaaaaaaaaattaaattaaatataattttttatttattaactcaacaaaatattttaaattaattaaaatcattgaaaataacgtaaaaatgcacaaaaaaataatgttacaccgtccggatccgaacctgcccccccccctcagaacatgtcccagaatccccaatcacacagggattctgaggtctaacgatgtcaaaagtaaaatctgatcacgtattcgtgatcagcggcccaaataacccctaaagacatatttttggaagatttttgtgagaaaaatttttccactcaaaaatcctatgctcacccctttgtgattagaagaggtacaacagtaaatagaagaggtacaacagcgattagaagagtgattagaagaggttcaacagtgattagaagagtgattagaagaggtacaacagtgattaaaagatgtacaacagtaaatagaagaggtacaacagttattagaagaggttcaacagcgattagaagagtgtttagaacaggttcagccgtgattagaagaggtacaacagtaaatagaagaggtacaacagcgattagaagagtgattagaagaggttcaacagtgattataagaggtacaacagtgattataagaggtacaacagtgattataagaggtgcaacagtgattagaagaggtacaacagtgattaaaagagagaagtaggtacaacaaatggcagaagaggtacaaaaatgcattaataattttttaaaattgtaaaataaatgcctctttttattattaaaaaaactttgaagtttataataattgaaatgaaattaatttctgaaaaactcaaataaaaaaaaatatataaaattatttaattaaaaaaataattaattttaataaaatttttcataaaaaaaataatttaatttaaattaaaaaatttattttttattataaagcaaacactcttttaaatgaattaaaaacattaaaaataaccataaatataacgaaaataatttacaccgtccggatccgaacctgccccccccccctcaaaatgatgcctcagaatccccaatcacacagggattctgaggtcttgactatgtcaaaagtaaaatctgatcacgtattcgtgatcagcggcccaaataacccctaaagacatatttttggaagaattttgtgaaaaaaaaattttccactcaaaaatcctgtcacccccctttggtcccgaatcccaaaatcacttttatttttgtatctttttttaaaaatgtgataaaaatgtaaaataaaatttatattatagagaaaaaaattgcggatttttgtagtattttacttttcccgaatagcttttcagaaggcagctacaaatttttttctgaaaaatcgaaaatttccagaaattctggaataacttttttcttttttgtgataaaaaactcaaataaatcccataaaattctccttatttttctctatttttaaagctttattatagttaaatcgatgaaaccatcaccgagttatgaattttccaatattcgcccaaattccagagggtcaaaaaattgccaaaaaataaaaaatttttaaaaaattccaaaaattgctaaacttaaaacgaacatcagattcgtgctcagcaccttaaaaatacccagaaaaaaatttttcacccccattttcgtccgaaaaaaaatttaggaaaatttctagggggcctggctcgaaaatttttgaaaaatgcacgacctatcctacaccattcgatagagcttcaaa

SEQ ID NO: 30894 - DNA, 1031 bp, Heterodera glycines
agcacgggtgacacgcatgcacattccaactgagcacgggtgccacgcatgcacattctccaagccctcgctttccgactgctcacgggtgcacgcatgcccattccaactgagcacgggtgccacgcatcgccaagccctcgggttccaactgttcacgggtgccacgcatgcccattcgccaagcctcgggttccaactgttcacgggtgccacgcatgcccattccaactgttcacgggtgccacgcatgcccattcgccaagccctcgggttccaactgttcacgggtgccacgcatgcccattcgccaagcctcgggttccaactgagcacgggtgccacgcatgcccattccaactgagcacgggtgccacgcatgcccattccaactgctcacgggtgccacgcatgcccataaaccaagccctcgggttccaactgctcacgggtgccacgcatgcccattccaactgctcacgggtgccacgcatgcccattcgccaagccctcgggttccaactgagcacgggtgccacgcatgcccattccaactgagcacgggtgccacgcatgcccattcgccaagccctcgctttccgactgctcacgggtgccacgcatacccattccaactgttcacgggtgccacgcatgcccattcgccaagcctcgggttccaactgttcacgggtgcacgcatgcccattccaactgctcacgggtgccacgcatgcccattcgccaagcctcgggttccaactgttcacgggtgccacgcatgcccattcgccaagccctcgggttccaactgttcacgggtgcacgcatgcccattccaactgagcacgggtgccacgcatgcccattccaactgctcacgggtgccacgcatgcccataaaccaagccctcgggttccaactgctcacgggtgccacgcatgcccattccaactgctcacgggtgccacgcatgcccattcgccaagccctcgggttcccactgctcacgggcgccacgcatgcccat

SEQ ID NO: 30895 - DNA, 1250 bp, Heterodera glycines
ccccccccccctctgcctacgccctttattttgggcaaaacttgtctaatattgaaaaaataaaaaaataaattgacagtcttctattaaccaaaaatagatattaataattgaattaaaaaagattgcgtaaacccaaaaaagagtaaattttcaaaaaagaaacacggccattattaaaagttttaccagtccgtcacctttttttttattttattttttatttaaatgttttaacattacttttatgccttttgttgaccatattctaaacaatatttaattattgaattgtttattcaatttttttttcttgcctaaatttcaggtcaatgctcgaaggtcccatgcaatgaattggatcagaaattagcattcgaaattcgtttggctttgtgtctgcatccagcaaattattgcgcgaaactgtattttaattacaatagaatgaattataattttaatagattaaaaaaagaattaaattgtttagtaaaaagcaattaattctaaactccaaaaactttttcattaaaatcttgaattaaaagttgatttacattgactttaaaaaactcacttaatcctgagccttcctcaatatacagaaaggcactaaattgaggaaaaaagaaataaaattttgattggatttgtacgacctgggcaaatctggctcaatgtttgttcctgtctcatttaatagcattactgctggcggcggagtgccagtggctcgcttccatatctgtagtttaattatttattaatagggctacaaattgtttatatgagaagtctcaaaatatgtatataaaatatgtaaaaaaaaaaatctcgaactatgtacaaatataagttatacttttttgaataaaattcttagcaaagcgtaaacagcaaaaaattccataaagacgtcacttacaataatttaaataaaggttcacaattaaacaaaattctaaattgtttatcccaatgaaaattaaatatttgataaagactatttaggaaatagtcaaatttaaatagccaaaatttattttttgttataaaattcatttttactgatttgcctgtcccactctgtcgccaacgacaagtcaccccgaattggtcgcagttcaattcggccatatcattaacaaattcgcctctggccccggtcagcaaatgttcagaaatcattggcccaaaatcaacttaaaaaattgttgaaatttgaaaaattttaaatataattaata

SEQ ID NO: 30896 - DNA, 1541 bp, Heterodera glycines
tcggtgtaccaaaaaaaaaaaaatttaaaagcggctctccaatgttcggttaaaaacaatttttcttttttttttttattgatttagcctttttaaccctaattcaagaaattccgattttttttttcgtcccggatttcggaacttaaccataagctatttttgaccatcactttaaaaaacaaaaatatttgtaagaaaccacggcttttttaagtaccatttacttttttccagctaataattcgcatctttggctaatatttccatggttaatgaaccctaccgctatagaacacttcgactggagaagccatgacctctcctcctttcgctaatcaccttttactcttttttttttttatcattttccggctaaatctttcccatcatttttatcttccgtctccccccccccccccctcaacattcttcttccccccccccccccctcgaaatgtccatcgggccgagttggaaatgaatggaaaatggggaaattaggcgaggggatgcgctgcaaagacggcggagatagcgtcaaaataaacacaacagatattagcaagcaaaaacatcacagagcacaatccccgcgggggatgaattgattggcgggggcgggggatgaaagacagaaaaaattattacttttgaacataatttcgtttttcttttattgattttgttttaaaaataaacaaattaattcttttttttgctaaggcacccacagaaaaaccattttaattctcgtttgccataacttgccataaccatttctgaacaggctttaatagagggggtcggtgttgtttgatgatttgaatgtttattgtttagcgtcggctcacaggccaccgactacggcgaacagttgcaaaagcatgacccggccgacctctgatcagtggccgatcattctaatcactcttttcattaaaaaatgccttatgctgttaattgtcgttattccctctgcttcattttaattattattacgaaaaacttttatttttacaaaacataagccatgcccattgtaaggacatcttttttgaaacatttaaaataaaaagccaccaggcttccatagtacatttacatatgtgcaaaaatatttcaaaaattctcttgaaaaaatatttcacaaaatttatttgctgatagaaattgttctgataccaaaataaaaccgatacccatccttttcagattggtcaaattcttatcaaaattaaagatgtcgcatgaagaagcaataatctacggcaaaattgatcgctacctaagaatcggactctacgacaacgcctgccgtgatttgccaacggtatttaatgttatataaattataaaaatgcattataagtagggttgggaattatatgcatagagcccggcgggatcgggacttaaaaaagttaaatttttaattaatattttcgaaaaaccaaaaattcaattttttgaaatatttttcagtccttagaggtcaaaaaggccgttttaaagggggggccgttttaataggggatttc

SEQ ID NO: 30897 - DNA, 1045 bp, Heterodera glycines
ttttaaataaattgatcaacttaaacgatgatgtgcgatcaatgaagaacaaatggtttttattttttatgaagtccaattagttacggcacaaacaccaaaaaatcatagcaccgaacaacagaacagattaacaaggccattcgtgagtggaccgatattagggaggcattaatagcacaacccgtggctggtcgattcctaaaaagtagggctggtcgggaccgggaattttgacaaaaaccgggaccgggacttgccgggaccagaaaagtcgggatcgggaccgggaccaagtttttcgaccgggaccgggaccgcgagaaaagccgggaccgggaccaagtttttcgaccgggaccgggaccgcaagaaaagccggggccgggaccaagtttttcgaccgggaccgcgagaaaagccgggaccgggaccaagtttttcgaccgggaccgcgaccgcgagaaaagccgggaccgggaccaaccgggaattttcccaagagaaaattttttggaaaaattttgaaaatagcattataagatggaaaaaacagttttgagaagaaacttcgtcgaaaaaagaatgatccaggctatttaacgcgataaagaaataaaaattccgatcaaatttgttttcccatataaatccaacaagaaattgttttattaattttggttttttgaggcaatatgtccggcggtgtatgttcggtacataattttatgagatttattataagattatacaacaatatttggtcatattttcccaatgtggcattttttcattttgtaatttttgacggtgtcgtaaatggcaacgattgacttgaatttgtaaatacctaacaccacttttcatgttcttatgagcaaatgtgatagcaaaatctagtctaattcgaactgaagctgaataatctccaaactgtacaataattctggttgatcagataaagtgccacagagtcaacaggtctgagtcctcctaagtcgccttgatactgtgattgggttattgtaagtttgtttgtttttca

SEQ ID NO: 30898 - DNA, 1535 bp, Heterodera glycines
gtggaacggaataaattttgttgtccacttttcttttttttaaaaactattaaattcgtttttgagagaccaaatttgaaatttttttaaatttcggggtgcaaaccaagaaaaaacacctaataccaaaaaggatggaccaccattaatgcattttgacgtcctgcgctccccctttctccctcttccaatttttccttcttacccttctttttggcggctcggttctcgcccaccaccacctcgtggtcccgatccttcgcctcgagtgttaccttaaagagtggagggggattttcattcacaagatgtgccgaattgctttattgtgcgtcctaatggctggacaattttacaagcacgcaatccattccaatgcagcatgcaatcctccaacttatcccccccccccccccccccgctcaactgccgttcaccgtccatttaaatatttaaggatttgtcagcaatttttcccatccattttcatcgatttatttgttaatcactcaaagtgaatttaaggagcagcacatctatttcacatttctttgattatttaccttttcagctctacaaattgcaaaagcaatttgaaattagttaaatttttgtaattaattagtttttgccaacctcaattaaaactagaaattcggttaaagttatgacaactagagaccggaaatttcaaatttgcgaatcccgctgcgggattggaactcaaaattctttgcgggacgggatcccgcgggattaatcccgcatttaaaatttgcgggatcccgcgcgggattgcgggattttggaaaattcgaaaaaaattaattaaatttgaaaaaaatctccaaaaattaaaaaatacacgaaatttcgaaaaaataaatttttaggggctggtgggataggggctgatgggtcgactaagatttttcgaatggatcggattgaaaaatttgatcgggaatcaaattattaacggtccataaatttgactattttgttgcttttcaaaaccgtttgtttgcggcgcaattttccaaaaaactaggaacagggttcggcggtgccgataggcgacgccggagaaatttttagaaaatttagtgctatttgttattgattttgtctaaaattgaccaaatgtcacagtttttgactaaatttttacaggattattaagaaatgccgatccggcggtgtcgataggcgccgccgggaaaatttcagaaattttgaatgaaatttgcaatgaaaaatgagttaactttaattaaacttattatttaatttattcaaaaatatttggcattctgtctttaaaaattgttcaaaaaaccaataaaatcccgcataatcccgcacaaaaaatcaaatttgcggatcccgctgcgggattggaactcaaaattctttgcgggacgggatcccgcgggattaatcccgcaaatcccgcattttccaaaaaatgtgggattgcggactgggatcccgcaaaatcccgcgcgggataccgtcacgcgccggtctctaat

SEQ ID NO: 30899 - DNA, 991 bp, Heterodera glycines
aaaatttaataacgggcgcgaagcgcccgtccgactccacacaatttaaaaaacggccgcgaagcggccgaaaagcacaacaaaaattagaaacgggcgcgaagcgcccgtctgaggccgcgaagcagcctaaaaatcgctgatagtttttaaaaattcccaaatatctccacaaccagagcttatctaggtagcgaagctccgaaagcgcgaagcgctttttcccagctaaatagccgacggttcacgcacccgctagttatatatatgttatattgacaaggcaactcatcctcaaaaaggatatctcaagaccgggaatagctagggggctgaaattttgcaccaaggggtaactcgagacggcgcatctgggaaaactataagttttttggtccgaggcccaactgagtaccaggggccgatttcccgtttttgctcgcagttcaaggcccgtaactttttttctgaaactctaatcgaaaaatgtccgctggtaggaaactaagttgaagtgttgactaaaaaacaaaaaaaaatccaggcctctacctataataggaagggctgcagaaaaatggagaaattcagtaccaactttgaccagttcagtcccgggtgaataacacgtcagggtttgaattgatcaagggggtgccagcgggactattgtagagctttaaaagcccgatttttccagtttttaaaatttcgaaaattttcaaaatttttcgagctaggcctaaaaaacggttttcgggtttttgaattttaggaatttttagcgaattttcccagaaaaacggagaccactttcaagcaaccgtttttcgagctctatcgattgctgatatttttgaaaaaaattcgattttttcccggaaatagaaaaaaatttttgcctcagcgggacatttgagtcccgggcccataactcgttaggggttggttttagcgaaaaattgccttaaaaaaaaattgtaaagctttt

SEQ ID NO: 30900 - DNA, 992 bp, Heterodera glycines
  misc_feature (911)..(911): n is a, c, g, or t
  misc_feature (933)..(933): n is a, c, g, or t
  misc_feature (973)..(973): n is a, c, g, or t
gctttcaatctgcaagaaattagattggcaatatgtggttgtaaaaaacttttgggtatggaattattttttgaagtgagcaaacaccctattagtgctttgctgtgccgagaaccggcaggcaatggatagctttaaatctgcaagaaattagattggcaataagtggttgtaaaaaacttttgggtatggaattattttttgaagtgagtcaaacaccctattagtgctttgctgtgccgagaaccggcaggcaatggatggctttcaatctgcaagaaattagattggcaatatgtggttgtaaaaaacttttgggtaatgaattattttttgaagtgagtcaaacaccgtattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatggatggctttcaatctgcaagaaattaaattggcaataagtggttgtaaaaaacttgtgtaaggaattattttttgaagtgaatcaaacaccctattagtgctttgctgtgccgagaaccggcanggcatggatggctttcatctgncagaaatagattggcaatatgtgggtgtaaaaacttttgngtatggaattattttttga

SEQ ID NO: 30901 - DNA, 1098 bp, Heterodera glycines
  misc_feature (47)..(47): n is a, c, g, or t
  misc_feature (52)..(52): n is a, c, g, or t
  misc_feature (75)..(75): n is a, c, g, or t
  misc_feature (77)..(77): n is a, c, g, or t
  misc_feature (84)..(84): n is a, c, g, or t
  misc_feature (86)..(87): n is a, c, g, or t
  misc_feature (112)..(112): n is a, c, g, or t
  misc_feature (114)..(114): n is a, c, g, or t
  misc_feature (129)..(129): n is a, c, g, or t
atgaggtcaaacgaatgattcatctaaggaactgatcatgaattagnctagnataacattaacctttaaaaaaangnaatatanannatattataattgttttctttgtatntnagtaatggataaaantttatattatcttcaaagattttataattccctcttacgaagtgtattataaaaaggttaatttgcattaagaaacattaaatgcggaaacattatcagaataattttgaatttgctttaaaatggtgattttacatgcataatttaaaatatggtgtcatttgataaataattaaacgtttcaaacttttgcatttttacaagtttggaaaagtaccggttaaccctggcatcggttgaaaatccaggtccctgtacggtcaccgcggtaccggtcagtaccggtcccagttaattctaaaaattaccggtcccaactactctagtacaattgcttcagatgataaaaaggacctattatatttctacatttttcattagctcggttggtgagaaaaataaaatgaatgaaaaatggtgtgtttggtcatttcgtaaaaatggcaatttacaggttttgcgtgaaaaagtcatcatgactttgttaaaagaatccaaattatataatattctatcataatttcttggattgggcatttattgctatactatatggaaattttaaaaaatttaagttagtttcaaaaaattgtgtccaaaaatgttgaaaaaattgtcgtaactttttgaaaactgaatgaaattttcatcttctaaagtaatacaaaaatcgaataatataaaatattattaatttgctggcatttaatcctctcttctcgggcccacatttatagttagacatgccaatttaaatttatattatccaactcaagggcccgattatgatgtttgtctttatggcacggatcttttaggatggaaagttatataaaaatgcagtccccactggttatatcaattatatcaatcgaattgaggaacgaattcccgttctcggctcatcaggccgaagttagttttatttatttcttattttctcgatgaggtttcctctattaattctga

SEQ ID NO: 30902 - DNA, 1066 bp, Heterodera glycines
  misc_feature (23)..(23): n is a, c, g, or t
  misc_feature (47)..(47): n is a, c, g, or t
aaagaatcaatcactacgggctncagccaaagaagttcagtgcatgngcagcataatcaaatcaatacgggtcactgaccaagcagttcagttgcacgtacggccttaattaccaacgtttacccactcactcccaaaattaaattaggcccctattgtaaccgaccgtgagaaacggtacttggctacgattatgatgaaatgctgttgctcaaagtcgattctgacgccgtaagccagcaaaaaatccaaaccaatgcttaatttcatttttgtgacatcttttagaattaaataaaagctacaaacgttgcgtgattttgcggaccgtcacggccattgccgcccaatacgtcaaacgtgtgagtgcccaaaaaatttccgattcgaatgcgcgcgtttcgtaagcttaaaaaatttaaataattataaaaattgtttgatcagagaccgtcctgaggtcggctgacccgtcccatttactccgactatattgcgtgtgtcgtgttggtcaaatactgcaccaagtacagcattttgcccactccagaattgtaatgaaatgagtgagacatggcttgcttaaaataaattattttgataaaactagaattgcaacactcttgtcgataattagtgataatattcccaaaattaccactattttgcttaagatatatattaaagtacttaaacttgtattttttaattaaaataataaataataatattatttttgtattaaaagctggatatgagctgtagtgtttcgtgctctcctcctatacccattaacattttggtgtgcgagcctcctaaagctttcgtacccatatcgactaaaatgaagcatcttcgattatttattgcgcccgctaagtacacaaatcgatcataaaggagctggtggatttgggccgcgtgaggagacggtgatcgcagacgagaaactaattttaataaaagtgaatttaaattatttcgcaaattatgtaagcacctttcacttggtttcgcacgtcccgtcgcgcaacattggcctgcatgcgaggctgttgcacctata

SEQ ID NO: 30903 - DNA, 1352 bp, Heterodera glycines
  misc_feature (54)..(54): n is a, c, g, or t
  misc_feature (57)..(62): n is a, c, g, or t
  misc_feature (66)..(67): n is a, c, g, or t
  misc_feature (70)..(70): n is a, c, g, or t
  misc_feature (78)..(78): n is a, c, g, or t
  misc_feature (94)..(95): n is a, c, g, or t
  misc_feature (97)..(98): n is a, c, g, or t
  misc_feature (100)..(100): n is a, c, g, or t
  misc_feature (102)..(102): n is a, c, g, or t
  misc_feature (105)..(105): n is a, c, g, or t
  misc_feature (107)..(110): n is a, c, g, or t
  misc_feature (112)..(112): n is a, c, g, or t
  misc_feature (114)..(115): n is a, c, g, or t
  misc_feature (126)..(126): n is a, c, g, or t
  misc_feature (130)..(131): n is a, c, g, or t
  misc_feature (136)..(139): n is a, c, g, or t
  misc_feature (141)..(143): n is a, c, g, or t
  misc_feature (145)..(145): n is a, c, g, or t
  misc_feature (156)..(156): n is a, c, g, or t
  misc_feature (162)..(165): n is a, c, g, or t
  misc_feature (168)..(168): n is a, c, g, or t
  misc_feature (174)..(176): n is a, c, g, or t
  misc_feature (182)..(182): n is a, c, g, or t
  misc_feature (188)..(188): n is a, c, g, or t
  misc_feature (191)..(192): n is a, c, g, or t
  misc_feature (196)..(197): n is a, c, g, or t
  misc_feature (215)..(218): n is a, c, g, or t
  misc_feature (220)..(221): n is a, c, g, or t
  misc_feature (225)..(225): n is a, c, g, or t
  misc_feature (255)..(255): n is a, c, g, or t
  misc_feature (258)..(259): n is a, c, g, or t
  misc_feature (261)..(262): n is a, c, g, or t
  misc_feature (264)..(264): n is a, c, g, or t
  misc_feature (270)..(270): n is a, c, g, or t
  misc_feature (274)..(274): n is a, c, g, or t
  misc_feature (278)..(278): n is a, c, g, or t
  misc_feature (282)..(282): n is a, c, g, or t
  misc_feature (284)..(286): n is a, c, g, or t
  misc_feature (288)..(288): n is a, c, g, or t
  misc_feature (290)..(290): n is a, c, g, or t
  misc_feature (295)..(296): n is a, c, g, or t
  misc_feature (298)..(300): n is a, c, g, or t
  misc_feature (304)..(304): n is a, c, g, or t
  misc_feature (306)..(306): n is a, c, g, or t
  misc_feature (308)..(310): n is a, c, g, or t
  misc_feature (312)..(312): n is a, c, g, or t
  misc_feature (315)..(316): n is a, c, g, or t
  misc_feature (319)..(319): n is a, c, g, or t
  misc_feature (323)..(323): n is a, c, g, or t
  misc_feature (326)..(326): n is a, c, g, or t
  misc_feature (345)..(345): n is a, c, g, or t
  misc_feature (350)..(351): n is a, c, g, or t
  misc_feature (353)..(353): n is a, c, g, or t
  misc_feature (355)..(355): n is a, c, g, or t
  misc_feature (358)..(358): n is a, c, g, or t
  misc_feature (364)..(368): n is a, c, g, or t
  misc_feature (370)..(372): n is a, c, g, or t
  misc_feature (374)..(374): n is a, c, g, or t
  misc_feature (377)..(377): n is a, c, g, or t
  misc_feature (386)..(386): n is a, c, g, or t
  misc_feature (390)..(390): n is a, c, g, or t
  misc_feature (394)..(394): n is a, c, g, or t
  misc_feature (398)..(398): n is a, c, g, or t
  misc_feature (404)..(404): n is a, c, g, or t
  misc_feature (409)..(411): n is a, c, g, or t
aagggccagtcaatcagtgatcagaaaggctattaggccgataattaggagagnagnnnnnncagnnatnccaaaagngaccttgagcacactnngnnangncgncnnnngnanngaaaccaaaangaannggaannnngnnngngaaacaaaggncgacannnngangaaccnnngggccncggcgnaanncaannaaaagcaaaaacaggaannnnanngggncggcgcaaaaggggcccccacaaaaagggnaanngnngncaaaanaaanaaanaaanannngngnaaaanngnnngacnanannncnacnngancaancancagagaaaaaggccccccngcccnncngnganggcaannnnncnnnancanaaacaaaanaaanaaanaaanaaaaanaaaannngaaaaatggaaatggcgttttgtgacggcacaaaaaggcaaaacaaaaagcaattattaaatttatttataataaaatgaagagaattttaatattttgaacagccgcgtagtcaaattttattccgaacaaacagcagttaattagtcaaaacctttatttaaattttaaaatggatcacggcgatatgtgacgacaaaaaagggcaaaaaaaaaaagtataataaaatgaataaaatttatttgatttttgaattgccgcaaagtcaaatttattcgttaatttttattaatttttaattttaatttttgtagcaataataaatatatttagcaatttctccccttgcttttaaacattcgtcgcatttgctttttgtcatttacttttatgctgtaacataagttttgtcgcccaaaattttttcgttttaaaattcgtaacaattttctctttatgcaatgaattcacatttgtgctctttattaatttaactaaattagggccttagaatcggaacgagccgaactgatagatgtataataatttaatttaattattaatttaattatatttgctaaataataaatcaaaacttagcccaaacttaaactaatttcaatcttgctattaagcgattgttctattatataatttaaaaaattcagcaaaatttacaaaaacatgtagccaaaaaattcgaaaaatttagtgactcaaaaattttttccctaactttttttgaaactcaataaacttttttgaaatttcaaagaataatagagaaaactttagtctatctaatgatatcaagggtggtaagaattaagtggagtttgaacaatttttatgcatttaaataactttaaatttttgtatgaccataaaaaaaggacacatttcttagtaactttttgtagaaacacaaatttgactctag

SEQ ID NO: 30904 - DNA, 1293 bp, Heterodera glycines
ttgaggagcaaaggggacgccgacttcgaggagtgccttttctccacttccatcgaacggattgaaaggctatcgcgcgaagaggtgcgccaaaaccaaggggaaaaggattaattcaggggggggggagataaattgacaacgatgacatttgtcggcaataatctaattgttcaggttaatcgggagttgctgctcgcagaccgtgacaaccgaatgctgaagcaacgagttacgctgctaagagacagctaccagcaagtccaagaagaaaatcgaaaattgaagagccttttgaacgacaacggaatgaattctctatgagaaatggacaaaaattgaatgattgattgatcttttttttttgcattgaacaaaatacttaaacaaaacaataaaattgaaaatcaccaataaaattcaaatttaatccatcaatctcgctgggtcggcttggtgcacgctttgttcatttccttgctcaattccctcgcatatctcaaagtcaattcacaacatttttgaacctgtgttgaagaacaaaaacattgcaaataaaaatagagaatttgaaaggacacttttctgacccgtgttgagtttatcctcagatttccacgctgatgcatcaggcaaatttcgtcccggtgattcgcccctatggtcaacgagccctcaataagtgaagattcctccagcgttgggtccaccattggctcatcaattccactgatgaacccaaatgtgacggtcgcgggtttgtagtacagagtgagcgggacgagagccttatcataggcggaatgctaaatgacaaacgcttatacatagccgggcgaaatttttgagaatatagcaaaaaatggacaattattttgcactgaccgatttgagttttttggtgacagcattgtacgttacgtcatttcgtttgaaacccatcagagcagtggaaacagccaaagtgcaagcgtcgaacagacctccgtcatagtcgagcacttttattgtgcatcggatgtcaaaaacgtatctaaaagggcaagctatgtgaaatacgaaagccatacagataggtatttgacaaacttgtcaatttcaatgcacagcgtttcgaagtcaatgcagtaagtgtcccggtaaagggactccaacatgctcagacactgctccacttcgctgtccgaggaggcggacgcgtcgaccgccgaagggtgtgccatcggcagaaagtcgagcgaaaatgaaatgaaaagcgagcccggcttcttccgtggcgcagtgatttctgct

SEQ ID NO: 30905 - DNA, 1510 bp, Heterodera glycines
tcttataatcacttttgtacctcctttaatcagttttgtacgttttttaatcactgatgtacctctttgaatcacttttgtaccacttttaatcacagttatacctcttctaatcaaatttgtacctcttctaatcaaatttgtacctcttctaatcatttttgtacctcttttaatcacttttgtacctcctttaatcacttttgtacctcctttaatcacagttgtacctcttctaatcacttttgcacctcttctaatcacttttgtacgcacttccggtttccattgcattatgcgatgtgtcaactccaattattggaggaaaccaagtgcatgtcggctgacgcaaagaccctaacagactaaaacgcgcctaggtagcgaagctcacaaagcgcgaagcgctttttcccagcccagatccgacggttcacgcacccgctagttatatatatgttatataggtaaggggtttcgttgctaaaaccgatttctcgggatcgggaataggtaggaggctgaaattttgcatacatatgcaccctgggacggggcatccgggaaaaataagcagaaaaaatctcggtggccaactgagtcccagcgggtcgaaaactgactttgccgacagtctcagtgttacgaaattttttgcttttggtttcagggcttagtggaccccaaaagcgaaatgccacaactgtgctctacaactttgccagcaaattttttttgatcagatcaaaggcctgacctgtaggttaggcaacgtacgaatcactttttttggacacttcagtaccaggcgaatagcacgcccgggtttgatctgagccagggggcgccagcagacttattgtagagctcgatgagctcgatttttgcaaattttaaaattttgaaaaatttcaaaaattttcgagttaggccccctaaacggtttttcagtttttgaattttaggattttttaacgaattttcccgggaaaacgaagaccacttccaaaacatcgtttttcgagctctatcgattggtaaaatttttagaaaattttcgattttttcccggaaatagaaaaaatttttggcctcagcgggacatttgagtcccgggcccataactcgtcggggggttggttctagccaaaaattgccttagggcaaaattgtagagcttttaaagttctatcgaatggtgtactataagtctggaaaatttcaaaaatttccgagctaggccccctagaaattttcgaaaatttttttttgggccacaatgcgggtgaaaaatattttctgaggaaattttgaggtgctgagcacgaatatgatattcgtttttcgtttcattatttttggaattttttaaaaattctctattttttggcaattttttggcccttggaaatttggggtaaattttgaaaatcattgctcagtgaaggtttggtcaatttaagtgatttaaagctctacaaatagagaaaaatcaggaagattttatggg

SEQ ID NO: 30906 - DNA, 1258 bp, Heterodera glycines
ccagtgattgaaatgctggagggttgagtcccagtgattgaaatgcaggagaatgagtcacggtgattggaatgcataaaaactgagtccgggtgattgaaacgcaggagaatagagtcccagtgattgaagtcctggagatttgagtccctgtgattgaaatgcaagagaattgattcccagtgattggaatgcaggagaattgagtctcggtggttacgataccgaagaatcaggtgaggttcggtcccagcgattggaatgatggtgggattgagtcccgggaattggaatgatggagaattgagtcccagtgattggaatgtcgcagaattgagttccggtgattggaatttcgcagaattgagtctcgatgattgcgatgccgaaggaccaggtgaggttaggtcccagtgattggaatgcaagagaattgaccagtgattgaaatgcaggagaatgagtcccggtgattggaatgcataaaaactgagtccgggtgattgaaacgcaggagaatagagtccccgtgattgaagtcctggagaattgagtcccggtgattgaaatgctggtgtgttgagtccctgtgattgaaatgcataaaaactgagtccccgtgattgaagtcctggagaattgagtcccggtgattgaaatgctggagggttgagtcccagtgattgaaatgcaggagaattgagtcccagtgattggaatgccgaaggaccggtgaggttaggtcccagtgattggaatgcaagagaattgagtcccagtgattgaaatgctggagggttgagtcccagtgattgaaatgcaagagaattgagtcccagtgattgaaatgctggagggttgagtcccagtgattgaaatgcaggagaatgagtcccggtgattggaatgcataaaaactgagtccgggtgattgaaacgcaggagaatagagtcccagtgattgaagtcctggagaattgagtcccggtgattgaaatgctggtgtgttgagtcccagtgactggaatgctggagggttgagtcccagtgattgaaatgctggagggttgagtcccagtgattgaaacgcaggagaataaagtcccagtgattgaactcctggagaattgagtcccggtgattgaaatgctggtgagttgagtccgacgattggagaaaaagcaaaaaaggatgcgaggccgcgaagcggccgagccagtcgattttatcaaacataatcttacactacaatcgtact

SEQ ID NO: 30907 - DNA, 1096 bp, Heterodera glycines
  misc_feature (1012)..(1012): n is a, c, g, or t
  misc_feature (1029)..(1029): n is a, c, g, or t
  misc_feature (1043)..(1043): n is a, c, g, or t
aggcccaacgttgcttaacttgccagatcggacgggatggcgtgctttcaacgtggtatggtcgtaagcgatagggctccatttgaaaacaattaaatagtcaattttataatgcattttcttctctttggttaacttaatcaaaacaaggattgataaagaattgagaattcatttaaataaggtaaaaataaaaagaaaactccgatagttttttttcaaaatgaaagagcaaaattcggaattttgaattatttttaactaatttcccagcaaatcggctaattgaaaatgagttatataaattttgcgattcatcacaaattctctttaaaaagcacagcacatataaagccttttcctaggcacaatttaatttttttaatttgaaaaaacctcgaaaatcaaaattctatagaaaattggttttggtggtgattttaagaaagtcatccatccatcatttttagtggttaaagtcatcttttgaggtgccaattttacattttttttgtattccgttaagaaatttaaaaaaccatttcggcacaaagtgccaaaaaaggcaaaatggggacataagggtcaaactaatggttctaaatagagtgccacgggaccgggaatttttgccaaaaccgggaccgggacttgccgggacctgagaagccgggaccgggaccgggactcgattttttttcgggaccgggaccgcaagaaaaaccgggaaccgggaccaaccgggaaattttaaaaattcaaaaaaattttaaaaatttaaaaaaaaattcaaattttaatttatatcaagtgaaaataatacaaaatgatttggttttttatttaataaattaaattaatgaaaattttcaaacaaattttcttcaattatttcaaacaattaatcatttttggactaaatcatcgaatattaatagaaattcagatttgattttcacatcactttttttcggagcgctttttcaaaaatttgtcaaaaaaaggttggttnttgcgattattaagctncattggtaggattntcatttaaaaatgataaaatatgtatcaatttaaaaaaaactatgaggaatca

SEQ ID NO: 30908 - DNA, 1522 bp, Heterodera glycines
gtgagaaccacttactttgacgactattcaggtaaataatgtgtcgtagagtaagttacaaaatatatggatgatcacaggaattaaaaaaagacaaaaatgtgaaaataattaaattaataaattgaggtcaaagtcaaatgaggtcgaaatataaaaataccaaatcacttaggaatttgttataattttagcttttccggtcttacatatttaattcttactcctgatggcaaagcatcaggaagatcgttaatatagatcaaaaataataaagggcccaggacagagccctggggaacgccaaagatgtttttgttcgccatttcaaggagaattttgagtgggaccatgactaatggcattttctatttacaattcgtaatcattctttaattactgagaaattaaaaccttaaagattggcatttcaaataaacgcaattcggcaacgctgtctcaatataatttgaaattcattaaattggcaaatgcatttgtcatttcgaatgctttttgtgtagcaattagagtttaattaaagttgaaaaccgttcttacttggtgtttcatttaaatataataatatttttaattaaagaaattctttaaaaattcaacaagtactatcgcaacgcattccgcacaaagtttccatttcattatatttagtaatttccattttaattattatgttattacatacactctgactaaacttgccataagctaaatagcaaatcagccaaaaaaaaaagtcaaaatggggttttgtgaatcaaaatgtggcaaaaagatacatgcattcaagtaatgaaatcttcagatattgtatttttcagttcgttttaaagatggaacaaatccgagtctggaagcacgaactctcagcatctgaatcagctaaactagaaaatcaccttttatagaaaaaaatacagcattttcaaaaacacatgctaatgaggctttggcggcagcgccgactgaaaattatattccgatttgtaataaattagtcaattctttcaaaaaatttttgataattatagtaaaacctttgaaatctaagaaaaagcatcgggagaaaatattaattatttaaaaaaaaatatcaatttggaagtttaaaaaggggtaaattccccaaaaaggtgaaaaattgcaattctgtccaaaaaacatatgtttctgtgaagtgataaaaagttaaattattaattataccatttgtgtgtgacacatgatggtcgttaattagataattagtcaatgcaaagaattctcataacattttcttacttttggtctccaatcttgttttcttgagaattgctctctccgtcagcagctgaagttacaaccatttttgacaataagttttgcgagtgaaacaaaatgacaactgaattttaaataaaatttaaaaatcatttttatttcacataattgacaaaggttttaaggcctttttataaagaaaatatcttaaatttattatttttttgaaatcgaaaaattt

SEQ ID NO: 30909 - DNA, 1151 bp, Heterodera glycines
  misc_feature (172)..(172): n is a, c, g, or t
  misc_feature (178)..(178): n is a, c, g, or t
aaatatcaaatttctatcatatataatgaaaggcgctccccgttgacgctgtgcgattgctcgtcggcgccgtttcccgcttctcgcggttggccctcgtggcttgctgcgtttgtgttcgctgttcgctcgcctggcgagcagcgacacttgcgacgcacttccccccggntggggnggcggagccaaattttggcgaagcgtctgataagacgttgagccgaaatagtcgctgtcgctaataagcgccagtggcaaatttgtccttgtggcgattgccgcaagggcaaaatgtgggaccatgtccttaataaaggtcatgggcccagaaatgggcttggcctggcaatggccttgccctcatgtgcgatcgcttagcgatcgccatgctccccgccggcggttgtattcggttggagtcggcttgagcgctaaatcgccacttttttttcagttagctgttaaaaaaaattaattgtttttcaaaatactttcgaattttttccattttttctccaattttatccgaaaaagcctttcaaaaagaacattaaatttatgtatgacaaaaatcttttaaaatcggaccaaagtttcaaaaaaaaattttgctggcgctgcctgctccttaatttgttcttaaacccgattctttttatgttttgcttttaattttgatgaaaatctcgaaattttccacggcatctatcggagaccattggcccaattcaattcttggcaaccacgaccaaggccgccttcctcacccaaatttccaaaaaaaaaaaaaaatttagctaaactttatgaaaaaattgtattccatcgcatctcaccacaaccttttgctagcgtacaactgagtaccggagtcccgattttaacgagaaaggcaccaaaacggcgctggagaccacgcgtacattttccacacttttcgccgacatggacattcgccagctcaaatttgtgtttttaaatttaatttgaattatttctaatttatttttttcttatctcgatattagacggatctgcaataacaaatcgaccaattggtcgagtattccaaattataagtttagaaaattataaattaatggaaaaataaaagcaacgaaaataatttcaaattcagatgaatataagga

SEQ ID NO: 30910 - DNA, 1694 bp, Heterodera glycines
attacagacttaagtttccatttatttcataaaatcaccaattggttcaagttcgacaaaagaccagggatcggatccattcgtcaataaatttattaaaagggatgcttaaagttttcaggataggtaatattcgttgctgattatgaaatgcgccagaaaaaaaggcattagagggaaaagtcttgttcggtctctctctgttgaccaagagaacaatttgcgtcaaatttttgctcaattatgcagaaagcagtagcagaaatccccatctaaatctcagagcaatatcatttaagacaaccgtcaaattcctgatcagagggacctttaaaaccttataaactcatttttttgactttttaaaacctgaaaaaaaaatttcgaaaaagggcttccaccggtggtattcttacccaggaataatttttagagaattttaaaccaaataaaactttcataagataattttattgaaattagccaatatttttaaaaaattatgtctcagtgacgaactaaacagtgacgaaacgataggtaaccagtagggctaactatttcaagaatgaatggaatcaaagcacgtagttagaacccatgtgtagaaaaaaagtgttgggatgtaggaaatggtgggagggattcggggatggcaccactcgaggggacagagaacgatcaccgaaaaatgccaaaatgtccgtcgagtgtacatttttcaaaattgcaataataaacgcctcacacattcgtcaccacattaccttgtcccacagagtccagttgtggcttagcaactagcatatttacaccaggaataaagcgtaacacggccgacatttgcccatctttttgtagtgcggttcataaagtcacattcaacctttaacaaaattaaaatctcaacttttcagttattaaatttgtttttttctaattaaattactcggtagaaatttttggcacgcacgcagatacgaacaatggcacgcacatggcttctcctcattttgccaatttccgtagatgtccggatcataaccacgtttcttgtccttgcccattgccaacaattatcaaaaaatcaaaaacaaaatctaaaaaaaggtaaaaagggagaggcgaggccgtaagtcccattggcaaacggatcattaagaaataaaaaaataataattgaaaatgttttcaaaaactttgggtgtaaaatagcatattccaaacaattaattaatttggatattgtaaaactgtccgaatttgcacgagagaaagttgggagcagtcgatacagcgaaaaagtgtacataatggactttcatggagaatatgggcacaaatagtaacgaaaacgggaaatttttctacctattacctaggttctattttatacctaacgaatgccactgaatttgcctagaaattcggcagaacacaaaaaaataattgaaaaatcttttcaaatactttgggtgtaaaatagcatattccaaacaattaattaattgcctttaatttgatcactgcaattttatcggcttggttagagaggcagaccgcgtgcactgtctgctccacaaaatgctcgctctcgcttctcttcactgtctaaccataaccatccaattgtctcttttcttcgctgtctggcattcctcgcaagcgcacgcgtctcccgaactgcaatttca

SEQ ID NO: 30911 - DNA, 1762 bp, Heterodera glycines
  misc_feature (1634)..(1634): n is a, c, g, or t
  misc_feature (1682)..(1682): n is a, c, g, or t
tattagagatcggtattttgaaaaaagcctggactgggacctggacctggattccatgttggacctggacctggatttcctggacaaaaatccaggaaaatccaagtccaggaaaaatccaggctcctcgagacctggatccaggcctggacctggattttttgaaatttgttcaaacaaatgcttgaaaaaatcatttatcaaattctactgctattattattaaataaattatatttttggcatgtgaatggaagtacattataagttacaggtaaaagaaaagtgtgttaatgacttgcgatattcatatagacaaaagttttataatatttttaatctcttagattttttgtgttcaaaaaagaaatttttataatattcattagaaaatttcaacaatatataatatttggtttaaatttacctgatttataattttttttacaataaattttcttaaaaaatttttaaattaaaaaatacagtcccaattcttcattttatgttttaaatttgtttttattttctgttatttcccgtcagtcagttactcctgtgaagttcaccgtaaacgtgcagtctgcccccagcgaaacgtaaatactatgttctttatcattgccaattactggaaagtataaaattttcttgtttgtaatatgctacgatcttcattaataagggtttataggtttttttttattaagggttttacctattttttactttttttataaataatatgtttaattattaatttataaatttttatttataagctttaacgttcgctaaagataaatatatttaaaaatttaatctacaccaaaataagcatcttctcaataatattatttatttaaaaaaatttcggtcgacaaattgcattattttgtgtataactgttgcattcgtttgttttttttacctgagttttgcaccggaatgtttaaatattattgccctcaccttggtaaattaactttaaaactttttattaaatatatttatattcgttatgaaacgaaatgttttttccataacttttatttatcatttctttttcaacactgaacgtttcctttttccgtcattttattattgctacttttagtcaatgttttatttcgaagtttggtgttttttagtccacataatttataatactaattatgattatcaaaaaattatagaaatgtaaaattaaataccgctaacaaactaaagaataacgttggtcaataaacaagttgagtaacgattttggaattttatattgatatggttttacatttttgtttttgaaatcttttctttttgcagctggattatgaaaaagtagaaatcaaataaacttttcttattaaggcgaaaataaattgaaattattttaatgtaattattttaatcatagcgcgattggattaaattattttgaattattttgtactttttcgaatcctccaaatctagccggtcatttaaaaaaatatcgctctgtaattttattcaaatacaaattaatttgaaatttttttaaattttattattccgtaatatttttaataagatatgaaagaaatttcacatgattccgctgatgtattccgtaaattataatgtttcattanaaaattttccaaattctacaagttttttttttgttgtaaaattgccgnggttttttaggtttttgcttcatttttttgatttttcattttataaaatagttcatgactttttcagcaattgcgcaacg

SEQ ID NO: 30912 - DNA, 1294 bp, Heterodera glycines
  misc_feature (62)..(62): n is a, c, g, or t
  misc_feature (65)..(65): n is a, c, g, or t
  misc_feature (69)..(70): n is a, c, g, or t
  misc_feature (72)..(72): n is a, c, g, or t
  misc_feature (79)..(79): n is a, c, g, or t
  misc_feature (1132)..(1132): n is a, c, g, or t
cccgttcccgattcgtacaattgagtatcgtataatttccttcgaggtcaatcaagacttanaanaagnncnaaaaaanactttaatagtttctactaattttttcacgtttctttgaaatttttcccatatttttatgaaaaaatctgtcttaaatgagaatttaaaaaaaattttgaaatcaagtcattctacgaatttccatttgctctcgaggtgtcggagctcaaccctgaaccaaacaaataagtagaaatgataattatatatagaatggctaaaaaggatcaaaattaaaaccattagtaatacgtacaaaaaattttgctttctaccaacttctgaccctagcagatggtggccagctgcaagccgtggtgtggggatgtgccgaaagtgacaatgccaacatttgcaccgaatttgaacagcaattaaatgctaagcggatcaaacatgtgtcctgtgaatgcctttttggcgcccggggtgtcgatttttcaaatcaaaagatgatggtcgaccatttgtttctgccaccgtcatcatcattgaccacacttctataaatgccggttaatatatggacaagctggggaagcctttgagggaaaaactattggactggtcgaatttgacgtggcatctcgggcttcaggaccaatgttatttcatcagaacaactgacccggccctcaattatataagaccaattatctccttaattgaccttaattggtccattaatttaccgcacgggggaatcttcttcttaacttttgttataactattgttattacacagcaactcgtactaccgctaccacaatggcaccagagacaagcacgaaaacaatggaagtggttaccacggctaagatggaaaatgattcaattggtgagtgtaggacaaatagtacagaatagggagcttccgcaagtcaaaacaatttgctggaaatgcataattccggtgccaaaaagtgccgtaatctgtccctcctcattgaggaagctcgggaacttcggccccttttcaccgagaaatttcatgggttttttgcgttcttggcattcctttaaaaatagtcaattttgctaattttcgttcagatgacgatgaaatcagtanattaattatttttaattgtttttatattacattattaaatgaaaatcttacaaacattctgtgtgaagctctcaaaaatatttcgcaaattaagaaaatggtattgtgcgcccagccatctcgaacttatccattgttgtcatgctgagttttggtaagctc

SEQ ID NO: 30913 - DNA, 555 bp, Heterodera glycines
cgccgacccgacactccctatgccataaacatcagtcaaattctcgtcaaaaacattgtcgtataagatctttaattcttccctttgtttgtgccaatattcgcaaatatattgcccctttggctcggcatcaaaccagcgcacaaacacaatgatatcggctgccaatttggcactcattcgttcgatttcgggaaaactgttggcatttaaaattgcatttgtataaaaagaggtcaaaattttgtcgtcctcaaaaactaaaaaggtatgagcaattttttattgtctaatataaaaacaatttcgcacattatataaattatacaaatttaaaaaattccgtgctcggccattactgccaaatgggcgtttctctaattgcctccccccgcccctcactcatttcaacttcccaaaattcaaaaaagacgagatttagagaaaatcaaagtttaacttttaaaagaaaactaaaaacaatttctaagaaatttttttttagaattttccaaatcttttattatattcattttttcttaaaaacataattaa

SEQ ID NO: 30914 - DNA, 1913 bp, Heterodera glycines
  misc_feature (1879)..(1880): n is a, c, g, or t
  misc_feature (1883)..(1883): n is a, c, g, or t
gattcaatcatttttagcactttgctgcctagcgataaggacaagagaatagaaaaatatcccttttaagaaaaataacagaaattgtcgaaaatctggaaaaaacaaaaaaaaacgcaccaattgaagtcgttcccgctcttttttctgtagcttcaactgttcctccaagtcttttcgaagcattttgatcaggttttcggacggcattgctggtgtttttgtactttcgggtgggaccatcgaattttttgtgtcggatgccaaagaacgccaataaaaatgtgtcgcattgcgagttgcaattcgcaatgcgaaccgtgcaaaaaggacgttatgaacagggtggcgaactactctcatagtgataaatccatacatatgacagaaacttaacaaaaaggacaaaaattaaataagacatgtaaaaaaatatgcaaaatttcacctctaccaaaaaggggggtaatagtaaagtttatcccccccctttttcaaaaaaaaaattaaaatttttaaaagtgcttaaaaacaggttttagggggttttcggggtcgctgatcacgaatccgacatccatttcaaccaattccgaaccccggacccgaattcgaacaaaaaatcaaaatttcatttttcaccaaaatgcatatttattgcacaaaatcgatccaaacaaagaagaaaatgttctataaattgacaatactgcgcatgtttggaaataaaaataaaattaaaagcgattgaaagcctgtttttacaacggaatttcttgattaaagattaaactgcaaaaaaatgagacctatgtaggaaaaataaaacaaaagttttttttgtttatttggcgaattgttgtttgatgcaaatttcaaatatattactatttactttttatatggtcatctcccaattttggaggaaccgcttttcttatggtaaggtttacaggggggaaaattatggtaagactcggacgggttcgggtaccactcgggcatttaccgggccggtcgagcacgggctaggcaaattttaatttaaaaaaatgctaattgtaagatttttccatgttttttttaacaattttccagaaaattgctgtccttgttgcactgttttggagaattgcaagcatctttttgttctgcaaactcttcgcaacggcccaagtccaagcaacacttcctaaattttcctcccataaaagcgaatttgcaggtgtttattacttgaagaggggggggggggggggttacatattagtaatctgactttaatggcaaaaaacctcaaatttgtcttggggcaaataattccgttttatgccaccaaaaaactccgtgatcttttttatacgtttttgtggggtgtatgcataaaaccaaaaaatacctaaatttttttttacagaaaaatacagctatatcgaaccagaagatgttgaaatggcgcgtgaccaggcacgggaaatgtttttcttcggatacaataactatatgaagtttttgtcgaatttatacaaaaaaaaatttaaaaaaattttttttacttaggcatgcttttccaatggacgagttggacccaattcattgcataggacgggggcctgattatgagaatccggcaaattggaacatcaacgatgtgctgggtgactattcactaactttagtgagttattttacttttttggaagtatttgaaaaaaaaatttttgtctcaaaaatttccgaatattgtgccttggaaaaaaatttcgaaattttaacaaaaaatttttttttgtgtaattccacatatttttttttagattgattcactaaacactttggtggtgatgcgtaacaagagacaatgtttcacagatgctgnntcnaatttgatccccattgaccactgacctgca

SEQ ID NO: 30915 - DNA, 1214 bp, Heterodera glycines
acactaaaaattaaaaaaaaaaattttagctctttttttaattgtgtaaaacaaagttgtcattagaagttattcgatgtcaatttttcattgttgtctccgcatactcaaaaatatctgtccttaaatgttgggtagcgcctgccgcattggaacttcaggtgaaatgagaactgaggttatgccgtacgcaagttaatctcacggaaatgagatgtttttaataatggaaccatcataaatgaaggtttcctaccatgaccgcaagtgtaaggcatacaaaaatcaaataatttggtatttaatgaaaaaataaaactaagtttaggaaccctggagaacaaaacaacattttgcgtcacgtttgacggaagaccgaacgaagaaccgatggaatactaataaaataaaatgaaaaatttctcattaggggtcaaccaacgacccattcccaaaatttttggcttagttgacttgcaaatttgggttcgtctgtcagtaatggtgtctttggttagtcccctgcgtataatcaataataaccctaaaaattacgtaaaaattttgctaaatgattttgaattgcgcaaactacgctgttatctcatcagttgcattatgtgaacaggagtaattaactcaacatttcatgtgaccttgtacaccataaggcccaaaatatttggttttattgattcgaaatgggacaacctgtgaagttttataattttttcttacaaaaattgttccgcaataactgaaactcacgaagctagaaaacataaaaacattagcacttctaatagttcatcaaacttttggtttttcttggcgccaaaatgcccaaaaatttgatggggaaaccagcaaaaaattgcaaatgatcaaattaagagtaaatttatgaatcgaaattcgtaccaaacctctcatgcagatcccttcattctttttgcttcgtttgagtacgctttcgtcaatttgtgcagaccgccaggaattgacctgtgcactcgtcgctcacccgaaatagtcgcttttgctgccgccggccttgtgcgtacatatactgtagcgatgggtctaggtgatgcttgccacgggtatttagggatggatgcaaccagtagctgttgtcttttcaacctaattggtgcctaggccacggctattagcagccattagccaattgaagaagcggtgaaagctgaggt

SEQ ID NO: 30916 - DNA, 1053 bp, Heterodera glycines
  misc_feature (52)..(52): n is a, c, g, or t
  misc_feature (55)..(55): n is a, c, g, or t
  misc_feature (59)..(60): n is a, c, g, or t
  misc_feature (63)..(68): n is a, c, g, or t
  misc_feature (71)..(72): n is a, c, g, or t
  misc_feature (76)..(76): n is a, c, g, or t
  misc_feature (79)..(79): n is a, c, g, or t
ataaaaaaacagtaaaatataatttttaaaaaatgtaaccctttaaagaaangcnaaannatnnnnnnaannaccnaanaaactttaaaaaattgttatatttgaaatctttcaaaaaatatttttaaagacagaataaaatttataatgacaaaaataatatttaaaataataaaaattagtatatttgattttttttaaatgtaaaaaaaaaattaatgtgatttttcaatgaaattattttattttattttatttacgaattgaacgatctctttttctcattcagattaaaaaaagtgatgagaagtgtgcttgaagcaaatttttggcgaaataataattttaaaaattggtgagccatacaaatgagccaatgccgttatatttttgctctcaagcaaactttagttgcctaattactccttaaaagatatggaatgtttgttaaataatggggaatgccaaaattaatctttaataattgttaaaacaaataaagagcaatccaaaggtgctgtataatttctcaaaaaccatcaaaattgtggtcactcaaaaaaccatcaaatggaaaatgttgacgaaaattattattaactttgctcaagattaaccaaatttttaattcttgatatcatccgttaactctaatttttctatattaacctgaaaatctcaaaacatttcttaaaaactttaaaaaaattttctggcgaaagttcgttcataactttttgaaacttcagaaattttttaaaatttggcaggataatagagaaaggctatcaataaaattaagaattaaaaatttaattgcttttaagcaaagtgatatgaaaaaatggttttgagagtaacgttataacacaatctaattgtatagtttttggttattgtttttcaataatcttttttaataagcggttatgaaaatgtttttcttcaatattttttgtccttaatttttttgctgaaaaattttataccaagaaattttttttgaacaatatataactttttgaaaaaaaataaatgctttttttgaaaagg

SEQ ID NO: 30917 - DNA, 657 bp, Heterodera glycines
agtgagggtggtcactcattggacgcgtaaacattgactgtacgcctaaactggaatagagcccacttttctagggtagttttgggagctgatcaacagggctgcaaaaaatatgcacgaaaagtgaccaaaatatgcacataaatatgcaataaaattgccaaatatgcacaaaaatcgcaaaatatgcacaaaaaaacttgaaaattaggggtgcaaaataattcaaaaattttatttctcataaattatgtatataggttgtttttgtaattgtaaatcaaaaatttctcaaggtttttggcagtgaaactcactgttgacccactcgcgcatcaattcagatttggatttaattttaggcattttcaaaatttttcctaagagatattcaaatcggaaaatatttgacgaaaaatggcaaaatatgcaaaaaaatctaaaaatatttcaaaaaatggcaaaatatgcaaagaaatctaaaaatatttcaaaaaatggcaaaatatgcattaaatattcagaaaatatgcaaataaaaatccctatttttatacgcaaacacaaaaaagaaagtgtttttcctactatttaaagcagggagaagtcaggaaaaaaaaaatgcatttgcatgttttttgcagccctgctgatcaa

SEQ ID NO: 30918 - DNA, 1194 bp, Heterodera glycines
gatttcagattcgtgatcagcgtcctaaataacctctaaagacatattctggaagttttgggcgaaaaaatgtccccactcgaaaaccatgtgcacccccctttggtcccgaattcaaaaatcacttttatttttataactttttactaaaaaatgataaaaacatgaaataaaatttatcaaatacagcaaaaaattgcggatttttgggctatttttattttacaaaatatcttttcagaaccgagtagtgaatttttttctgaaaattcgaaaatttccagaatttctggaataactttttttatattcttgatagaaataccaaataaagggcaaaaatttctccgatttttactccattttttaagcctctatacattaaaatagacctgatctaaactgagttatgaattttcaaactttaacccaaaatcccgagggcaaaaaaagtgaccgattttcaaaaaaatttaaaaaattcaaaaatttcccaaacaaaaaacaaacatcatattcgtgctcagcaccttattttaccccagaaaaatatttttcaccccacttctcgccctaaaaaaattttttgaaaatttctagggggcctagctcgaaaatttttgaaaattttccgacaaatggcacaccattcgatagagcttaaaatgctctacaaaaatgttctaaggcaatttttggctaaaaccgatccctgacgagttataggcccgggactcaaatgtcccgcttaggccataaattttttctatttccggaaaaaaaccgaaatttttccaaaaatcccaccaatcgatagagctcgaaaaacggttgcttgaaagtggtctccgttttccccggaaaaatcggcaaaaaatcataaaattcaaaaaccccaaaacctcttagggggcctagctcgggaaattttgaaaattttcgaatttttaaaatttagaaaaatcgagctttcaatgctctacaataagttcgctggtcaccccccgctcagttcaaacgcaaatgagttattcgactggtactgaactggacaaagttggtactgaaaagttgccaatttctgcagcccttcctattataggtagaggcctggaattttttttgaaaattagacaacacttcaacttaggttcctaccagcggaaactttttgatttatgtttcggaagaaaa

SEQ ID NO: 30919 - DNA, 588 bp, Heterodera glycines
tttacttgaggataaagaatccccaattgtaactcgagcagtcctattactcaataagccctttatccacattaagagtctgtcctttataccaagtttttccgatttggataagagtgaattatggggcactgagtgcaaaagctttttgaaaatcaatataaatacggtcaacattttttccatttataattgcctcgcaccaatcttccacaactgatattacctgacttgtcccatacctatttctaacaaaaccaaattggaattccgaaattttaaatttttgcttttaaattaaggatttttacggaccggcgctgccgataggcgccgtcgctgcaaaaattaagaattttgaccatattttttgcgtattttcatataaaaaattctttaaattgccaaacattatgccaatttatcaaaatttataatattctgaggattttccccaaaagcctcgaaaatcctcacaatttctctaaaaaccacaagaagactcattgtgagaatttaccctcattgacctatcaaaaaaccacaaaatgaggctaaagcctcagatctgggagccctggcttaaac

SEQ ID NO: 30920 - DNA, 1104 bp, Heterodera glycines
  misc_feature (88)..(89): n is a, c, g, or t
atgatccaaaatgactgacgcgcatttgctcgtgtcgcattcggaaactgccttcgtaagcactcttccgcacttgtacaataacacnncgctcgttgtcaaacatatccagttcgcggtgctgttcttcattcgtacacatcggaaagactatgtccgaatgctcaatgtcaaattcgatacgcacaggactgatgtcctaaaataaacgaaaacgatatattgttaatactctttttttatctcgctattttagaaccccatacgaaattgacccccccttttttgtccacatatttcaccgccacacctgaatcattcgaacagctcgaataacagagtcggcagatccgcttaacaaatacgtggagtacgccaacgaggagcagtcggaagacgaggagggaaaatgaatggtcgctttggtttcggaggaaatggcactgatcagcactccttctggcgaaccgaccaccatacgccgttgagacacggggatctctaaggcggcaaagaactgttcacggcaattctgaagacagagaaattgtcactcggaaacttatcgaaaacctcaggaaaaagcaatttcatcagcgtctcacaggcatttatcattagtttatggtctttccgagacccccgaacaaccaaagagagacaattagcctaaatcaaagttatattctgtgaaaaaaaagctgaacggggaaactgtccacaaaatcagtcgactcacttcctccctcggcgcgatgacaaaaggattaggcggaaacaaaatgctgaattgaacccgtgaaaattgacggagttcgtcggtcaaacaccattgccgtatcagttgagccaaatcctcgcgtctgaactggtccttgacatttcgcagcgatatagcaacagtaattggtgcaaactcctaaacggagattggataaatgaaaaagattattgcggtcaggggcgtatctagaaacatttttcgggggggggggacccgacatgaagacctttttttgctatttaaccaataactttttttccactgctgggtaccaactggactttttcactaaaaatgaccaaattttggccgtttaaggc

SEQ ID NO: 30921 - DNA, 618 bp, Heterodera glycines
agcaattaatcatttgggccaatggtcgaatattactttaaatttacatttacttatcacaccacttttttcggcgcgcttttccagaaaacttttggggaaaaaggtggtccggcggtgccaataggcgccgccgggagaaattttgaaaatttgagtgagatttgttaacagattttcaacaaaaattgcttcttttttgggattattaggctcaatttgtatggattttcatttaaaaaataataaaatatatatatcaattaaaatatatgaggaatgatattttcttgataggaaaaccaatgagtatacaaaaaaaatttagaatattttaattactgtagagggattgaaccaggggaaagaagaagggaaagtcaaggagactaagtaacactttaaagaatatattaatatattttttaaatttttccctttaactcctattttcatctctaatttttcactcagaccccattcttaccagtgcttgtttttcccggttcccggttgccctaccgggaccgggaccgggacctgagcttttcaaaatccgggaccgggacctcggatgaccgggaattcccggcccggtcccggtcccgctctactcta

SEQ ID NO: 30922 - DNA, 1899 bp, Heterodera glycines
atgctaatacgtaccgcagatcctcttcaaaattttttccattaccgcaagagctgcggaaattgtgaattaattctcagaaaaatggccatctctttttaggacaattttctatctcgtaaccccgatgctaatacgttccgcagagcctcttcaaaattttttccattaccgcaagagctgcggaaattgtgaattaattctcagaaaaatggctatctctttttaggacaatattctatctcgtaaccccgatgctaatccgttccgcagagcctcttcaaaattttttccattaccgtaagagctgcggaaattgtgaattaattctcagaaaaatggccatctctttttaggacaattttctatctcgtaaccccgatgctaatccgttccgcagagcctcttcaaaattttttccattaccgcaagagctgcggaaattgtgaattaattctcagaaaaatggctatctctttttaggacaatattctatctcgtaaccccgatgctaatccgttccgcagagcgtggggggagctcaattgtcgggggtcggggaccccgatcgggtagtaatcaacgaaattttttaacgaaaaactcaatttttatttttaaatgctcgtaaatcttccttttttccactttaatcatctgatttcgttagcgccagcaagagtgagtccaagctagcctttaaaccaggggcttccatttgttcttatttataagaatgttctgattttggggtagcgactaaaattattctgatttcttaaatatacttatagttttgaaattttatggcatttcaagaaattttaaggtctgccgcaaaatttttttgatcttttggtcccgaatttactgaaatttataattttgcattttcctccccaaaatatcaaaattgataatagaagactaaacatataaatttgatcgaataaattggaaaaataactgatagaaaaatgttgcaaaatgttcatatttttgatactaaaatcttattttgggcttggtgtttatattttgaaaatttttcgatggaagccctggtttaaaaataagtggaaaggggtggggtttaacccaaatttttgcgaacccgtctcaacatcgaatttgaccaccattttttgcggcgctctttttcaaaaaaacttttggtgaacaaagggggggatgagcggcggtggtgttaggagccgtggggaaatttttttcttgaaaatttaattgataaaaaaaacatttcaaaatactttataaatctaaaatttcatatttaaagaaaatcaagtacaaaaacaaaattccgttttaggcgcttaattttgacacaaattaaccaattttcaaagacttaaatttttaaataaataaaaatgattgcaatgattttcaaatatatctttcaataaataaagtaataattattattttattcaggcttaataaaataaggaaatttcgtgaaaagttgtgatgagcaataccaaaaaatcaatgaataaattgtttggaataaacaagaattaattacgtataatattaatgattaacttttttaattaaattattaaatgaagcaatataaaataaatcattataaaataatattaaaaaaaaataataataattttgaagaaaatttaattgaagattcaatttctaaaacggtggcacttatcggtaccgccggtacccattttaccattttttgttgaaaaattgacccccaaatttaaaagaagtttaaaaatgttacttttattgtcctagaatttataagttattaacgggaattttggaaaaaaccgttaattttattttaaaagcaaaaaatacaaaaattacttttaattcaaaattcaatttcatcttcaatta

SEQ ID NO: 30923 - DNA, 1153 bp, Heterodera glycines
  misc_feature (1086)..(1086): n is a, c, g, or t
tttccccccagtgatttgggagtaataagaaaataaaagaaaatcaagggattaattcgggaggaatttccaaggccccacgtgcatcattgctccagcggtgccttaagggcttttttaatgtcaaaatgcccgacgctagtgcatttctttagacaaggaaaattaattccgaaggaattttcccacacccatgcgaagcttttgttagaccgatcccgaaatggcaatataattggaaaaggacagccaacaatgcttttctttatatcagctgatggtttacaaaaatcgaaatacttcctgagtactttccaagaaccatgagaataaatatcgcactagcgccaaaatcgaacaaaaacgctaatcatcagaatcatcttaattttcccccagtgatttgtgagtgataagaaaatagaagaaattcagggattaattcctgaggaatttccaaggaccacgtgcatcattgctacaacggtgccttaatggcattttaatgtcaaaatgcccgacactagcgcatttctttagacaacgaaaattaattcctgaggaatttcccaaatccatgcgcagctttgttagaccgatgccgaaatggcaatataattggaaaaggacagacaacaatgcttttctttatatcagctgatggtttacaaaaatcgaaatacttcctgagtactttccaagaaccatgagaataaatatcgcactagcgccaaaatcgaacaagaacgctaatcatcagtatcatcttaattttcccccagtgatttgtgagtgataagaaaatagaagaaattcagggattaattccagaggaatttccaaggaccacgtgcatcattgctacaacggtgccttaatggctttttaatgtcaaaatgcccgacactagcgcatttctttagacaacgaaaattaattcttgaggaatttcccaaagccatgcgcagctttgttagaccgatgccgaaatggcaatataattggaaaaggacagacaacaatgcttttctttatatcagctgatgctttatttacaaaaatcgaaatacttcctgattactttcncagaaacatgagaatagatatcgcactagcgccaaaatcgaacaagaacgctaatcatcagaatcat

SEQ ID NO: 30924 - DNA, 1925 bp, Heterodera glycines
  misc_feature (15)..(16): n is a, c, g, or t
  misc_feature (31)..(31): n is a, c, g, or t
  misc_feature (45)..(46): n is a, c, g, or t
  misc_feature (1895)..(1895): n is a, c, g, or t
tgcatggcctgcagnngtcggtcccggtccncgctgcatctctanntttttatcgtcgaaaaattacaataaaaaatttaatccgcttctgatttattccaatgattgatcaacttctgcagattattttcattacttttttgcggaactgattttgaaaaacttccattcttaagtcattttgaaagtcatttctttgggagtgttttcatttttttttttgaatttttgttaacgatttttggcttaaaaataagcataaaaataagaaaccaaatttaaaaaaatatttttcatccaaatgtatcagagcaacaattggaaaatatttaaatgcctaaatcacaaatttacataaaatgtacaaaaccaataatataaattatgcatactgtaaaaataaatgtgtgtactgtacgtttactccgtttgtttgtttgttttttatctgccaaaactgatcagacattcatcgcctgctgctgtttctccggctcagtgctgtgagattcgtcggatttgaagaaagtgacgatcagtccgtcgctgatgaacaaaccgcaagagagcagggaaaagatctgtcaatttgcgcttatttaattgctcttcctttccctgccaaaagacacattctgatcacagtgagtgagtgatcattaggaatcatattttatgatcagtcatatttttcctaatttccaactttttaaatcatatttttttagatcataaaatgtgatcagccatattttggaaattttttcatttttcggcttatttttggtaaaaaccaaacatattttagcggaggcacacagaagactcacagataaaagaaccacattatcatcaactccttcaaaaaagacattcaactttaattttttttcattgtaattttttaattttttgactataaatattatccctattaatgaatagtatgaaaagaaaaaatgatgaaaattaaatatttttgtttttaaaaccttataaaattaaaatgttcgaatttctcaaattaaaattggccattttccacttaccccggctaatgcccatccgtttatcccacattgtgtgtcgaaatatttctccatagttgcaaaatttcgccgcattatttgtctgttcagaaaatcgtccagccaagggcaagcactgcaaatgcaaatgccaaatcaccgatcgctgctttgatttgctttgctcacctgtaatgcatttcgagcccaaaaacaaaaagagaaattggcacacagccaaaagaatggcaaacgcactgaagaaaaaagaaaaggaggagaaaaggaggcatttaataattaataaaataattaccaaaaatttggaatgttttaagcggagacaatgaatgatttgcaactgacaaagggggggggggcattctttgggctcatttattcggcttattttaccgaaatggaagtgagaagcatcgccacgcttaaggcggacgcacaaaattgggcactgattttgagggaaagggaagtgaaagcgaaaagtggggggggacttacgaaagtctaatctcggagaaagtcgccggaagttcgtcaaaagcaaatcccggccgaaaagtcctaagaaaaggtcattaagagagaacgcttatcagagggaaaggcatttgaccatttgtccattgtgaggagaagagaaatgcggttgccatttttgtcctgataatggccaattcccgagaaaatgagcaaattgacgagcagcaaaaggacaacgttggccattcgcaaggtcagcacaatgcgggcactgctcacgtcgcttctcctcctgctgcgaattggaaatgctgcgtgctttcatcccatgccggcccattcttttaagcccaaacgccccctcanaattattattgcgatttctccccactcgcc

SEQ ID NO: 30925 - DNA, 1020 bp, Heterodera glycines
  misc_feature (880)..(880): n is a, c, g, or t
  misc_feature (975)..(975): n is a, c, g, or t
  misc_feature (991)..(991): n is a, c, g, or t
cattatcatttgacctattagagaagctaacaaatgggatgagaaagaagctttagccattggcataatgccaaaaaattttattcaaattgaattttcattaatactaattaattcataaaattttttgatggaaatatgtaatataaaatgcaaagcctaaaataatacagtataaaattcctatgaataaggctaacctaaaaaacattaaagaatgtttagcttaagaaaaatattattttaattttttattaaaatttggcaaagtgtcaaaagccaactttggcctagcctatgcctaaagaataggccacaaaaaaaattagttttccttagctgaattttatcagattttattgaatttttctaaaattttgaggcggagaagaatgggtacaaaaatgatcaacagatgaattggttaataatctccaaatagccgatcatttctcaattatatttcacttccgccgcttcttcttcatctcatttttcttttggttgcgcagacaatggcctaaataaaaaaagtgcaatttgaattcgataaaaacttttgaaaacgcgtaaaaaatgaatgcattttaagcaattttaaaacaaaaggagtaaaaactgctgagtttgttctcacccaatgcaattaattgccgacaatttatttagtatgaaataacaacatcgtttagcaaaaaaaaaagataaaattaaaggttttaacaaaaaatgactatgcgaatgagaatactaaaatatataccagaaaatgtttattaactacataatgaatatttgttttgtaatcaaaaatcagtataaatataatgaaaaaataaataattaaattgtcgttaaatcttataaatttaaaacttanatagttaaagtgaaattgccaattaaaattgaaattttacaacaaattaagtgaataaaataaatccgtggataaacacctaatggaatgaattngcaaaaccccgtgacntatttttgagcacaaattaaaaaaaaaaa

SEQ ID NO: 30926 - DNA, 1661 bp, Heterodera glycines
ctgaaacgaccttcccgatttcggtcgcacatgtccccctcaactgcagcttttccctcagcgatcctggcaaataattaaatttattcatttaaaattgataatagtttgtcaaatttatcctttaattaagaaatatgctttaaaaaattttaaattgagaggagtaatttgttagcaaatttatccgttaattaagaaatacgttttataaaaaattatcatatttccataaataattattaatttaaatttaaatttttgactctttactgggataccaagcttacaaaattaagggagagattcggttttttgaaataattccaaaatttcaaatcaattctcagttttaattgtcgtgaaaatgcacaacttatagacgatactctcgctcaatcaaatcatgtgccatttttggcattgttgtgccaaaactgaccctgtgtgaactttcgtagcacctccaaaaattcttggaatgtgactgtcgtgtcgttttgtgcgtcgtgcgccatgcaggcgaacatccgctgcacgaaaaggtcgttggcacgcatgccgagcgcttcagcaaactccgccttggtcagcgtcatgttcatcaccttggcaataaaacagtgaaatttcccaagactaagtgctcgaaatttagcctcgagaattgagagaaatatcgagacttgaccaaaagtatcaaaattcgatcctcgaaaatccagtttacctgtgcagaagcataagtgttgaagtcggtcgtgtgatcgctcaactgcggcatgttaaaagccttaaaaatgtctttgaatttgggctgtgactttctataattttttttttgaatttttaaggccaatagaggagaacaattgaagcaattggatgacaccaagaatggttgatttatgagaaattttgtgattttccgtgatgagaaaaattaaaaattaaaatttaagtttaatttttaacaaaacattaaaaaatgaatcattttgacgctcattaaagttaaagtttagctttgatttttaagtccatataaagtaaaggcagagtctttcttataaacacatttattttgagttttattgaggtgttttcggaaagggactgaaatagaattttttttgcaatttaaatgcatgataattaaggcccgctctgcgaaatttataccgtccgcaaatgttttttaagccgtaccaggtataatactggcaatatgcaattcaaaaataaattttaaaaatttttgaggcataaattcctttaacggaattagtagacgcacccgcgaatacgcctcgcggaagaaatggtccagcttagcgtgccgcttgtcctttgtctcagccgcttccaacagcacgtcgttgtccgcttcatcctccgccatggatttgccatgccgacgcaaacacgcggacaattcgaagcggaatttggccctaagccaattaacatatgcaaatttaatttaatttaatttaatttgtaattattaaattattattataaaatatattttagaaagattttgtttaataaacaattttaagaaattattttcttaatttaaaatttcataatacgcaaagggttgaaccttttactaacaatcataaaaagaacaagggcgtagtaaaggggggggg

SEQ ID NO: 30927 - DNA, 1856 bp, Heterodera glycines
agagagctgtaaaattgacagtttccgacccttttccatgatgctgtcaaggcgtgggagagggtacttgtcgggcaccgtaacttcgttaagtttgcgaaagtctaaacagggacgaattccaccgtccttcttttgcacaatgacaattggggttacccatggggtgtcagactcaaccatgactccagcttctaaaagctgattaatgtgcttcttcaattcctctttgtatttgtatggcattcgtcttggcgcagatgcaattggttcctcagttgtggttgttatgtgatgttcagcggcagtgaaaagtccgagatcatacctaaatttgctaaaaacctcagaaaattcttcaattaatgctttaagctgttctaaatctttgccttcaaccattgccttagaaaagtcgactacaaatgttgggtcaatttccattttctttcgttcagaaataagggcaaggatttcttttgtgctattttcctttaaaagcccatttcggtcacataacagttcgttggcaaatgccaaatgtgttcctttccaaatccattttggttccatggttgggttgactactgccacttttatttgtttctggcccgcaggcgagacgctattaatgactgacagtccctttttaataagacttatgtcagggcgatcaatgcaaaatgaattttttgggtttggggatgattcgattgaagcatcgaccaatatttgggagtcggccggaatgagcgtgtttttctctgccgacacgcgcaaatcgttaagtaagaggaccgaacgatagcataaattggcttcgttctccccaacaaaaaatttcccgtttaaatgatcgaattttattgggggcaatttctcaaagacatcccaaccgacaattacactgtaatcccgggccacagtaaattcggaatcatccacaaaatagattaatgaacggactgtgtacccagcaatgtttaaattcacctgagcatattctttgaggcgaatgacatgtcctgaggcactcattgcctccaaatcggatgaatatgtctgacaattgagctcatctgcaactgatcgtggtgcaacagtcaaacttgcaccagtgtccattaaacagcggacgtgtgtggagttaatcaatgtctgcaccacggcgtgatgtggagaaattgcattcagatttgggagcattggaaggtctgaattccgttttgagcggagcagtactgaaatagtgataaaaatcagaaatgggaatgataagcagataaatcattgaaggagaagtgaattgaattgagatttgattattcacatcgggatttgcaaaagcattgggaagaaaaactactaaaaacccaatgagtacttttggcgcccgaaaactgaagcgagccctttttaccggtctctttcgttttcctgcgattttgtgtgcctgggtttgggcgggttcaatgagcttaacgagactgagctcaatttcgttaccaacttctacagatgcattcagatccatcatgttgaggcgtgctggagatttcacaattttttgcgttttgtttccaccaaaagtcatgcgtcgtgttgttcctctgccaacgtattcatctctaatcattaatccaaaccggatcaaaaagtctgtaaaaacaatgattatcattatagacaggacgattttgccaatttgttcccaattcccaaacattttgctgcgaatggactcactcacctgctcccattgttcagacagagtctttgttataaccgtgtcctcacttttgattaggaatgtgagttcactttctcttgccaaattggcgtcgtaaaattggcca

SEQ ID NO: 30928 - DNA, 1109 bp, Heterodera glycines
  misc_feature (1065)..(1065): n is a, c, g, or t
caaaaatacaaaaacttccaatttggattatttatggaatttactttgcttattcttttcttttttctggtaaatttcattaatttttcgcttttagccgcagcggcgatgactgaccagtgcgtttttggctttatttacttagtttcattctctcttatttcctttcatcaaaaagaaaatgcgcaccgatgctgatgaagttgtgcaggagaaggtacacaaataaataaataaaattattttaaagaattgtgccaataaattttattataaaggtcatcatggcccagctgttcgacaaacttggcgtcggcccgcacgacctgtccgtggataggctcgaagtcagagcggatgacacgtaaacggcaaaattttgttgtctattttacaatttcaattttcagattccaccgcttcgacttggcacggtgggccattggacacgatgtgagtgaataaatttcaaaaaatttgataagtgctaatttgtgattgatcgaaatgagatttctgatcaattggtcattcatttaatttgtttttcccaggtttggtccccaaatgcccgttggataatccaagtgccgcgtctcttcgacatttaccgtgccaatgtgagcaaataccgtagcacttttctgatcacattcacatttttccattttcagaaaattttgaaaacttttgacgactttctcgacaacctcttcactccgctgtttgaggtgttttctccaaaaagtaaataaaaaaaactggcattttcaggtcaccaatgaccccaacactcaccctgaacttcaccgattcctcaaagtgatcgaaatgcaaaaataccataaaacactcaaatttcagcatgtttccgggattgattcagtcgacgacgagtccaagccggaaaatgtggcatttacgaaggattcaccggagccggcggattacgacaacgaccaggtaaaaaggatcaaaatgatcaattcgcgttcaaaataaatcatatttcagaatccgtcctactcctattacttgtactacatgtaagcccaaatattttgnttcatttttgtctccgatcttttaaatcatttttttctctaccc

SEQ ID NO: 30929 - DNA, 1808 bp, Heterodera glycines
  misc_feature (1681)..(1681): n is a, c, g, or t
  misc_feature (1702)..(1702): n is a, c, g, or t
  misc_feature (1735)..(1735): n is a, c, g, or t
  misc_feature (1764)..(1764): n is a, c, g, or t
  misc_feature (1766)..(1767): n is a, c, g, or t
tatagctacaggagtttcttttgaattcctatacttccaattggccaatcgggctgaaatttttaccaaataaacttttcccttaaaaattgaagctttcaatgctagtcgaaaaagtcaattgcaccacagttaccatatctttccttcagtgtgatcgagtgaccaaaattttaacacccccgggggactatgattttaaaaatccctagggggctggaaagtttttcgtgaaagacgaatatgacagcagaaagagcctaacatttgctacaatatacaaaaaatctcatgtctctacaaattatgcccatagagaaaagaaagaccaaaaatcaattattccgaaaagtacagtaaaccaaaagtaaattgaccattttatgggtagtcggtctttaggcttaccttcctcaacggagaagcattatagaactattacccaaaagcattgtaacaaattttatatctttttatctgtgatttcgtctttcacaaaaaaattttttccacctctatggatttttttttaaacacctacccctgtatttacggtatttggtcacttatgaaaagcaaaaaaaaacaatcacaaaacccaagctaaaaccatgtgacccgtcccttgtattttattaatgtacataaaaaatctcagccttttgattttttggaaattttccccgtttggatgggttatgcataccgtgtatggccaatcaatattgccatttctctgctctccgctctgtgtgaaggcttactttatttttccatgttttctctccgttccctaactcccattttgcccaatgctttttcttctctgtttttctctttgctgttgttggtgctgttttcgctcatctctctctcctctctctctctctctatttttttcttcaactattttcccccctttttccataatttcatttgcatttttactcactattttagttaactattttgagatttttcgtcactaaaggttgcggctctagttatgtgtaaacaggggcaaattaaaaaacaaaaataaactaaaaatattttaaattaattcaataattttttaagtttatacgttcggctcaggaatttttcggtgtttttcaaaaatccaatgtttgggagggaggcggtggtaccggcctcaaacccaataatttatttttttcaaaatattttcctttcccccaattccatcactgttttttttattaactcgccttttgtgaatatttttgatgcatttgcatatttgctcctttttcacttatgaatgaatgttttgattttgtgcatttatgtatttactctcctttttcacctctgtgtgcattaaattaaattgacaaaagtttaaaagtaatttttaaatgcaaaaatatttttgttttaaaaattgttttgggaccaaataaaaataagggaaaaaagcaaacaaaatcatctctgtatatttaatttaagcctgtaatttataaaacaatttaattcattaaccagaatggattttaaattaaatcaaaaaaataaaaattgcaaaaaaatatagattattaataaaccaaaagcttttctcgctacataaattccctcattaaaaaggaaaaattttacaatattattttttttatgcggcatttatttttttaattagagacaaattttttanaaaaatttatttccatgcctntggttttgccaataattatttcatttttaatanataaatttcccagaaattcctccactttnannatgaactgtgatttttgatgattacgaggcgatgagcgctt

SEQ ID NO: 30930 - DNA, 1055 bp, Heterodera glycines
  misc_feature (20)..(20): n is a, c, g, or t
  misc_feature (989)..(990): n is a, c, g, or t
  misc_feature (992)..(993): n is a, c, g, or t
  misc_feature (996)..(996): n is a, c, g, or t
cctatttccaaatgaaaaancgggaggaaaactggcattttttaaatttaagaattttatgcctttttttgttgcaaaaactggctggcttaatattttaaaattttagagttttctttaaatttttgattaattgtttttccgtgattttactagtataaaaatcaatcaccacaaattatcccacccccccccccctctctcatatcaatgttaattgaaattgcttacgatttcgaaattggagttcaacgaaaataaaattccagaaaaaaaactatccccctcccccctctccttcactatttttagaaattggtttcgatttcgttttgaattcatcgaaaaaaaaaatttttttttttaatgtttatattgatagaatattaaatatatggacttattctgcgctaatttcaggtggttgtccaagtgcatgtgtccaaattgtcatttgtcagcaaagtgtttgacaaaagttcgcccattctgtcctacaataagctgagggttggcgagttcaaagtgttcgaccatttgtccatttcgcacatcaatgagatgatccatcgcgtgcgtttgcttttgtttttaaataattgctttatattttttcccataatttttagtcttttttttaataattttcgaaattttcaccgccttttgcctaccaaaacgatttattgttggacccgaaaaattgtttatcaaaaaaacccatcaaaatgatcatttttaagggcccccgattttttaataatttggtacgcctgttaataaacattaaaaaattttccttttttttgtcactttcgcatttcgattttttcttcaaaaatggaaaaatctatcaccaaaaaaaaattatgttaatttttacaatgtataattaacctttttttaattaatccaaaaatttttcgacggattttttttttttttttacataattccaattttacatacagttggaagggcctccttcnntnnccncccccttcttctaccctaggaagatgaagaccctttacgcgaggcaattctgcgcctgt

SEQ ID NO: 30931 - DNA, 1687 bp, Heterodera glycines
atggtgcccattctcagctaagcccccgctttgtctccccccgggccctctcgccccaatgcccacctcattagactttcgctagggaatttgttccacgtccccctgtccgccctcaatatttccctcctcccccgccccggcacccacttcaaagcggcgaaaagaataaagcaaaaaacagggggagggggagggcatggaattggaggggtcggcatggccatgccgtggcacactttccccccccccctcccattggcgcgccctttggcccgtccttttcccacactcaccactcgaatattgttaaaaataaagtcttctttcttttttggtggggataaagacaaactgcaatcgatctgtctgctgcccatttccgcttgtcctctaactgatcccaaggtcatgcttcttggccttagaatggccaaaggatcggatggaattcaatgagggccaaatcacttaatgccattaaatcatttaaaaattttcacgaaacttgaaatttttgtaaaattcccactgctgttgtgccgtcattctctgatgcccggccgtccgtgtcgatccatttaaaaactataccgtttcgaaattcgcatttttaaatgccaaaaattaatatgccaaaaactggcaaaccttttttcaatgaataaatttgtgcatacatatatatatatatatccctctcccctctcttttgttgtgatttttcggagcgattgccccaaaatttggcacattcgcccaatttgaatttgcatttttttcattgttcataaaatgccaatttgcaaatttgactctgttggtgtgtcaggtgagcgcctcccgccgccacccgtcgcttcagctccctttttctcgaatcaacgccaaaatttgtgtgcccaacagcagccccagcaaatttatgtccaaatgaattacacggcaaattgaggcaaccaaaattttgtgccaaattgccgagaagcgaaaaacaacggacgaacgaaccattaaactgaagaggagagaaaaggaaaagcaagcacaacgagaggacgaagaaaagagcagcagacggagcagaagaagcagcaaatggtgcgaccgacgacgggaggaggagacgaagacgaagcagaaacaacagcaggaggaggaggagagaaaacagcagcaggtgaggagagtaaagagatggagatgagccagggatgggaggagggagctggagcagtaatagaaccaatggaaggtcaaaaatgaaaaactacttgtgttgctggggtggggatggacatgactgatgggtgtttgctgggcgtacctttgtgaaccgggaggacagattttggctgaattcaagaacgactgtattggtgccgaccataagggacaaagcaaagggatgtggcggcggggggcggcgaggtcaaggagcagtaattgcccagtcgacacgcttaagtggacacaattcgctcgatttatctccccccttcccttctttcgccatttcatttcattcatccgtccttcctcgtcgttgcaccaccattcctttttcttctcttcccttttcttctcttcccttccattcacttatcttcctttttcttctcttcccttttcttctcttccccttccattcacttatctttctttttcttctcttccctttttcttc

SEQ ID NO: 30932 - DNA, 699 bp, Heterodera glycines
attgagtcccactgattgaaatgctggtggattgagtcccgttgattggaatgttggtggattgagtcccactgattgaaatgctggagggttgagtcccggcgattggaatgttggtgggttgagtcccagtgattgaatgctagagggttgagtcctgttgattggaatgttggtgggttgagtcccactgatttgaattcgggagaattgagtcccaatgattgaaatgctggagggttgagtcccgttgattggaatgttggtgggttgagtcccagtgattaaatgatggtggattggcgcagaaaattgtgggggggccgaaggccccagtacgaggccgcgaagcggccgagcgagtacctttggcgcaaaaaattgttggggggggcccaaggcccccgtacgaggccgcgaagcggccgagccctccccaactgttcaacatcccaaggcacacaaaaagttaaaaatgctaaagaaatttgctgaggttgagtcccggcgattggaatgctggagggttgagtccttttgattggaatgttggtgggttgagtcccagtgattgaatgctggagggttgagtcccactgattgaaatgctggtggattgagtcccggcgattggaatgttggtggattgagtccctagtgattgaaatgttggtggattgagtccccgttgattggaat

SEQ ID NO: 30933 - DNA, 981 bp, Heterodera glycines
cgcatcattccgccgatgaatttgcttagtgtgcgctctttttccctttttcggtcattcttccggttcttttccttctctaatattttcagcaaccgaaggatgaaaatttgcaagaaattttggctcgtgggagggcattcccgcgcaacacttacggcaccatcagtgccatttcgttgtgggaaaaggggcggggagaggggacgacccccgccaaagcaaccgaacatttgggcgaaataaaagcacaaagaattattggcacagcaaatggaagcgatttgaaatgctaaacggacaatgacaagaaaagaaaaagggaccgattggaaaatggaaaagttacagaatttgcccattcgtttaatcccccgcctactctttccaaattcgtttttcctattttcatcctccgattggcctatcgcgcgactgtcttctgctgcagcagcatcagttcaagtatttgctgtgctcatttggcgggaattggtggtcaggacaaaggtaatttgtggggatgggtgggaggggattaagcaattgggacgaacgaacgaataaatgggagtgaaagaagggaaaaggaaagatgaagcggactcgaaaagggggtcaagtcgaggggagcacacaaaggcgcgcggttggccaaacattagcccttttttgtcacaatttttttctctttttttgagtcaaaatgcccgacggtccatccatctcaaaatcggttgggtgacgaagaaatttccttcgtatgaattccttttttttactgacactgcgcaaataatttgggccattcattcattttcagtcagacggacgccgtaataaacgagagaaaaaagttcaattacacaatttaaaaagaattatatttaaaaataaatgagtagttgtaacagaaaggaacaaacgaagccatgtgattcggaaattttgtaaatgttttctcgggagtgagaatgtttt

SEQ ID NO: 30934 - DNA, 1065 bp, Heterodera glycines
taacttaaaataattgattaaatttttgagattgtcaatgaagacggaagcacaaccacacggacaaaaagctcaaaagcttttaggtaaaaataaataaataaatatattaaattagataattaaattttcaaagatttttttataatttgccaagtttaaaattatttaaaatttaaattttaatccaaattaagctcacgttacacccgtcatgaaacatttgtgaatggggttcgccaagaatgtacaacacggttccgtgccttcatggaatatgcgggcccggacggcggcttttgcatacggtaataattggatacacggtagattgtggacaaaaaaactgtacactaaataatgcatatggaaatatcgattgtgatagttagtgtacggtagacaaactgacaaaaaaagtggcatatactgtaggaaagaatacgatcgacggtgacaaaaaatgatataatgtagagaaaaacggtagacagtgcccgaaaatgatatactgtatgaaataatacggtagacggttcacagaaatttaaaaaaaaaattcaggctcaataacaacgcggacaaggatttgagtgaggatgagggcatcgatttggaggaggacacgcggagccgaatcagccgatcaaggcacgacggcattcggccagaaattcaaaaaaaaaaaattgccattttaagcctctctgaaatcccggacacgcagtcggcactggtggtgatcggcaaacaaggcatgccattgttggtggaccagcaaacggtggcaaaacggcacgaaaaggtggcacgatgggcgaatggcacattttaatgtcctaaaaatacgagtgtaaaactgcgattttctgaggggggagggggaacaatgacaattcgtacaataatttgtttaaaactgggaaaaaatgcgagcttttttcttaagaattttcaaaaataattgtttgatgaaaaattaaaataaagtttccaatttttttcgttggaaaattattaaaaagaaaaattcaaaatagaaattcaaaaaatctaaatgccaag

SEQ ID NO: 30935 - DNA, 939 bp, Heterodera glycines
  misc_feature (847)..(847): n is a, c, g, or t
  misc_feature (916)..(916): n is a, c, g, or t
cgacgatgcgaatcaaatcgcttgcgctgttctgtgtactccgaatcccacatttgcacgtacgcttgtggagtacagtacttctgaagggatcgtactcatatgaaaatggtaacggcgtggtggtaatttaattggttttacatacaaaaatgaaaagcgcatcccattctaaataacaaacaaaattacgccaaatttgcgttccttgaagaagtatcggtagccccggtccagaaggtaaatctccttgtagtccacgtatgggtaacgcgactcgttccggacccggtcaaattctcgcagtgcaagagccctgcaaaacgaatcggattaaaattaggaatggagtgtcgaacattttgggtccccttttctgcgagtactcgcagtagaagatgggagttcgcacaataatttcgccgaaccgttcttcctcttctgggtagaagagcttctcaatggaagtggtctcccacaaattcagtgagtacttaagcgccaaatgttggtaagtgcggagaaacaacagaaacagacccaaatgtggcccgcatcgtattcgtaaggatagcgacaatcgatcagaatgaaccgccgttggaactgttcttctgttagtgaccccaaaaggttggccatcgtatcggcgttaatgctgcggaaggctttgtgcggaacttggggccgttcaacggtgtcaagcgaatactgctgaatggttgaagaataggactcaaggggattagaatttgttttgataaaaaaagttagttcttaacggatgacacaccaattcccgaaccttgaacccgaagtcgaacaaagttggaaaataaattttggncaaacagctttgctgcgaggtggtggattgagccaaacgaatgccggagtccctcgaatcttgatcttncacttgcacatacgattccatct

SEQ ID NO: 30936 - DNA, 1788 bp, Heterodera glycines
atattacatatgtacatatttttatacaattttctttattgtcccattttttcgtacatattttgcaatttttaatattttttaaggaatttttttattaaatgcccccaaaaatatccaaaatttcgcaattttttaaaaattttgagaatttatagaattttttgtgaaaagtaaaattttttttgaaagtgtgctccaaaaaaatattttttttaaatactaaaagatgattctaacaaataagcctatttaggtcatttttattgcaatttatgcctgtttcaccctttagtaggaattttttcccaaaaaaatcaccatttaaaaaattctatttacatattttagtacatatttcatacatattttagtgttttttatcatattttatttacatatttcgcgatttttcttacataataaaagaagccctgctaatcaattaaaaataatttagattaatttaacttacctatttagtttaaaaaatataccgtaatttataaaataataattagaaaaataaatttgtttaaaaatgttaatacagtcatatgcaagttttgagacaagtgacaggtggcaaaaataccaattttctcgaaaatggagactgtatgaaataattacgatatcagaaaaaacccttgcctgtaattaagagaaaagagcaagttatttatatttttgctagaataagaatttggctgtggtcaaataaccttcgttttacggtttttcagtttctttttttcttattatgtaagtgaacaacaaattctttaaatattggtttgtaatccctatgaatatctaaaacaatttgagtgggaaagcatttgaaaaaatggggggaccttgacgactttaaagatcgaaagtttaaaaattccttaattttttaagtgaagatgttatatgaagaactttatgtaaaatttgcaaaataagtgaatcaaaagggacaaggcaacaagaacacaaattcacagaatcaagtaaaaaagtgccgcactttgcagtccaaatgtttgataaacaatggcaacgtctcaattgtcctgggccatcgctccgttgtctcttcaatcaaattcccattacgaaatccatcaatcttaaaaagtgcaatcacaatgcaaattccgattccatatttttccccaattaactctcacttgaatatgatccggtctgtgtgtaagtgtcagcaaatcgccatgatgacggagaccattcccttttggcgttctgctgaagaggaaagaaccgctaaattgaagcttaatgcttattcatcactaatcacccgagattaacctcctttcctccaaagacagcttttgctcttctccgattcgtttcagaacggaaaaagttgcggcatcgtttaaactgaaaagtggcggctgaatgctaacaatgccgaaatcgagctggtgaagcaaatcattagaagaaacaaatgcaacgggggaagtcggcgatgaaaatcgcttcatccgatggggacgagcagcggttgtcgtggcctctttcatggcttgtcgcctcgtcaccatgcgcttctttaccagtggcatcccaccatcgctggtcacttctccgtctgatgtgtttctggccatgtcttctccacgtcgcttcccccttttccttcggcacactgtttccattggcattcttttcgccgttcttttatggatgtttctttggctgtttcgtctctttctcccttcgtcgtccatttggcctttgtttctcgttcgctttttctctctgtgc

SEQ ID NO: 30937 - DNA, 1176 bp, Heterodera glycines
  misc_feature (738)..(738): n is a, c, g, or t
ttaatacactttgtctcattagctctttcccttgtttatttacttctttcatttttgggtggacattttaggtttttatgaatttttctcccattctcttttaatattccattgcatttcctcccaccccacgccacctcactttagttttatgttctccaaataaagtttattgcccaattttgcataattcgtttgctttcaccacctgtcccttccctccccccccctttgttgaattgccagtcaaattccaacaaaaaatgccatgcgggcattttatcttttattgtctcccgggaagagcttgctgtgcctgcggccccatcacaacaattatttcgattgtcctcctcccccctcgcatgggctgcgattattccgcccattgggtaataggccgtaaggaagcgaaaatttgcccaatttgaaaacatttgagcactcaaaatacccaaaaatgccaatgaatggacggtactacctaaagcatgccaaatccaactgtcttacttaattaattcatccttatccgtataatttccctgtcccctgacggcgagagtcagaaattgagcacaaattggtcagtagctctctcatcaattatttacccctactcattcaccgctctcggtataaacggtcaagagtttattaaagtatgggaaaacgacaatagtgtccctactcaagtttatttaccggacatgaattttaaaaccgccggaggcctgngaaataaaattaacgaagcattcagccatcattacaaaatcaaaaaacaacgtggggaagagagaagccaaggctgaagaaaccaaagactcaaaaatagatgtcgcaaagagggccgcaaaaacgccccgggaaagatggaaaaaagacaactcaaatcatatcaaccattgtcttccagttccatccaaaccaaactaaaaaaccttataaaaaagaaaaccttcaaattttaaaaaaaccctgaaataaaaaggggggtttgaaaaaaagggaaaaaaaaggggacccaaaatttaaaaaataacacaaaaaaaatttaaatttttttcaaaaaaaaaaaaaaaaaaaaaccaaaaacaaaaacctttataaaacatgggggaaaaaaaaaaagttttgtgaaaagaaaaaaaaaaaaaacacccccgccccccc

SEQ ID NO: 30938 - DNA, 1730 bp, Heterodera glycines
tttaatattaatgaatgataggcgcaaatgtgggacttccagggagtaattaaaaaaaaattcgggtggacatattccttctatgggctggtatcttatttagatcccttttatttttatgattttaaaataaatttaaattggcgtactcaataaaattgcgtataactttgacattgtcgccattctggtaaagccaataataagcatcgattgctctggattcatccttatcgaagcggcttatcatgacatgacggcagttgtaattatacaaaagaaaacagttttcgggctcgcaccgtagcacaagatttgtatcattttcaagtttgttggaaatgaattcttgccgaatatgtctgagatatcaataatatataaaaccaagaatttgagtgaaactaatttgctaaacccgaataggcccaaataggaagaattattggcaaaaataataagaaaaaacactagcggttgaattaaaaaatgtgttaaaaacgaaaaaatattccgattattggtcggcataatcaacaagagagagaagaaaatgaaaagaactagagaaggagagagagagagaaacacaacgaaaacaaaaacaataataagaaaattaagagggaaagggagagcgataaaagtaaaggaaaagagaaaaagcaagagagagaagaaatgaaagaaaaagattagagagaagaaagcgagaaagaaatacagagagaggtggtgaatgaattatgagaaaaggaggagagaggggaagagggagaaagagagagggaggaggtggtgagaaaaagagatggagagaaataaagacaaagagagagagagaaagcgacaaaaaagagagagcgagcgaaagagaacgaaaaaacaaaaacagaagtagttagagatagagagaatgggaaataaaagagagttaaaggaaaatagagagattaaataattgagagagaacatgatagagagaaggaaaaaagagaaatgaagcgagaaaaataaaggaaaaagagagagagaagaagaagagagaggcagtgagagattagaaagagaagtgaaactgagtgagagagagagagagcagaggaaggaaggggagagaggaatggaaaggaagagaaaagaaaaatgacgagagagggaaaggaagagagagagttaaagggaaagagagatagatggagaaaaatggacagagagagagagagagattaagagggaaagagagaaaaaagggaaagagagagaaaaacaaacggtcagagagtgagaaaagaagagagagtttaagggaaagagagagagagagataaagggagggagagaaaggaataaataattgagagatagatcgtgacatagagacaaaaagaaaaaataggaaggagaaagtagataaagaggaaagaaatcatacttggatgaaaaactaatttattaataaactctatcaaaattttgcttttattatttcaaaataaactgagaggttggcgcctgaagcggcgcctaagcgctcgtatatattaaattaccagcaaaatacttattcataaatttatatttggatttatgcatttttgagcttattttcaagagccgaacgtttaaattatctctgaacaacaacaaaaactcactttccattgccaattaagtttagaccgtgaaaatctcgctgttcgcttcagcaattgtgaaatgactctaga

SEQ ID NO: 30939 - DNA, 1085 bp, Heterodera glycines
  misc_feature (1011)..(1011): n is a, c, g, or t
  misc_feature (1030)..(1030): n is a, c, g, or t
  misc_feature (1044)..(1044): n is a, c, g, or t
ctctctgtcatgttttcgagtaataagaaacaggcgctcattattggtaatatctgctaaatcatccagaaaatatgaaacaaaaacatggacagaacattcccaaacattgacaaatacactaccagaaacagacacaaacattgccgaacatcggctaaaacgctaaaaaccaggatagagatgcccaaaacattccgcctgtttttggtatgcgcctgttttggcaatgtcaatatttgctaaatcatccagaaaatatgaaacaaaaacatgggcagaacattccgaaacattgacaaatacactaccagaaacagacacaaacattgccgaacatcggctaaaacgctaaaaaccgggatagagatgcccaaacattagcccaaaacattccgcctgtttttggtatgcgcctggcaatgtttttggcaaatgttgggaatctctctctgtcaatgttttcgagtaataagaaacaggcgcaaacattggtaatatctgctaaatcatccagaaaatatgaaacaaaaacatggacagaacattcccaaacattgacaaatacactaccagaaacagacacaaacattgccgaacatcggctaaaacgctaaaaaccgggatagagatgcccaaacattagcccaaaacattccgcctgtttttggtatgcgcctggcaatgtttttggcaaatgttgggaatctctctctgtcaatgttttcgagtaataagaaacaagcgcaaacattggtaatatctgctaaatcatccagaaaatatgaaacaaaaacatggacagaacattcccaaacattgacaaatacactaccagaaacagacacaaacattgccgaacatcggctaaaacgctaaaaaccgggatagagatgcccaaacattagcccaaaacattccgcctgtttttggtatgcgcctggcaatgtttttggcaaatgttgggaatctctctctgtcaatgttttcgagtaataagaaacaggcgcnaacattggtaatatctgcntaatcatccagaanatatgaaacaaaaacatggacagaacattcccgaacattga

SEQ ID NO: 30940 - DNA, 1182 bp, Heterodera glycines
aaaatcgcctgcggccatatgagattgatgcaacccgaggcattgctgatcgtccacgattgaaaaaatacataaaaaatgatgcagcaattaagcaaatgatcattgcatacgatatcaaagagaatcgcaatgacgctgatgtgctttcccacttgtacgcattacaatatcgtttagggatgaagggttttgaagcgtgggattagaattttaacgatgaaaataaaagaattgttgttgataaaaattttgtcactttgggtgggcgccgcaagtgtcggcgccgcaagtgtcactttggctgggcgccgcaagtgtcggcgccgcaaaaaaaatagccgcaaatgtcgggccgcaagtgtcagcgccgcaaaagtcggcgccgcaagtgtcactttgggtgggcgccgcaaatgtctgcgccgcaaatgtcgcatcaccatttgaagcgagtcgtgcgggggagtcgttttgttgccgaattttagcgacagctcgagttgttgaattgttttttttttgtttttacaaaaatccgacaatcgtggcatcattcgaaagctttacatttctaattccaacccgaattcgacgtattcgaacaattttttttttatccaaaatcagtttttctaccccaaattcgtgctttctccaagtcgactccttaagtaatatattttaaattttttacaagatttattcaacttgtcgcataagattttttgtaatttcatcagttcatttttcctttagatctcaaccgaatagaggagattaggaattattttgcgtttttaaatggaaatatttattataattatttaacttttgcttaattaataatttttttttgattttattaataagtaatatttcatcatgacttttagggaatttaataatataattctttttcatttttataaattttattttttgccggttgagtaaggtgtctcatagctaatagacattatacggaattttgacaaaaataacattgtgtagatttgtcatgttttaaaatagacacaaaattataggtggttaaattcaaatgattatatatagaaaaaaaatagtgtagatcatttcgtaaaaaatgccaatatgcgcgtttcgaaaaacggcaagttttacagattttttccgagaaatatccgtcataacttttct

SEQ ID NO: 30941 - DNA, 1188 bp, Heterodera glycines
ttttaagctttttaacaataataattttggatttaatatttttttcccttttttattctctacgagagaaataattttgtctactgacctattcttaatcgcgttaattgccttcgcttccgatcatttagtgatcaatttgatttaataatcaaaaattttttataaaatttttttatatactagaaaaagcgttaattgtatttcccatactcttaaatattaatttaatgtgtttaaattaaatcgtgacccaaaatgggtggccaaatgctcggaacaagttgcatctgcgattcagccgaactgcgacgaatagcggcacgaaaatttcatcatttttattgagggctgcgataattttattaatttctgtttaattttctttaatatcaaacaattattatgaaaataaaattttaactgaaattaattttacaaaatttataatcaaaattgtaaccaatagatttaagagttttgttgcgaaacaaatcaaaattccgtaattattaggatgtcaattttatgtaaatacatattttttttcctggattctccatgctctgaatagtatgaaaaacactttattttttgtgtccgcgaacgaaaatagggacttttatttacatatttttacatatttcgtacatttttggtatacatattttgcacatttttcttatatattttattttttacgtctttgaggatttttaaattgaacaaattttttaatttaaattttggcctaccaattatataaaatattttttaggtattttatacatgtttagtatatattatgaatatttgccacattttcttagattttttgcattttttgaggatttttaaagaatttttgttaaatgccccaaaaaatccaaaatctcgcaattttttgtacatattttcattttttacatgttttaaaatttagagaaatttcttctgaaaaaaatattttgaaaatgtaccactaaaaatcggttattttccaaaaaaagagatacaaaaaccaaataaacatttaaaaaattttataaaaatctggtacatttttggctttttgttcatagttcttacatatttggtctttttttaaacatatttatttacatattttgaccactttaagtacatattgctgacatccctagtaattatgtctttataaattaaata

SEQ ID NO: 30942 - DNA, 1516 bp, Heterodera glycines
ctaagggcatcacagacctgttattgctcaatttcgtgcttttgaacaccgaaaatccctctaagaagttgtgcccacagatgcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggaaagaccggcagaaaagccaaccgaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagttgataaggcagacacttgaaagacacgtcgccggtacaagaccgtgcgatcagcttagttgttctgagtcaacactggacgcccggagggcgcttggttttgtggcgaaaaaatgcgctccgctctggggagattggagctttggtgcatgtattagctctagaattaccacagttatccaagtaagaagtcaaggtcaagtaaattatagctggtgtaatgagccgtacgcagtttccctgtctggcaggttaaacttacacatgcatggcttaatctttgaaatgaacacatcagttcaggcaggatcaaccagatagctgctagcgagcgttgccaagcgccgctattacagccgtcttgtaaagacggatagtttcagcaga

SEQ ID NO: 30943 - DNA, 1018 bp, Heterodera glycines
aaaaatttcaaaaaatttgatcgtccataaataatttttattgatcaggggctcaccaattttgcagagatacgtatcggagcactacaaattcttactaattttcctagatttattaaacccggtgaaaattttttgcagacacccaccacttttgcactaaaaaaaatttcaaaaaatttgatcgtccataaataatttgtaattgatcaggggctgaccaaattttgcagagatacgtatcggagcactacaaatgcttacttattttcctagattttttaaacccggtgaaaattttttgcagacacccaccacttttgcacttaaaaaaatttcaaaaaatttgatcgtccataaataatttgtaattgatcagcggctcaccaaattttgcagagatacgtatcggagcactacaaatgcttactaattttcctagatttattaaacccggtgaaaattttttgcagacacccaccacttttgcacttaaaaaaatttcaaaaaatttgatcgtccataaataatttgtaattgatcaggggctcaccaaattttgcagagatacgtatcggaacactacaaatgcttacttattttcctagatttattaaacccggtgaaaattttttgcagacacccaccacttttgcacttaaaaaaatttcaaaaaatttgatcgtccataaataatttgtaattgatcagcggctcaccaaattttgcagagatacgtatcggagcactacaaatgcttactaattttcctagatttattaaacccggtgaaaattttttgcagacacccaccacttttgcacttaaaaaaatttcaaaaaatttgatcgtccataaataatttgtaattgatcaggggctcaccaaattttgcagagatacgtatcggaacactacaaaagcttacttattttcctagattttttaaacccgggtgaaaattttttgcagacacccaccacttttgcacttaaaaaatttcaaaaaatttgatcgt

SEQ ID NO: 30944 - DNA, 1799 bp, Heterodera glycines
atgtttactttccatgcgaaataaatgagaattaccttctcattacaccggtaaacacgttaaattcgtaaaatttactcccttttacaattgttctttttgcgctaaaatttcgcgcaaaatgacaaataaataaaaaacattttccgctcttttttttgtgatcggattaatttcgcgcgtgaaattttgcccggcgctcactcattcgcacaaaaagtgttccccccccgggggcgaacaaagttcacccagcaaaatatttgtcaccagcacataaaataataccaaaggctttattcattcactcaaattatttatttttgtcagccaccgccggcgggggaaaagcgctttatttgtgttgtttttgtgtgcaagaaggttaagaagcatccgacagcacaaattagtgggtcccgggctgctggtgaatgaatggatgaaaacaacttctttttttgctaattgatttttgcattttcaatcattttgtaaattgttaatttaaaatgaatttttgtaagtactaaataggaaaaagtggatttttaaattattcggcgattgactttatcaaatctgtgaggtccggacttgaaaaattctaaatttccgttttttaggtgcctgattttacagtgtgtttttgacgatagggataactttttttaatatttttggattttctttttcattatctttttattttaaattcttttagaaaaaatattaatgaccgaaggacaaaggttattttcattttcataattttgtttttcgcttttcatcatttgtaatttttcgatttttcctttataaaattaaattttttttacacacagaaagaacctttgccctcatattccccgctctaatttccattcatttaatcattaattacgcattcattacgaacgctgctgatcatgacattccccatcaaactcgtaattttcattgtgttctgttcctgtgacttatggcctttgttcctttcgtttgggtgggaatgatcaaatgttttggtctgtctgatcactattttttagaggttgtaatcagtattcagtttgtttgaggtgcaagccttctgatcatttgaagtttcgggtttactcacttctgcaaggggggcgggacgatcactatcactttgtttatggcccaatcactttgttgcgtctgatcactttgcgtctgatttggccgcgtttctgcttctccttttctttgatcaaacaaagagagcacaacgaacaattagtcgcttaattgcttgcctttcttttctttctttgtctttgtcattgctggaacaaaagtttggacgtgaacagagttctccattttgggtgaaagtttgctagcagaagcagctggaaattaatttgtttactttttctgctcataattcattttgatggaaaagtaaaaaaaaattgtttaattttcaatttttaagaattttttgagaaaaaattcacttaataatgattgatatttgaaaaattaagaaattttaattttcaaaaaaatgtagcatggaaattttttgaataatttcagtcgaccttcatctaagttttttcttcttaaacagatttgacttttcatttatactttttttacaaatatttatttattttttttatttatttcattttttatattctcccctgaaacattgatcgttttgttgttcattctttctgttcattcccgcctaagggcggcttttcattagtcattcattcattcctttccacgaatttgtgacttttgccctcggaagaatg

SEQ ID NO: 30945 - DNA, 1030 bp, Heterodera glycines
gctctgtttcttagcaaactttgcccaaaaatgaccaaattctctattaaattttcaatttcacggtaaccgtgaccgtgaatcacggcacaccatagtaagggcgatgaaattaaataccaaaaacatgattattgttaaataattattaaatgatctgtaaaattgaattatttgcatgcagaattcaaaaataaaggaattgtcatgaatccgaaaaaatattggaccacaattaaagatataaaatgacaaatggcatatatattattctctcattaacttttgtcatgacctaaagaaattccaaatcgacaaattaaaaaatggcaattcagcggaattataaaaaaagaataacggcctcattcctaataactagagtatggatacaagttatgtaaacaattcgacatttaaatattataaaaatagtgagaaaaataagataatttaaaaataatttaatatatgaattatttgatttttttaattttaaattcttgattccattgaaaatctaattactaaaataacctataaattttcaaaaatatattgtttttatagatatttttttataaacagcggctgaaataatcggagttacacgagaatgatgaagaaagattcctttaaaaactcaaatatgaataaatttttaaaaaatagtaaaggaatttgcaaaaatttttgcatcaaatttttgcttattaagtttaaaaaagatagaaaaacctaaatatgtaaataaaaattaaactcaaatttaattatattgggaatttatgaacataagttcatcagagggtgaattgtggctttttctataggtacgaaaatatataaatattaaattaatgataaaattaaattgataatgtataaacaaaaaatcgataataaattaaaattaaaaagtcaaaatactaaacttcagataaggaacagctaagagttttttcggtgaaaattgacataggagatgaagaagagttgtcattggcaaaaccatcaacaattttcagaa

SEQ ID NO: 30946 - DNA, 922 bp, Heterodera glycines
  misc_feature (881)..(881): n is a, c, g, or t
  misc_feature (916)..(916): n is a, c, g, or t
gttttgtcatccatcaaaatcagtggctgcgttcctcgctaaattgtgatgaagcatctgaaattaaaaaattttgatacttgaaggttttatttaaattaagaaaaacttaaaatcccaggcaattaggtcaggaaatgtattctaagttttgttgatacgaaccccaaaatattaggtaactaatccgattacatggtcattgaagttggtgtcagggttgccattgatcactcgtaaactggcaatttccgacgcaaatttaacgaaagttaaattgaatttaaaaattttttcatctggccgccgctcaaaaactgtgtacaaatcatccatcattttggccaatgtgttgatattattggccaaattttgctcttcccattcataagtttgcgcgcgcccaaaattaactgcccaattagtggcaattaaaataaaagttagtgaagagtgccttagtaatttcatatttacaattattcgaaacaatttttacaaatgcaaatgctaattttcattttttttttgccattcatcgaattgtattgatcatctgacgtgtcattttagcaaagattatgccaatacctctaggctgataatgccacacgacaattttcacccaaacaaaagaaatttttaattcgcatttttcaaaataaaatctcttaattcattttaatattccttctaattaaaagttttttcatcgataaagttgattcagacaaataaaaaaccttaaaagcatggcgaccaataaaacttttttgaaaattaatgaaatttcttgaattttgcaaaaaaaaaaattagtgatacaaatgatttcaataattaaattttagttgtttttgagcaaaattattgctaattanaacttttttgaatgaattttattatttcaaaattncgtttt

SEQ ID NO: 30947 - DNA, 1254 bp, Heterodera glycines
  misc_feature (1146)..(1146): n is a, c, g, or t
  misc_feature (1167)..(1167): n is a, c, g, or t
  misc_feature (1179)..(1179): n is a, c, g, or t
  misc_feature (1226)..(1226): n is a, c, g, or t
  misc_feature (1246)..(1246): n is a, c, g, or t
gccggcgctactttaaaaaagatattttttgaattttatcaaaaacaatagggcggagggacccttttgttctgcaaaaaatgtttgtgctaaaaaaaccgataaaattcgttctccggggttttaagggtcgctgatcacgaatttgacatttattttgaacaatttcgaatccccaaaccgaacccgaacaaaaatcgaaatttgaatttttcgattttatgatttttttgtttaaatttaggttagtaaaagggaattgatcaaactagagattaatcctgcgggatcccgccccgcaaaaaaatatccgttccattcccgaggcggggtgcgaaaaattgaaatttccgggcttcaccccattgagatcaatcaaaattaatgattcattattatttaggcgaaaaattggggtggaaggccggatttgaaccgccgctcggggccccttacgtggatcagttgtcttagccactagaccacatccaccactggagggatgactgttgttttggggtcattttccttcattttggcccctgttgcttttgctcccacagcactttgagctcccacagctattttcgatcagccattacaaccagttaagtcactccggaactaagccactcatcatattgactgtttcgatcgttggatggaatggaatttttattaacttatagcattattggtgcaaaatctgttattaaattgtacaaaaattccaattttttctggctgtgcctatcagtagcgcctgaacctttatggcaaccctggtttagtcggtataacggcttatacagacagttgtcccaaaaatgaatataccaaagcaatattgctgttgaacgttcgttatcacttcattggaagtgcaaattaagtcacggaaaatgaggtgacctgactcacatttttgtattttttatgagcagaatttttttaatattttgtaaaaaagaatagaaattaaatgacccggaatttaagaaacaccataatatggatgaataaaattttgcaaaaaatgaatcatccgaattttggaaaatctaatttcgtaccaatgaaaggggcggaaaatgagcgttggaggacagcagacaaatgcattttatgaagcgacttttgcctttnaaaattggagcgaatgacaangcccatgatganattgattttaactgactaaggagtatattcgcggatatggtttaatnttatgataatatctgaattntttgatca

SEQ ID NO: 30948 - DNA, 2030 bp, Heterodera glycines
gaacggatttttaggttttcacctatttttttacggatagcatatgctgagataagcgcaaaaaacacattttcttccatcacttttcgatttagggcgactttcagcaactattttcaacaattttcgcttatgaaactttataacaactattttgacttgtgaaatttttaaaaaattattttttcaactatttctgcttttaaacaaaaattcttatgaaaaatgaaaaaaaacaaaaaaaatgcaattcgaagtattgacgttaatttttttttaaatacacctctaagaatcgatttttcaaaaagcaaaaagcctggccatgatttgccggacgatcgaaaactttttgtgaaaatcttcaaatgtgtttgaattataattgtgcaaccgaaaaggataaagatgcgaaaattttggaaaattcacactttattgacatgtttttccaattttggcaacattttagcaactatttaggtacctatttcgcgatttttagtatttgagaattcgatatctgcttttttccatattataaattatattgtgtattgtttgactaacttaattttcattttaatttttttcaaaaatttataaatactttgtaaaacgttcgcattaaaattgtatacttagatttttaaaattttattcacttcattattcattattaaaaaattattcataatgttttctaagacttttaattttcaatttaaactattgatattagaattattgaataaagagtatgtattttatttaatttatttttctcgggcagtatcaattttatgatgcgctcatgttgcgaacttttaaaaggattgtgcaaataatcaaatgcttgttttaataattatagaaaattatttgattaatttaatattatttaaataattttattttactgcttatttttcatcatttttcaatcatttaaattaaaaaaaaacattttaaataaatttgtaggtgatagatttggttttgattagtactcgttttttattttttacttttttttatcttatgttcctgtcacgtaagcgggtgtaattcatgctcataatttttttgttcaaataaatatttataaaattaaatatttggtttaaaatgtaaacaattattgtagataatataatttatttttttggtgtgctttttatttgtatttattttctaagctgaaatttaatagaaattattttttatatttttgctaattggtttgattagaaaataactatgcttttaaattttcaattgataattattttaaaattctttttatatttagaacttagtttagttcgcgattttaattttaatttacaacaatgtcgtttatttccttatcaattcttttgcgagatttttaatattttctaattatgtttttgctctttttgaaagctttcctatttaaaattaattatatttcatggatgaatgaatataataacaaataatcttttcattttataaaaatttaacatttatattttgatttttgacatcattctgttaagtttcatttttagaattatttttttgcttgacccttttttatttatgtttgatatttgtattcaaattttattattttgccttgacttctctagtgagtaaaaatgaattcaaatttttgaattaaataaacaaattattagtaaagagtcagagattgcaacataagcgattcagggaataggctcccatgcttctaacagcataaaatacaatatttaaaatattaactattcagcaattaatcgcgacatataaaagaaagtttaaattatatgcttaaaataataaaaatactaaaatattacaaaaatccgcaattttttgctctataataattattttatttcatatttttatcactttttgagaattgttataaaataaaaatgacttttggattcgggaccaaagaggtgtgaacaggatttttgagtggaaaattttttttcacaaaaatctaccaaaaatatgtctttaggggttat

SEQ ID NO: 30949 - DNA, 980 bp, Heterodera glycines
ctccctatcatgctcgagagcatttgtatgtgtataacatttatcaaaaaaagagatagccatttttctgggataacctctaaatataaaaatcctctgtgaaataaaatggcgattgtccacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcaagcgcttttgtgaggtataaaatttctcaaaaaaagagatagcatttttctgggatagagtataaatttaaaaattcc

SEQ ID NO: 30950 - DNA, 1231 bp, Heterodera glycines
atcgtgaaaattttggaaaaaggactatctctttttttggtctacagtcaagggaattccaaccgcactctcagcataaggaccccgatactaattgttctggaattattttctcagcgcatttgatcgtgaaaattttggaaaaatggctatctctttttctggtctacagtcaagggaactccagccgcactctcagcataatgacgccgatactaattgttctggaatttttctctcagcgcatttgatcgtgaaaatcttggaaaaatggctatctctttctctggcctacagtcaagggaattccaaccgcactctcagcataatgaccccgattctaattcatccggaatcattgtcccagcgctcatgatcgagaccaatttagaaaaaatgtctatctccttatttgctatacagtcaaggcaattccaaccgcgctcgacagcataataactcgagaatctgactgttctgaatttttcttgccatcactttttttgcgcgcaataattgaggtaaaatgaaattctgcagtttaatagagcattcatgggaatatcgaacgccctcaccacttttggatttggttgtcaaagaaaaaagttatatccaaaaacttgtgctcatacgaaaacggcccgtacgaaaacgaccccgaccctaaaattagtcgtttttaaattactttcttcgaagaatgtttaaaaacggcttttgggtttaattactttggctaatttttcaggatttttttggatttatttcgtgcttttttggcatttttatgtgactttttggtcattttttgtgacttttggcattttttatgactttttcgtgactttttggcggtttttcatgactttttaagtcgacttttttgagatttttcgtgacttaaattcccatccctattgattaccaaagaccaaagatttggaaatgcaagaaaaagttattgccaagaatttaaatagcagttaatgtgcaatgaaccgaaatttttttatcatcgaaaaataaagtattttaatcagttataaataaaaatgattacggccaatttatatgcctttatttggccaaaaaaacatataatggccaattcacacgcattgtttggccaatgttttttttgaaaacaaagaattccgttggccaccattgtgcgccaaaacagcgacacatggtggccgatttgcctttaggcattttgaaaattgac

SEQ ID NO: 30951 - DNA, 818 bp, Heterodera glycines
ttccaaattttcacgatcaaatgcgctgagaacatttccagaacaattagtatcggcgtcattatgctgagagtctggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccaaaaaaagagatagccatttttcaaaattttcacgatcaaatgcgctgagaaaaaaattccagaacaattagtatcggcgtcattatgctg

SEQ ID NO: 30952 - DNA, 1241 bp, Heterodera glycines
ccttcgcgtgcgcaacttttggatgattttcgccaacagttgaaaaagcagcaaatgtatgactacgcactattggtccatcgaattgaatctatccataatagacaaccaattgataatgaaaaggtggcaaattaaaaataaattaataaaataaattttttaaaaaaattatccgcgttgggactcgaacccacgataaattctgtagctcagtggttaagcccggcacagtttaacattgccttagattcgaatcccctttggcgagttggacttttttatgttctgcttttgtgaaatttaagtatgggatcctgtccggagctctgatatacacaagagacttgatgggatagaaaatttgttaactatcttaattttagaataatttttaataaataaataattttaaaaaatatattttttttttgatattcttaaaagaagttttatttttcgaataaaaatttcattttttaagttagtgaatagcattttcaatgagtgtaatgcttggagaaattgggcggacatttgctgctcgccggaagatgataaatgcgaaattgtacaaaattttaatgaccaacagaaacaacaatttgtttggcatggcgacgaaattttgattcgaatgtcaaaaatgaataatttgttgagggaattgatggtaaaattaaaatttctttgtgcataatttcaaaaattttagattaagattaaaaacctttttcatattaatattataaaatatttatataaatttatttgatttttttttaattataatttttagtataatttaaattattcatgcttctcattttttaatattatttaggtatttttcgaatttaattcggctcccgcaaaatattttgccacacaattcaattttaattgcattgaattgattaaatatatgcagaagtcgcccatttctcaaacaaccaccactccagcagaagaggcgaaaaaaaattcattttttaagaggtttcaatttttttttgcgattttgcgcctagcaaattctatttctaaaatagtattgtgatatttactagaagattaaggcagcgcccggtacataaaaaaaaagtaggggatcggggtcggggagcaggcctaatggtcgggatctagacgtggatcggagagtccgggtccggttcggttaggaaccctaatccagtggaggatttactaaaattcggtggatttgtttatttgaattg

SEQ ID NO: 30953 - DNA, 983 bp, Heterodera glycines
agtaactcggctcagagtgagattaagggacgcaaaagagactattaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaacaaaaagtccataatatctttccata

SEQ ID NO: 30954 - DNA, 825 bp, Heterodera glycines
atattccacattttgcattgaaaactcagcgcatgaaaagatttgcatcgtgtcctcgtttaaccacctggccataacatcctcgcgtgtaaaagtcgtctggcctgaatggtaggatttcctcctctggaacttctacggcattccttggaaaaaagctgcgcgattgatcggcttgtggcaagttgtcctgcagttaattgtgcgcgagttgctcctcctggatggctctttttcccaatccacaatcgttgacgatcttcaggtaatcatcctccaggattccaaacgattggtccgacaagcgaatcggttttccgttgcatgctgttttcattttcgcctctttgctaaacgttagcgcctgttccttgcttttggatatccatgttccgcctgcccaatccgttgatcccgtgtgctctccgtccatactttcgacgaaatggtagtcgcatggcttacagctctccttgcactccgtttcccaattgatggactcgtgcgcacggcacgagtacacacaaaaggaaaactcttgttcgcgcgattaaccttttgtaccctctagaaattaacacttctgcggaggacgaagtcagtcaaattcaagtgactgacggagtccagtttgcctccagggacggtgaggcaggattcacaaatcgtcacgacagaatcgagtctgtctccagtcagaggaaggaatgagcggcaagctgtgaaagagcgaattcgaaagagacagccaacggaggaagtcagaggcaaaggcaaattgaaaaagaatgggccatatgatcgactgtgaccgggcaactacag

SEQ ID NO: 30955 - DNA, 1553 bp, Heterodera glycines
  misc_feature (1524)..(1524): n is a, c, g, or t
tttttcaaaaaggcattcccaaatatgttattgccatccaatcatcggtgccgtaccgacagcttttacaaccccgcgaagaaggggctaagcaccacttttcctcccctctcttatcaacacattttgatgagaaaatggcatggcgcgcaaatggcataaaaaagaagaaaattggaaatattccacggaaaaacttacacatcgttttgcggatttggagttcaaatttcacttcagctggcgctgaaatattcgacggtttgagtaaaatgcaaaaaaaaaagtgggggaggagggcacttaaaagagaagggaagagctgctgaaatgagatgaaaattgtgccattttcacataataatggcgaaatataatgatattaaatctgcgtacccttcagacatgagctcacttaaatatgtcatttaagaaataacaaattttaggagtttttatgtggaaaaatatttaaataaaaatcttttgcgaatcttaattagtgttaaaaaatattttatcgtaaaaattattgtatatagaaataattttaaaaaactttgtcttcaaaagcaattttcttacgaaaatgaaacgcttaagaggttccaaaatctcatgaaaaatgagcgttttccgtcttacaatgatgagcccggaaaggaacggcccggcccaatataaagggccaattttggcactatgaaacataaaacggcacggacaaattggggtaacatttctaccgaaaacagcatcgataattggtgtgatggaagagaatgtttatgccaagattggttcccaaattggcagcaccccaaaagccttattattttcgctgtttgccgaatattatgtgtccggttgggcttggattttggtggcgtctttttcaaatgcttcggcacctctcattattattattatctttttggccaaaaatgttcccaccttttgtgacgaagaatggatgaacgattcattatgcatcacaaaatccattgaaaacaaaattcattttttgtggatttcaaataggaaagtgcatagctttctcaaaaatagaataagggagtaaaaaaaaatatgaaaaacaggaaataaagctattcgaaaatttggtttattgaattagttaaaaaggataaaatagttattggttaatttttataaaaattaattttcacacgaattgtttttcaaaattttaataatcaatacttaaaaaaaaatttatgatttgagagcggacttatttatttatttcaataaaagaaaaagccaacaaaatggaaaaatgcgtttacatttagtttgaacataaaggacgggggcggaggttggcgattggagcgacttggccacgcaaaaactgccgtttacgggggtccaattcctgctattttggccaaaaatacgggtgagcggccggaaaatccccgcaggggcccttctctctctcgagtgaacactaaataataacccagtgtattttaaatgaatattatattttttaactanaaatggggatatagttgaaaatatgaaaa

SEQ ID NO: 30956 - DNA, 1165 bp, Heterodera glycines
  misc_feature (1117)..(1117): n is a, c, g, or t
  misc_feature (1155)..(1155): n is a, c, g, or t
aaaataccccctaaaaatcgaatttttgactttagcccccccccgccgaaggcaagagtctggcttcacccttagtttttgtattatttggctgaaaataatcacatgtaactcttgtatggcagaattcaggaatttcaatgtctaaggcatcaaaggccgccaaaaaaaggtggcgaaaatggagaaaattctatgaaagcatcgaattggcaatccgtgaacaaatagacacttcggctgtcacagctggccatgaagcggcgcattcttgggccataatcaaaggaatgccagagcaatgtatatctacgacaataatacccagccatggcaatttgggcctcactctatcgacagaagtggactatcaaagttgctctcttaacgagctgaaaatgatccttattgccacaatggctgggcttggacggagttttgggcatgatggagatatggaggccgctcggccaatcgctaagaaggtcgtttccttttgaactcataagctgcagtttttaaagccaaaaatgctttatttgcaacgaaattcctatgggctttattgcagtttaaatttttggtatcattcggcagcttaaaaacttcattattactcgaaaaaatctcagcggaattaaatttaaaattttgctatagcatataacgaaatttgttaaaattttaagtctaatgagataggaattcggaatgttgaatgatacctatatttctgagaaaagttatgaatttgaaaatttgtcgacatttttatacgtgaacatacactaagatttgtaaactgcaataaaacagccattttagatattgcgaaagaatgggagacggttgcatggacttagttcgcgtggtaaacgggcactgaaaagagaaattaatggagaaatcgacgcggccacgaggcgaaggaactgcttgtaaataattggagaaggttttagcttttagtccattctaaatctaaacaaattagtactttaattcgatttatttagttcgcaattgaattatatgtgcgaaaaactattaatgcggacgaagcttatgagtagttcttttagatatataatacctaatacatactaagtacaaattntaaaattttaggattttggcccgttatctccaggatgngcgtgtagga

SEQ ID NO: 30957 - DNA, 1610 bp, Heterodera glycines
  misc_feature (26)..(26): n is a, c, g, or t
aatgttgaatgacaattcaaaatatnttttgagaaaccatcggaaagaaattggaaatttatttggaaaatgaggaggaattaaattatgaaattaatgaggacaaaaattggatcaacgaaaatactgaaaaagtaaaacaaaaaattgaaattgaagcttttcgaagagaattagagcaaaaaatggaaaaaatgagtgaaaatgaaatgcaaaaatggccaagcttaaaatttacaatgcgtatttagtgctgctcgaaacagaaatttcccgagaccgagacttgatcccgagactcgagaccgagacccaaaaaatccgagacttttctcgagtcgagaccgaaactctcgagcagcactagtatttaattgtcaacatttttatttaaaaaacgcattttccatggtaatccatcggcttctgtaagtgttttttcttattcttttttcattgatattccttctgtctcccctactgatgaatgatcaatccctattttttaaatattgcctcattatttaatataataaataaattatattaagtaaaatatagattttaataatcctactgatgattattacttaaaagctttttaatataatagacaaattagattaaataaataagatttgttggttttgctccctttataaggcttttgtgcttttccattttttcattttcataattactttaaggtattgaaaaatagaaataaattattttatttatttatttattttagttacatagatattagctaatttcttaataaaaaattttaatttattttgaaataaattttaataatattaatgagcatttaatttattttaagaaaaaataatgaaaaaataatgttttattttttctctgtaatttcttttacaattattgttcatccttgtttaattcgaattttaaatgcgagtccatcggtgagtaattatttgggcaatttaattttactaatccattttaattaattaggtcgatgacaaaatgctaacggcatttatgaaaggtcatcaagaaacgcaaattagtgaatattcaatgcagaagtatgaggcacaccttggcattatgtattatatgagaaataattggcactgtgacaaaatagcaaatgaatttgcagaatttgaacggacagaatgccaaaaatatcgcaaatatttggacattttgtacgaatatttgttcagagaatacatcggtattcacacagtgaagccaaaatttgtgtttaaaaagaaacattttgaaattgaagggccaataatttatgcgataaattgtttggccacaatttcacagttttattgctggaaatatgtatctaaattatattattcctcattaaagcgtttcttcaatttgtattttgcaccaaaattattgaatgaggagggattaaactatgaaataaaattggaaaatgaaccaaaattgccaattaatgaaatgattttggaattggcaattgacacggcgaatgaatggcaaataaatgaaattttagacggaataatgcgagaaaatttggaagaaaaattgaaagaaatgatcaaaaaaacggaagaaacggaaaaaaaata

SEQ ID NO: 30958 - DNA, 1372 bp, Heterodera glycines
atttgccaccaaaattcacttacactttaactgatcctcgaaggaggccaaaattttaaatcgactttttttttgccacccgtcatagatttcaatatgtggaattagatttcggcctggattcaggtccaggccatttttttgacaatataagcaatagacttgaatattcttttcttgaaaaataatgcaataaattttttaatttgcatttctcgcatccatttcagtgttcttttcttgattcccgtttaatttgactatgccaataaatttctggccaaataagtatattttgatcagtaaaatcctattgaaatttatagagatgaccttgttaatttgctattttatggcatctctatcgcaataaataaaaattaatttttttttcaacaaatagatataaccggagtaaaacccacaatagacacttaacaggtaatccactataaccatggtagattttactatcgagaattgatatttaaaaattgccggtacttttctaaaataaaaaatatagtgaagtgccaataaaatcaccagggaattgagtttaaatatggaacaagcacattgaaacccgaaatcaagtggagtgccagcaaaatcggcaggaaaggaatttaaatattcagaatgcgtctcaaattagttgaatggttttatttgcaatttatttacattaacggatttataacattatctcgatgcgacgaaaaaaatttgacatcacccttatattcattacagcgccaggggcttacaatcttcataatcagccatcagtaagcgactaaaggaatttgatttttcaaatttacaaagaaataaaatctttttaccatatttttcgtccttgctttttctgcagttcttctaacgctttcgaaatacgcattttggtccaatgtgtgttgtgtctatataaaattaatttttaaagaacttatttccgtttatacccttgcgtcttcgttgaatgggctctcaaaattcggctcttccaacagtgtgctcagccccaataagatttctctcatatgacggtctgatgaccatccaggtccaataagccaattcatacaaacatgccctttttgtggttcgcgtcgtgaaactaattttaaaattaatctttaattagtagggttgtaaattatatggattaacatattttttctgcgcatatgctatgaagaaaggggcttaaaaatagcatttctgcgttaaaattttttgatttggtgaaggtttttagtccatataaatccatattttgggggttttcgggaataaatccatatttcgccatttttgggtttttagtcctatattttggccattttttggaaattttcacaagaaa

SEQ ID NO: 30959 - DNA, 1754 bp, Heterodera glycines
  misc_feature (56)..(56): n is a, c, g, or t
attatgagccaccatttggcaaatcggtctttttttcgcattaaagaagattcagncgattgcttggagtgtaagtaaaaaaacgttattaattttcatcttcatcattttttggtttaaaaatatatttgaatacttttttatactttgaaagacttttttattaatacagaattttttcaaaatttccaaaaatccgcaatcctgcgcaggatcctgcagattttaaatgcaggattgcaggattaatcctgccggatcctgtcctgtaaaaaattttgaactccaatcctgcaacaggatccgcaaatttgaaatttccggtctctaatgcaaatgccaatttaatgtgccaatagcaattcagtggcatggtgcccacgccaaacccaacgtggcattaatttctctcgccacgtacagaaaaatggcatattattttttgatccattgtttaattttcacccataaatcaggctttagcattgcgtggcaaattgattattagcttttttaatttacgattgaaaaaagcaaaagcataaattaataattatcaaatacctaatctcagtttgtaaatttatatggagcagctcgtttcgccctactcgaaaaaattaaaaaaaaaattaaaagttttaaattttagaaattgatggctttttcaagaaaaaaatcacctttcattacaattctttaatcaatttttctaaatttttatattttccaagaaaaattaaattcaagtattcaaaaaatcaaattttttttgtttttagatctttttatcccgaatcttgatttcgactttcaaaaatccgctctttattcaaatgcatatttaattgcttaaataaaaaatgaaataaataacccaaacaaatttagaaatattatttttctgtaaaatattaaaaatcgcttaataaaaatgtattattatattaattaatatttgttagcatgatcattattactttctgcgcaattttatttgttttaatttcaccaattttgccatcatttataacaatatgcgtaagaccgcacatattgaattattttgggcaactgatgtgtaaacgcaataacattatgcacatgatttacgaaaatatgcctaaaattgaagatcaaaaatgtggaaggtattcatgcactcgcttcgggtggattatttaggaaattgtgatcggaatgaaacgaacgcaatgatcaaaatcaccaaaactggcaccaatgaaacggttggtttgttctgtatgtgccagggaaggcattccgaggggcaaaaaattttcggaaattggaattccgaatcccccgaacatttcggaggtaccaaaatcggacttccgtgccattcctggtatgtgcttcaattctttttacaaaacaagcatttttatagaaggaatttacgatcccaaaaacgcatctttccttttatgaggtgccgattgtgctcatgttcggcacacgacaagtgacacataaaacttgatgattcgcgtggataaaaatgttattatttatttctttttatttttttgttaattttacccccgagtgctccgatcagggacgggcgaaacttcggcttcgaaaacttcgggttttttgagtttcgaacttcgtgcttcggcttcgggtaatttacccgaagttttgggaaaaatacacccctaaagattgagttttcaatgttaaaactgcgtcagttaatgattttcttttggtaaacttaaatt

SEQ ID NO: 30960 - DNA, 993 bp, Heterodera glycines
  misc_feature (55)..(55): n is a, c, g, or t
  misc_feature (952)..(952): n is a, c, g, or t
tatccttttttattcgctgctttagagtatatataattttttgctatatcctggncttttaatatttttgctgaactagctaaccagcctacacaaaaagacgtctttgtcgcaatcaattctatttgagcccaccatgagaataagaatgaatcagttactgtttactcagacttctcggtaaaagcgacttttattttaataaaactttttcaaaagaactaaaattatgaattcaaagcattatttttattttattttatcataaacgatttctattatctgaaaaatattcttttagatactgcattacagattgggattttatttggggtatgtcaaattgcccatttgattcaattatgcttattctttgtcacattctaaaaaaggtttattatccttttttattcgctgttttagagtatatataatttgttgctatatcctggtcttttaatatttttgctgaactagcgaaccagcctacacaaaaagacgtctttgtcgcaatcaattctatttgagcccaccatgagaataagaatgaatcagctactgtttactcagacttctcggtaaaagcgacttttattttaataaaactttttcaaaagaactaaaattatgaattcaaagcattatttttattttattttatcataaacgatttctattatctgaaaaatattcttttagatactgcattacagattgggattttatttggggtatgtcaaattgcccatttgattcaattatgcttattctttgtcacattctaaaaaaggtttaatatccttttttattcgctgttttagagtatatataatttgttgctatatcctggtcttttaatatttttgctgaactagcgaaccagcctacacaaaaagacgtctttgtcgcaatcaattctatttgagcccacatgagaataagaatgatcagntactgtttactcagactttctcgtaaaagcgacttttattt

SEQ ID NO: 30961 - DNA, 1084 bp, Heterodera glycines
acctttgagggtgtgaaaacagctgttaccggcaggtgtccggggcccattttcgcgcaaaattttttcgcgcatttttttcggggtactgtattttaaaaaatttttttaaaccggtgggtgtggggtgggattttaccgcactttttcctcattgtactgtaattttttaaataaatttttcctaattaaactgtaatttttattaataaaatttctacatttcgacggcattggatattttacataaaatttaattcgataaagtttggcgtcgttggctgctgctggtcagcgaacgttggcgggcggtgggattagtaaagggggggggggggagcattctttgctcaattattgtgtggacggtgtgtgtggggtcattttttctctttttctctcccccacacttatgttgttctcttttcttctctctctttctctctttttttctcttccttttcgttctctatcgcacacagcccaatgtgccgaaggtggactcatacagcccaaaactcacaactttttttttagcgtctcaattgatttcttctttttttgtaattaaatgttaccaatgtttttcccaacacccccttttttaatttattttaattcttttcaattgccaaccggatttttaaacttttataaatacattcacagcttaataattttttaatccttttttttgcactttaatttttattttaaaaataattttattcaacgttaataaaaaagttaacagatgttgtttttttgtgattgatacaaaaaaaaacatttttattgtaaatcccctttttcaataattcaattgttccccttcaccctcccgtccccacgctcgttccctgtccctcactcacgcgcttctgccggcttgtttttggcgtctcctgcatttcttccccctcctcttccaaccccctaagcttcttcgccgctctcgccttctctctctttctttttccactgctgcgattcgtgcttttgctcattgtggtgcttgccattgaccccgcctttgttataagaatggtaatttttaaatttaaatttcattttcactaccatg

SEQ ID NO: 30962 - DNA, 1503 bp, Heterodera glycines
tgccggtcaacagcgggtccaagtcgccctgaacgccgatgtaacgggcgacacggccaggcaccaggaaaccaaagtcgctgaatgatggatgtagtatgtacctgaaaagcaaaaaaataaccgatttttttttgtttctaaacaagaaaatatgtataccgtatttcctcgattataagccccggggcttctattgttcaacccccctccaaagggggcttatattcgagggggggcttttattgttcaacccctttccctatataaattcttaaaattttttgctttctgcataatggtacaatttaaatcttaatctgaaatttttgaattgaaaagatttttcattttttggcccttggaaatttaggcgaatgtttgaaaattcataattcacttctaaatgaatcaattaaagtgcaaaaaagcattaaaaatagagaaaaatctggagcattttatacttttttagaattttctatcttcaaaatgaagaagttattacataaatttaggaaaaattcgttttttgagaaaaaaaaatttataacgctgttctgaaaaggtttttttgaaaaacacgaaattcttcctctataagcttctgtttattctatatttttataagacttttgaaaaaaagtacaaaaataaactgattttggaattcgggatcataggtgggagcaaatggtttttttggaccatgggttcagatccacttgcctgtaaaaatgtttttttagggtttttgggaccactaatcaagaacttggcatccattttgcccaattccaaagctttgatccaaactcgaaaccccaaaaataatttttaaaaaatgttgcaggcatgtggatttgaacccatggccaaaaacccatttttaacaaaacaaaaaatatatttggtataatatttctatatttgcttgaaaattttttagtgattttcatcaaaatcttttccagtgcaatttattaacagaaattttttctaagctattgcttcgctattagacaatttccaaaaaagttatacataaaattgcgaaaagtcgaaatttttgaagttttttcttttccaggcttgaaaatcttttcgcttttggtaaggctaatagagcatatgttaagagctttcgaatgataccaacaatgttggatttggatgtcaaagaaaaaagctatcgtggaaaaacgagctggcgccgaaacgcgagcaccgaaacgcgtgggtcccgtttgtacaattagtctttctaaaatattttacgaatttaaaaaaaatactaattttttcagaaaatttttgtctgttttaaaagtatttaaaatagcaaataaatattataaaattatccataatttctctatttttaagcctttcttgatgtgtttttgattaatttaaagtgtgttatgaatttttaaatttttcactaaaattgcctttagaaaaataccaaaaaatttccaaattaaaattataagaaaatat

SEQ ID NO: 30963 - DNA, 1017 bp, Heterodera glycines
  misc_feature (47)..(47): n is a, c, g, or t
  misc_feature (49)..(49): n is a, c, g, or t
  misc_feature (51)..(51): n is a, c, g, or t
  misc_feature (53)..(53): n is a, c, g, or t
  misc_feature (58)..(58): n is a, c, g, or t
  misc_feature (64)..(64): n is a, c, g, or t
  misc_feature (94)..(94): n is a, c, g, or t
  misc_feature (112)..(112): n is a, c, g, or t
tcgtcaaaaacttccattgattatgtgcttttttccatttaaagagnangngnagggncagagngagaggaaaaccctattagcaaagaaaagnaacagggggggaaaaaanagggacgaaaagaaggcaaaagaagcgcagaaacacgcaaacaaagccgagaaacacgcaccaaaaacgcacaaaaaacgcaaaagacgcacaaaaaaccagaaaacgaaggggcgcaaaaaaaccgaaaaaagcgcaggacacagaaaagagaacggggccaagggacagccgaaaaaccaaaaacgccggaaggtgttgtgtatcaacaatttattaataaccaaataaaaataaatgaacaaattgatgaggtcggaggagagcagcgacgaaggagaacaaaataataaataaatgtccaatgcgaatgaatggagcggagagccatgagtgagggaatgggcacacttataaaaacgttgggtcagagaaatgtggaagagataggcagagagagagacaatggaaatagtgtatgacagagaaaaagggagagagaatagtcaataacattgatgtggaatgatctttggtccttatccaacacctccctccttaagtcgaatgtccctcgatttgggattcaagatcggattaagccatatttaggctttgtcggatccatgtccagtcgttgagatgcgtggctgactcttcctgatcggcgcaaattcactggttgagcaggcgtttgctggtgattcttctgcggtttttgcgcgattggcgattgtggcggattttgtgcctgggtttgatcattttctacaacttgatcattgtcctccaattcatttggataacgtcgcctgatttggttggcatgacgatgaatggctcggccaagcgtcggtgccaaaatgcgatacgtcggagaggtgcccaatttctcaataattttcccggaagccaaatggctttattgtttttcaaattccaaaaataaatttttcttctttttg

SEQ ID NO: 30964 - DNA, 1209 bp, Heterodera glycines
ataattggttacgactttcaggcaaaaagagtctgaaaaaatgaaatatttggtaaaatttgacgaaattgattaccgcagaaaattaataggttccaaccaatggcattttttgtcattatgccaaagtccttacgatgccttcctacaaaagcacaataataaaaattttggcaccatttccatttgtgccggatggaaagacagcagtgacactcggcaaacgatccatcagtgtgggaagactgagttcggcacgggaaggtgagcatgtcgggagcaccgaattttgctgagcctttgccctcgggcgaacttttttggcactgacaccacggttaaggtcgtcagtgagggaggagttgcgatcggagtgcaactggaataaagggctgaattttgaaaaacctgggactgtttcgggacttcggatttccgagtcagacccggacagaatttcggtctgaatcggacacggacagatttcgggataaaagtacagtacccggattaaggccctgctgggaaactggaagtggccgagccatgacccggatttcctagtcggacccggacaaattttcggtctgaatcggacacggacaagatttcggtataaaggtacagtaaccggattagagctttaggaaatcctgtacagaattctatcctgtccgtggcgataaaaggcattgaaataaacaatttcatttctaattcacgcagttacccagcttaaaaagatttccggacattttgtcgaaaatggacaaattgtcacagcgtataaatgtcaataagaataaaaactaagccaggaaggatcgagaataggatttaagtccgagaattgggtcggcatataattcgacaatgcccaggccaaccaggtcgggaagtcgtacaaacagttgatcctcttcgcttaacaatgccgagtggtccaagccgtcattttcgttgcgaaacacacagacagccatgttcgcttcaaacgcatccgcaatgacacccatgtactctttgtaccaatggagtctatacaaaatgtcaaaaaaataataaacaaaattcgggtacaccctaaaacgtcgacactgaaacgtcggcggaaaaaactaaacctggaccggtttacctcagttgggccggctcggttgggccccagcacgtttttggctataatttttttctttgccaaccaaatcc

SEQ ID NO: 30965 - DNA, 519 bp, Heterodera glycines
aaaaaaaaggtattgaaaaaatttggaggtcgtgtgatgtaaaaagaaggaatagaattgagaagagacggaaatgtttttgatcaatttcaggaagtcacgaattgacagaaagccattaacactttcgtaagtcgcgttggtttaatcttaaaaacaaattaccgggtcaatggagtatcgatggctcactctaattgctttctccagtgccctctaatcaggcagaaaaagtcaaaaagagaaaaaagaaaaattgtcggcacttattttatgaaaagtaccgcctaaactgtccaactcctctctcgactttgttatcttcaagactctgatctgctctctcatttcccctttatgccgctctttcccatttccaaaatctccctaatttatcaactttttgcaatttgtcaaaaagtgtccccccgcccacccgccaattttgcgccactccaaacgctttatgtgccctctgaaattttgtgactgtgactgactaacatatccgccccgccg

SEQ ID NO: 30966 - DNA, 1557 bp, Heterodera glycines
  misc_feature (6)..(6): n is a, c, g, or t
ctctantgtgtgaccaaccaaatattggctgtaccgctgctgttcttcactgtccgttctcgtgccgtctgttgtctcacctgccgccattgtgccacccatccaaaatggcattccgccgaccctttcgatttgtcccatttccgtctctcttcctcctcctccgacaattcatcctcccactcttccggtgactcttccctccctcctcccccatatgctcctcctcttccgcctccaccaaatctgccaaaattggagtaggacggcgacggcatttgtccctcacccatttcaacacttcctttcataaaactgaaaagcccaaaattttcaaaatgaatgccaagcaaacttgaaaaaaaatgcgcgaccgcaggattttctgtccgcgctctccacccctgatgtacacccccaaggattgattagaaaactaaaaaaacatacccttaagaatgggaaaagtttccctaatttttggtttttgtaatcatgtattactggaaaaatgcattcaaaaactcgaacatatttttcactaatcaatttgattaaatattttttggattttaataaaaaaaaagccctttcggtaataacacaattgatagaaagaatcaatttaatttacattgcgaaattaaattttaatttttcgcgactacgcctttaaacttgagtttatcttaattaaaaaagttaatgaatttttttggcacgcttcaagcatcgctcggttaacacggttttaggtcagcaatttttcagctttgccaatgattcattgtttgagtattattagattaaaaatttattgatgagagtcaaaagacaacaaaccaattcaaagatataaattaggatttagaaaacaagcaaatcacgtaaaccgaggcttagttgcgacggggctcattgttaaaacatcgacagtatttccatgcttatttagcgccacaactgtcaacgcgtaaagggtcgccggcttcagattctttacgactgcggtgtaagattttttcgggacaaacgcgtgctgaaaaacgcggcatttcgcgatttaaaaaagtttgtccgtggatgtgccaaatgggtcgatccatttaaaccgaggatatttttgcaattgtttttattttttggccttccgcgccgaaatggggagggcggctcgggctcgaccaccccaaccccccccctccccccctcctttcttcataccgaatttttcagtcattttttgtgtggtgatgcttagcccagtttttttttgctatgcaatgccttcctttttgcttgcactccctgttttgtttactaacttgcggacactttatcgtcttccaaacttcattgacattcttgtactgcacttcatagcactcgatttcaacatcggtaatgctttggcttttccacgcaatggtaatcgtgctttcggtgctttcaatagacttaagcttgcaattaacaaaaaactgagcaaaagccatttcgccttacacgtatacgttcaacaggctgcagagcagtacggcgactacgcgttggaac

SEQ ID NO: 30967 - DNA, 1486 bp, Heterodera glycines
cgcttccaagactgtcttgggcttggctggctgagctccgatcgctcgcctctcgtcctgctgatcagaggggggaggatccccctgattcgcgttttcgttgaattggtcgtcgtcgtgtcgctccatctttgttcaaatgcgttgtgttggtcctcggcgaccgaagtgctgttgctggtggttgtgctggtcctttgcgaccggggtgttgttgctggtgcccctgctaacggcaccaaattgtttgtggcaaagaaactcggccggcgctgacggctagggggtctgtgcgcgggagtttctctcccgtccctcgggcccaattcactcaaattgccgaatttgctgctgccgtcgggtccgtgcccaagggagtgaactggggagggggtggggaggacaaacaagatggggtttgcggttgttgctgtaacggcaccaccgactttttgaagagctgccggcgctcccggttgaggttcgggagaagagttggacttccggccgcgaactgcgtcaaccgccgggaactggctcccgtccttgtttgctgctgctctgcgggggagtgtcccccgcttcgattctcggggctttggctccccttggtcacttcgttcccgagcgaattttccccccttttttgccctctgaccctttcaacacttttccgacaaaatgtttattggtgatgatgatgataaaatggtcaaaaattggtggatgattatatgcgagatgttgatggattatatggtgaaaattggaggaagggaagggcgataaggattattgagggggtcaaaaattgggaatgattcagcaaaaagaaagaaaatggtgaggagtgagaacgagtgaagagccagaggtgaatgtgtgtccaaatggaatggaatggaatggaatggaaccaaaacattttccccctgggggggggcaaagattaagatgcaaaagagcgacgccgaagggtacaaaaatcggcggggagaaaaaatgccaaacaaagggaaaaatgagatgaaagaatggccaaatggaaaaatgtgatctgagaaagtgtgaacaaagagacaaaaattcggaggcagatgtgaatggcagaaaaattgaaaagaaaagggcaaatggtggagttgaagaaaacattatgtaaatgagaaaaaatgaagagaaatggaaagtttaaataaagaggggtgaaaatgttgacgaatatagaaaatggatcgcttaacatggcaatggcccttatccgggaatgtcccctccggatttcctggtcagcgtcgtcctcctcggcgcttcttccctcctttgtttgggtcccgcggtggggcgggggggtggctgaagatccccccggcccactcattttcctcctcctctgacagttccctcgccgtgccgtcggcgttgaagaccaaaatgccgcttcttcctcctgtggcactctcgtcggcaacgaaattccgacaga

SEQ ID NO: 30968 - DNA, 1027 bp, Heterodera glycines
aataaattgagcaatggcatcatccttatcatacttgctggtaaaaatgtggttcattctccttcaccgtcttgtctgatcacttggatctctaggtccttctcctttcaagataagcttttacctcattgtgcctttctctctctctttctctctctccgagcccgttatgtttttctatagccttttctatttcccctttttctgccttcctgtgatatcccttctcacatctctttcccctttatcttttccccctttctttcactattccctccccgttctcccttttattccttctctcccctctttcgtaattccgatcactttttcttcttcagtttattcttcttcttttgctgttgatggcttagtcattttgtcctccatgttctgcttatgttgtttctgttcctcattcctctcagcctcttctcccaattgtcctgttgatgacgatggctttggtgagcatatcatatcttggtgcattttatgttgtataagccaggcattgtcaattgattggactcataaagtgcattagagcccaattttactggtcccataaaaaaggaaacaaaaagatgattttttacgattctgagttgcaagtataccttcgacgcgctgccttaaaagttatgaactcggcaaaataaagatcccattgaaataatatttaaaaaattcattcagcggtttactattttgaaagaatttctacacaataaggaatacaaaaagatgttttttaaattatgggggcgccataaaatttcggcgccgcacacgtcattctgactgggcgtgggcgcctcaagcgtcggggccgcatggacccggaaatatccggacccgtctaaccctaaaattaactcattttgagatttataaatttatttaactttttattaatattgttttattttcaatttttattcgcttaattttaaatattattattttattatttcaaaaaatctttgtcattaatttaaaataccataaagttaataattaaaaa

SEQ ID NO: 30969 - DNA, 1446 bp, Heterodera glycines
  misc_feature (16)..(16): n is a, c, g, or t
  misc_feature (105)..(105): n is a, c, g, or t
agctgggtttagacgntcgtgagacaggttagtttaccctactaaagacctgttgctatgatagtaatcctgcttagtacgagaggaaccgcaggttcagacatntggttcatgtgcttggtcgatagaccaatggtgcgaagctaccatctgagggattatgactgaacgcctctaagtcagaatcccgcctaggcaagatagcaatattcttgctccccggtgtcgggaggcactacttatgcgccgcttgcggtgcagcacaaatgccccagcatctggcccgatgtgcgtgcttaattgctcgcacattgccaaagccgtagcactcgtgtgccatggtggaacgtcggggcgcaaaatcacttgtatacgacttgactactggtcagggggttgttagcagtagagcagcttttacactgcgatctgttgagacttagcccttgatcggatgatttgtcttctttttccccctttactttttgtgccaacaacattttaggtacaagtacatgagaagggaaggctctcttaagggagtcaaatgcctcgtcagtcaccatgaaattaggtagaataagttcttgactttgcttttttttccatttatttcaatcggctagtgctttagggttttgtgttttgactttgcttttttttccatttatttcaatcggctagtgctttaaggttttgtgttttgactttgcttttttttccatttatttcaatcggctagtgctttaaggttttgtctttgactttgcttttttttccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctattttgtctttgactttgcttttttttccatttatttcaatcggctagtgctttaaggttttgtctttgactttgcttttttttccatttatttcaatcggctagtgctttaaggttttgtctttgactttgcttttttgtccatttatttcaatcggctagtgctttaaggttttgtgttttgactttgcttttttttccatttatttcaatcggctagtgctttaaggttttgtctttgactttgcttcggctagtgctttaaggttttgtctttgactttgcttttttttccatttatttcaatcggctagtgctttaagggtttgtctttga

SEQ ID NO: 30970 - DNA, 1137 bp, Heterodera glycines
tttatcgcccgtcctgaggccgcgaagcggccgaatgattaccacaaaattaaaaaacgggcgcgaagcgcccgtcctaaggccacgaagctaccgaaaattcccaacaaattaaaaaacgggcgcgaagggcccgtttgaccccaacaaaatttaaatcgggtgcgaagcgcccgtccaagcccaacacgcgcatgcactagcaacgaagtcctttgcgcgaagcgcttatgtcagcgcccgtccatacatacaaaaagcatactgtctacaccgagcaattactgtgcaaagcatactgtctacaccgagcaactactgcgccacacgctagtttatatatatatagaataaaaggggaactcattaaaaaaattaaggctcccggccgaaggccgggagcgccctgaaagtagtggaagggtcttacaactttttgaggcgcatctgggaaaactataggttttccgctccggtggccaactgagtcccggcggctaatttctcacttttgcttgcgtttgaaggcccgtaactttttttaaaagacagggagcggaaaattcttgctggtaggattttaagttgaagtgttttctaattttcaaaaaaaattccaggcctctacctatacttggaagggctgcagaaattggcaacttttcagtaccaactttgtccagttcagtccccgttgaataactcattaggctttgacctgagcgcagggtggccagcagacttattgtagagctttaaaagcccgatttttccagattttaaaatttcgaaaattttcaaaatttttcgagctaggcctaaaaaacggttttttggtttttgaattttaagaatttttaacgatttttcccgggaaaacggagaccacttccaaaacatagtttttcgagctctatcgactggtatttttttcagaaaaatttcgattttttcccggaaatagaaaaaaattttggcctgagcgggacatttgagtcccgggcccataactcgtcaggggttgattttagcgaaaaattgtcttagaacatttttgtagagaattttaaatgctatcgaatggtgtactacatgaagaagaattttcaaaaattttcgagctaggccccctcgaaa

SEQ ID NO: 30971 - DNA, 355 bp, Heterodera glycines
aacgctgcggacatctacatttttgaattgaaaaaaaattggtaattactctttctttttctccatattgaccatcatactcatactccccccacccttttcttcttccgccacccacctcccccgctacgcgccgctcccctccccttcgtgctcctctctgtgccgatgaatagggcgaggaaatgggcctaagaggatgctactcctccgttccttcaaagacactgacctttcctgtcaaaatactcgcaaatcttactgcaaatcaaaacacattaagctagcttctgcaggtcctgctcgagcggccgcccggggatcgatccccgatctagtaacatagatgacaccg

SEQ ID NO: 30972 - DNA, 1255 bp, Heterodera glycines
aaaggtcccggtcccggttttgcccaaaattcccggtcccgctcaactctaattaaaacaagtaaaaacttaagatatttcaattgtgaatgagttattaaataaggacaaattttaaaccagaaatttttattaagaaaaatatatacctattaaattttgggatcatttttttgaaaattttttcaattcttaagggtgaaaatgagtaaataaaagtcccgattttgttcgcaaacacaaaaaagaaagtgtttttcctaccaattagagcatggagaatccaggaaaaaatatgtatttacataaaattgacagccctatttatcacctataactcgcttcattccccactgaaccgaactttcatagttctccaaattagacctgagcgggaccggtactggtactgaaaaaacgtacaactgagtacctaagtaccagttttgaccgggaatactcccggttttatccaggttttcccagccaaaaagtcccggtttttttcaacccgaaaagtcccggtaccggtttttacaattaccggttaccgctctactctactccgaattgaactagctaatttatttattgtctttcgatagctctttgtattctatattagcctgcaaattacaaaaaattgagtactgtagaaatcaactgctgtcgtgatcagtgtctcacccacagtttaatataaaaattactgtcgaagatgcacccaacgaaaaatgtgaattttcatcttctttttgtatttgaatctgagttctgaattgaacgacccttcttcctttgtgttttaggcttattcaatttgttttctgcgcagtttgcatatatgtacatacacattaagaaaataacaatatccaatctcagaaaggtcagatttgctggtcgccctcctcgaacttgtagctgcccctccccattttctcctccgcctccgccgcactttccccgccttccgccgccgtttcttccaaagtgccgcactttctcagaccaatcagcgagagttgtgagtgccggtgctgcgtctgctgctcattggcgggggcagtgatgcgcgacattcgtcgctgagatgaaaggcccagcggggaggaggacacttcttcgctgacgcgcacagtgagaaaagtgccggagtcgccccgggacaaaagtctcatccgagtcgaacacactgaggccgttctcaccgctaaaggcggtcagacacactcactgaaattgtgacgcactg

SEQ ID NO: 30973 - DNA, 1051 bp, Heterodera glycines
  misc_feature (1021)..(1021): n is a, c, g, or t
ttttctttctatttgaggaacaatttgggttatttttgtttgtccatcatcttcactcactttaaatttgtgtcttgttttaaaaatcgaaaatgcttttcattttttaaaattttaatttggaaacaaactgaagtaataaatttcaattcaacaatgaaagtggacaaatttttggacaaactttcgcgaaaactttcgagcagttcgctttgcttttgtccagcaataaattattggtaaatatatttacatattataaaatttaatgaattttttgtttttccatttaatgacttgccaatttaagcgatgcaaactttggcgaataccaccgaaaagcgtcgaccaatgagcggcaaaaggaagaagcggctgaaggggcggcggacgaagcggaccaatgttcacacattagcatcccggttcagtaccgcaaacattcgtccacctcggaaacgtcgtcactgtacgaccaaattgtggaagcggaaggcaaagcattaattaacaaataaacaataattaacccaaaaaagaaacgaccgattttgcgaaaaagccaattaaaggcaattttagttgagaacgaagagacaatgaccgaaacattttgggtccgacgccaacaacagcaccaattggtgcaggcgaccattttcccaattagcaaacccttcgcccgcggcacaatcagaatggcaaaggtgaaaagtgaaaagcaagacaaaaacaaaaggcaacaaatgcaatcgaattcattaagatgccaaagcgcgggtcatcaaaaaaacggcgcaattcattccccgcaggcattttcaatgaacgttttacggatgatctcgtcagtgtccaattgaccatctcagagtttaatatggccaaaaaatgcgaggcactcaaaaatatgaaacaataaaataaaaaattgaattttcatttttaatattattttgggtaattaatttaaatggaaccaataaattaattttatttaattgacccattatttttgacngtaaattaaagaaaaatatttaattttttt

SEQ ID NO: 30974 - DNA, 345 bp, Heterodera glycines
ccgccggagggggaaaaattgagaattttgaccatatttttagcagattttcatttttaaaaaattcataattttgtggattttcgaaaaaaattgtaattttctggctaaatttgggtgagatttccgtttgatactctattaaaaaccaaaattcaaattaaataattgccaaacattatggcaatttaatcaaaatttaaaagattctgaggattttccccaaaagtctcaaaaattctcaaaatttctcaaaaatcctcaaatcctcattttccaaaaaaatcctcattgacctatcaaaaagccacaaaatgaggataaatcctcagatctggcaaccct

SEQ ID NO: 30975 - DNA, 844 bp, Heterodera glycines
ctttactgttttccactgttttgctatgtctatgtgcgcaagttttgacatcagccactgaagaagtacaaacgcatggtatgtttttcaatattttaacattaaaaattatttaaatttattttaaagtgattgaatgtgttcgagttaacttataatttatttcaaatatcgagacaattttagacagcaggcacccagactcgtacttgttttcccaactcttactgtgcaaaaaacagaaatttatcttaaatcccagtacgatttgggtaattttgtacgaagtgggtttttaccatgaggcctccggtaaaaaaagacaggtgtttacaattaaacctgtccagtctttagtgttgatttaagaagcataatcctcatttcactttttaagtgaaaaatattcgtgctgaaattgaccaattgcacgaaaaagttgcgcagctttttgctaattttgtaagttcataaatttatttgctacaacagccgaagctcgaaattttgcagacggattatgcgaattaaaaaaatcaaaagataataaattactgtttatttgtgtataatcggcaatttattggaagagctctgttgctgagaatcatttttaaattaatatcacaaatttccgtccgcatatttcgacgcacaaaaaggcggtgatgcgacatttgcggcgcccagtcaaagcgacacttgcggcgcagacacttgcggcgagaacatttgcggcgccgacatttgcggcgacgacaattgcggcgccgacagatgcggcgaccagtcaaaaggaaatttgcggcgcagacacttgcggcgcccagtcaaaaggacattt

SEQ ID NO: 30976 - DNA, 1502 bp, Heterodera glycines
atgatcgaagccgattttcttcttggccattcgtgtcgaattttgcgtgtctccaacagtttggccacctgttggcccacccatccgcgccccccgtaaataatcaccgaaagtctttggcttggctccgttttatgctccaagtgggagctgaccactcttttcaaacctggaaaaggtacaacaattcatacaaattttcttttgaaactgaccttcttcaaaaggtgttttcggggtccatccgagttccttcgtggcctttgaaaaactgatcagatatcgctggtcgttgtagggtcggtcggcaatgtgatcgaattggggagcaacgagcggaaggcccatttgagtacggacttcgctttggacacattccgccacttccttcactgaattcacactttgtgggagcgttttgatcggcaaggaatttggccacattcaaaccattccaaccgaccatttttctccaaataagtgcccaagttgtaaatttgccccactcggccaacttcggccgcccgtatgattccctccgacgcgtcgtccacgtacagccacgagcgcaattggtccccgctgccttggacggggaatcgcttctgctgccgtgccatttcgatgaagcgaggcattagctaacatttgaaaatgtttgttataatttttagatttgtctgtcactttaacgtcccattggttgggcccgtaaatgttgttgatgcgaagggtcacaattggaagtgcgaacttttgttggaacagatgggcgtagaactcgcagattgcctgaggatttgcaaaggaattatgtcgaaatgattaaaatggcaaaacgatgcacttttgtggccgcgtacggattccccggtaaaattgggcactcttccgacttcgccttttcagttggccccaaatttgaatcgccgtacacctcaaaaggagaattccgatgcaaattaagtgtttcctaatggccttcaaatgctgctaattattacctcgtccgtgctaatgtgcacgaattttttcactttgccatattctctcacgcattccaacatttggacgaacgcgaccgaattgttctccaacgcttccattggttgttcatagcatcgcttgctggtgcaatcggctgcgaagtgcacaatcgtatcaatctgatcaatcaattaaagcaattattaaattgacaaatcaaaattaacacgcattaccaaaaaatcaattaaattaaatttgtttaaatcgtttctttttgatgtattaacatattttttgtttcctttgcgatttttataaacagtaattaaaaaaaattattcgtttactaatttcaatttttgttcgtcgtttcttaattgaatcaatttaataatgatgaatttcatcaatcatgaatgttttatttcatttcaattttcttagtttcctctccctttttcacctcattttgctccaaccacttttttcagcacttttccgttgcgaatgtc

SEQ ID NO: 30977 - DNA, 1373 bp, Heterodera glycines
  misc_feature (142)..(143): n is a, c, g, or t
ccccgaaccccgatttttcacccccgacgtcggggtgcaacctattttggagtatttgcgtgttttagcgcataactttatgtgggttttaacatttttcccaaaaataaaataattttaatgtttagggtttttatatatnnaaaataaattatctaaatagattacaaaaactcgtttaaaagtaaaaattaaattttttctaattaaaattctaaattgtaaaacttataaaaaataataatttttaattaatgcaagatataagaaagaatacaataaattaaaatccaaaatattgagtgagttgtttattaattaaaataaaatgaaataaaaaaatatataattaattttatcaatacaattcgacacaaagacataagaattcaattcgagtgggaaacacaccatgaaattaaaaaataacagtttatacacaaataataacaaaataaaaatcaaaattgattaaattaaagcaaatattaattcattcattcacttagcctattaaatttgatcaattaaatgtaaaataatcaaaatattgttaaccaatgttaaaacatataacaatgagaacaattcaaatataatttgattactacagcagattgtttaaaaaaaaattgatgatgaaagaaaagttcctttgatataaaattatttaaagaaatttaaaaattaaaaataggaactttacctatacactttgaaacttaatcatataatttagcaacgattagaattattgaaataaataaataaataaattttgtttatcttattaatctattattctaatcaatattttggtttcaaaactaacaggaacactaagtgcactaacagctgcacatgaagtcgcacacatgaattttttataattcatttaaaagacaattaaaaataaatttaaaaaataatttcactaataatgttcttaattgttatattttctttttgaataattgaaaatttaaaatattctttgctaatgtacactcttggattgggttgggagagaaagaaattataaaggatttcaaaatttaagaacataaaataaacacaataggaatattaccaaaaagtatgcagtagattcagaacttttttgacggttacataagcatgcctcaaaaaattaattttttttcttcatttatttttatttgtaggaaatttaattaattaactcaatttctcttcttttctgtaatatttattgcatcaaaaatagaaaatattaaaaaataaaaaacttaaataaagaatgaggattgagagaagataattaatataatattattattacataatttgcagaaataaataaattaataaaaatgtgaacttaatattataaa

SEQ ID NO: 30978 - DNA, 520 bp, Heterodera glycines
ggggaaccgcccactttggcgcggccattttggcgccctatataaaatggcttttttggcgccagagttgaaaaactccaaaaattttcaaaaaatttttaatttgctttctttgtgcataattataagccgttttctttcaaagtaccatgctaatacaattgctagcaatggcgcagaattatggtgcctaatttaacttttatatttttgttcaaaattaccattcgggggttttcaaggatgtttgatcttaatctagccataggtccggactcatattcgaataagtatactggatattgactcgaaaattcgaaacccgacccggcattcgatggtacacaatacttcaaaaaataaaacattaactttttaacaaaattacgtcttatggtatgtagttcacagcaggaaaaaactgattttgacaaggttagttacaaattttgaaaatttaaaaaaaaatttttacggcgccaaaaaggggaccagagcgtttgggcccccgtttttgggc

SEQ ID NO: 30979 - DNA, 1875 bp, Heterodera glycines
  misc_feature (27)..(27): n is a, c, g, or t
  misc_feature (1786)..(1786): n is a, c, g, or t
  misc_feature (1838)..(1838): n is a, c, g, or t
attttgcacgaatatttgtgcagaganatacgttgggattcacacaaagaagccaaaatttgtgcttaaaaataaaattgaaattgaaggaccaataatttatgcgctgagttgtttggccaatattttatatttttttcacagaggagaaattaatgcatataaattaaataatttgttctatttttctcataatttaatattgttgaatgatgagaaattgaattatgaagtgaaattggtaaatgaatcaaaattgccaattaatgaaatgattttggaattggcaattgatacagcgaatgaatgccaaacaaatgaaagtttagacggaataattcgacaaaattatgacaaaaatttggaggaaatgtttaaaaaagcggagaaaaaggcaaaaaaagacagtccatggaaagcctataaatacaaacataaaataattattagatcgaaattcaatgatgaaagtacatgggtgagatttaacattccatgataattagaaatattcaaattttagactgatgaagctctattttcggaatttgttaagggattagcgacaaattttgagaatttttttaagatggctaaagaatatgcaaattatttatggcgaataaatgagaaaggatgtatttatgggtataatagacaaatgatcaattttgggttatacaaaattaagaacatgaaaatgtatttgatgcaaaaatatgaagcctatcttggccttatgtatttgatgagagagaattggcactgtgataaaattggggaagaatttaatgaatataaacggaatatatgccaaaagtatcgaaaatatttgcatattttatatgaatatttattccggttgtatgctgaaggtttgttagatttttgattattttgaatttttttgtttattaaataataacgataatattttattaagctaaaaacccgaagatgtcgaaacaattgccaccatttgtgaatccaatatttattggacgaagttatttatattgtttaatttttgttatcaatacactgaatgattattcgaaatttttttggcgaaatgatgatttatgggatgatgaaaacgttgaaatttgggggagttttttggtgaatgaggaggaattaaatgacgaaattaaacttcaaattgctgaaaaggcacgaaaaaataaaattaaaaaaaatatctccaaacttcgaaagcaatttgaacgaaaaatgaaaagattatccgaaaaagccacggaaaaagccaaggtagcaaaggagaaattggaaaaagcaatatcaaaagcaacagatgatgaagcaaaaaaaaatctggaagaagaatatgattacatatttggctcattaaattcgtcgccattttcataaaattttttgattgtccacaaaatccgggttcttcttctgatcgcttcctaattcaaattcatttttcattaagaattgttctttcttctttttcccacttttccatatatgatggatgatctttaaaaatatattcttctttcataaacagaatttaagtttcattataatgtcggacggtgattcatccaaagcctttttaaacaaattttatccgcgcttgacttatgagatgacccaactctgacagaggaaattgtggtaagtgaattaagcctaggcctagtctaaatcttagggctaaaccgaaagcctaggcctaacctaagcattgtacaggtagcatttgtacaaattgttgagttgcctttttaagacttgtattgacaccgtngaactttgcaaaatttgaaaaatttattaagtatttggcaaactgtcaccgntgcccactatcagctcaattttaataagtatctctca

SEQ ID NO: 30980 - DNA, 1049 bp, Heterodera glycines
ttccctatagcctttcttttaattttgcttgggtttttcctccccataattgttttgagtcccccaacggacccctgaaaaaattgattttttgttttcggggcagtccccccgaaccgatgcgcccagatttatggggagaccgaatccttcggaaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgaggtggatttttgctcccccataattgtttgagtacccca

SEQ ID NO: 30981 - DNA, 1215 bp, Heterodera glycines
  misc_feature (7)..(7): n is a, c, g, or t
  misc_feature (1076)..(1076): n is a, c, g, or t
ctccctntttgatagaaaaagcatcagagagccttatttaacttttaattaacatttggtgcgtttcagagcacgttctaaaaaatatttatgaattaattttgcaaaataataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcactttctgaaaaaatacttatgaattgattttgctaaaaaaataaaaagtaatgaaactttaaaaattaataaaaaattttaaataactactggagttggcatcttttcagtaagcttttcctttacatttttgatgctctcgcaaaatctggttcgcttctgaccagtttataaaaaaaaatcgatgaaactttttaaaatataagcctaaaatttttcgcatatttaaaaagcaattaaaaatttttagattttttattcatctccctttttgatagtgaaagcatctgagtgcctaaaataacttgcaaataaaatttggtgcgtttcagagcagtttctgaaaaaaatatttatgaattaattatgcaaaaaacaaataaataatgaactctcttccttaataattttcctgcaccgaaggtaaaaaattttaaatctgtattagttgtggtgggttttaatttgttggagtattgtgagtataaaaattgattaaattattaaagtgaagatgatgttttatgatggaagaataaatataattaaatagttgataaggagtgtttaaaggtaatgaagtgatgttaaagattggggtaatgagtatgaatttgatattgaaaaatgggatgagaattggaatgagttttttttggtaatgattanttgtgttaatgtaaagtgaaaatggttgttggtagaattaatttttgagaagttagattgaaaaggggtttagaaattttttgttgaaaatttaatgaaatttttgattttttataatatttaataattgttgaagttt

SEQ ID NO: 30982 - DNA, 659 bp, Heterodera glycines
ttctttatcattcccaaagtgggtaataaaagtttcgcgtgctaatccggcatggaaaggggaattcgtggcagcgtttcaagcagaaggacatattctgtcaggcgattggacggctcaacgggcagcctggccaacttcctgaaatcgccatttgtagcaaacaaattgaaaagttaaaggtgcgctaccaatgcaagccgagcttgtcgtacaattgttgattttcatggtccagagttttctcgagagcggaaatagtcttgaattttggtttttacaaaaaattgaaatgaaacttttctccgcttacccttctgttcagacagaccaccggccataacgaaataccgaagctgcagcagcaaaaaagcaatccgcagatcaaccagcgcaagtttctgctcacattcctctgaagaacgtaattcacacgtcgcaatgtgtcgtcaaactcttccggtgccaattttcctgtcagagcgctaggaaattccgttgaaaaatgcgagttaaggccaaaccttcgaaaaaaaacaagtgctattaatcctaattgtcttaaattaactctttccccatggctaagtgcccaactccacgaatgacaattggttctgttggtcatcgcccaatccggatgtgggaaaatttccaaa

SEQ ID NO: 30983 - DNA, 1692 bp, Heterodera glycines
  misc_feature (1329)..(1329): n is a, c, g, or t
ttaaaaggtaaaatttgaaatcagcagatatttttcaaaaatttgtccaaccctcaaaactcagcaaaatctaaaaaatcaaaatttttcggatttttacgaatgaccatattaaaaaatcagcacaaatctcaatgaaaaatcagcacagttgggagcccctgctggaaacattgaaattaattaactacctaatgatggccctgaaaaatctcgatattgctttttgttttgatttcttgacacttacaagcacacacagtgccgagccgaacaatgacagccatttgttgtagaaacgaaagccgggccggaagccgggcgatttggcggccgacgcatcgaaacaggcaaaattggtgatggcaaaagcggccaaaaagaagttggaaatcaaatcagcgatcgagttcagctccccaatcatgatcgcctaaaaatgagcgggcttagccattctcatatttccttgtgattaggtcttggatatggcattattgaaaattgaaaatcttgcattaactgtaattgaagataaaggttcgaaaaacttgaaaaaccaaaattctcgacaagccaggtttcaacttattttttcattaatgtaagcatgccctaatggaaataatgctaacaaaaacaacaccgaaattgcgatcagaagagtgagaaaataggctctgaacgggtcgttggttttccgatagcctttcgcaaatgggtgcatataggggaacattttgtcggcacataatgcctgaaaaatttttgtcagacaaatccgactggtaaaatgcttcttttataaatacttgcaaaattcgtggcgcaccgatcagacagccgctggccgagcttagcgtggtggaaaaaatgccgacagtgatcagtggtgcccaagcaccctgcagggtcataacctagacgagaaatgtggtcgggataatatactcagaaaacaagggttaaatctagagctcgacctggatctggatccaagcctgggtttctcgaaggatccgggtcaaagtccaggcattcttcggcaacctggatttttcccggacatggatttccctggatttttttccagaaatccagttttagtcaaacatgaaaaagactacattttcctgggtttttgtccagaaaacccaggtccatggttttttcaaaatgtcgagctctagctaaatcagaatctgatcatagtaaccatggattcaattatatatagagcgcaagcagttaaattggccgtacatcataatcatttgccaacccaaaccggcacgtgtcattggcacggcacgacgggacggtgtagcnggtgggtgggtgggatgaagttcaggctcggaaaagccggttgcatcgcgtacagtagtcaatgccgtgatcaccatacaccttttatggtaaaagtgctgaattattgtcgaagaaaaatgcccaaacataccatagataagtgagtgttgtgatagcgatagcccaaaaagtgccgcgagggactaaatggtgcattttttcaattaaattttaaattcgtgtaaaaatttactggatttagacgggtctttgagatcacctggaaaaaaattcaagaaaagaaattaatgtaaggcaatttaaacatttcacagtatttgtgttactgtaattaacgttactacagtattcgggtctgca

SEQ ID NO: 30984 - DNA, 1050 bp, Heterodera glycines
accaagtcaagtccagaaaggaatattttaaaacgatttcgtttgtttttggcattatgataccgaatactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattattttgaagtcttgaatttatttgacaaatccaagacttaaaactgggagaagcaaggggctgtggctgggggcctaaaatttgggccacattggagaattaattctgatttctgaaaaagtcccagaaataactattttttctttccatacgttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggatgggtataaccgttttagaaatagcgtagaaaacagct

SEQ ID NO: 30985 - DNA, 1089 bp, Heterodera glycines
  misc_feature (985)..(985): n is a, c, g, or t
aaaaaaaaattaagccctaaactttttggcactttttaaaaaggcgtttggggaaactcaaaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaaccctaaactttttgncctgtttaaaaaggaattaaaaagttttaaaaattttattcatctccctttttgatagacaagggagacagagtgcctaaactaacatgtaaataaaatttggt

SEQ ID NO: 30986 - DNA, 1123 bp, Heterodera glycines
ccgcatattccatcctcatcgatacgccttttcatttccataatttgccgcttttcgcgatgccaatttgaaaatgaaaaatggcgcgcaacccccgggcgattggaaattggcgaaaaacagttgggcacagagaaaggcatttgtggcgagggaaacaaagaggagaaaggcgagtagtaacagaagcagcggagaatgatgacggagggagaagaagccatttgcaagggcgggggaagagggagaaaggggaggaggaaaagccatcaaaaaggggacggattgggaagcgaggaggacaacaaatggaggggagtaaatagaaaaggtggaacaacaaaacaatggctaaagcaaaggaaatgggcggaggaatgaccgaaagacccgcgggggaaattaatgggattaggcgatggaaacggcactttgacagacaaataagtgacaatggccgaagaaaaatactgcaaatggcattcattaagtggttaatgggcagtcggccatttgagtggagaggcaaactttgccaaaagccacaaatattccgtaaatttgaattaatgcaaaatgtgccaatgccctttgccccgcccgtttcccattccatcccattattacccttctgaccatcgtccgttttcccctgtgatttttcgaccccccgccgtatgtcattccctttcagagaatggcatttgcattgttttgctccttataaatcagcatttggatacggatggatgagcgatgagatgatgagccaaaaattgtttgtgtccgaaagggttggcataacacacaaaggaaaacggagttggcatttggcaagccgaggaattggcaaatggacaaccgaaggagggaggggggggggaggggggatggcactgcagggaatgcgcaagaggaaaagtacggtcgagaatggtctcgagaatgggaaattggcacccttcggcgagtgtttctcaccaatgcatcaaattaaacttttccacggaaattggaaacccaaaaaaggcaattaaatttccgcccaaaattgagcgatcattttcaaattagtttaaatgaatgaagctttattctttgcataattaccatttttttaaat

SEQ ID NO: 30987 - DNA, 1045 bp, Heterodera glycines
cttccccctcctccttcaccattgcctttcttccccttcctttgcccaacttttcctcccctcctcccatttgccttccgttctttcctcctcatcactcaaacattcctcttcttccaatgattgtgcttgttcttcctcttcttcttcttcaaaatttcatcgccatttgccaacggctgaaacattccatcaaagaatgttggaacaacaaatggaagaggcgaagaaagtgaagactttggtgaacatgcttaatgtgagaagaaagccgataaaaacggtgaaaaaattggagggaattcccaacgaaatgaaggcgaaatcgaccaatttggaagtgataatgaagacaaatgaacagcagaaaatgaggggacaaggacaatccaaggacgaaaaaaaggaaaagccgaaaaagaacaaggaaaagaaggaaaagggcaaggagaagaagaagaagaagaagtcggacaaaaaggagcaaggagaagcggaagtgcgaagagcaaaaaggaaaagcgacgacccctggggggaagaagggggcaactcggtgctggaggagccactgacactgccggacaacgaaagagacggcacaacgacgggccgatgcaacagcgaacggattagaaagtgacatttggggaggcacttataagcaagattactaatttttaattcaggatcattacgagggtgagtgacggatcgtgcccaattaattaactaacgaactctaaataattaattatatttaaccaaatgatttgctcaaaggcaaaaggaagagacgcatccgcgatcaaacggaacattcaaacggtggcggaacgccaatttgaagccaaattcaacgtgatttgtgccaacgctgacttttcatacatttcgaacaccgacgtacccagaaaaaagcattgaattaaagtaatgaaactccacatcattttaggagttctgtcaagagcagatcaatggcaacacgtgttatgtgttccgacaattggaaagaagtcacaaattaatcgcccgaaggaga

SEQ ID NO: 30988 - DNA, 139 bp, Heterodera glycines
acgtgtcggatgaaaggccattgaagttcaacaacaagatgttccatggctaaaggctgaagcggcgatacaaaatgccaaaccaaagaaaagcatttgtgatctttttaaatttgtttttatttttattttggtttat

SEQ ID NO: 30989 - DNA, 1799 bp, Heterodera glycines
aattttttatcttaaattttttagcttaattattctataatttatttacgactttattgtaatattttcactataagaatttaatgttcgaaatttttattttaaatcttttattaaaatttcgaattttaaaactttgttttatttttataaaataaataattttatagagcttgttaaaaaggttttattttcaattttcttttcaatttttatttgttcatattgtatttaatgtgttaaatttttgttttttacttttttaaatattatttcttcaatttctcgactgggcgatttcgattcggtttgatcccactttacaaattatacggctactcatttgatttttttcatctgaagagctgtttattttgaaaatattttttgaatcgtaatttagtcaaatttccttttaaatcaaaaacttcgaagaatttcaaattttgacataaatatttgtactatgttaattagttttaatgaaattcctctgacattgattttataattttttttatacttttgtaataaattaacattattattctggtagacaacacttaaagatatttagtttttgcacaaacgcgcaataataactcaaaattttttaaatttggatagggccttactaactaaaaatctataccattgatttttttagtttttttaatctaattcctctatataaagcattgattgcataattgtttcccaagctataatagcctgggtcaacatcagaaatgttaaatgaatttgcaaataagctggcaaataattcacatttttcatcaccatcatgatagcatttgttttcaaagactaaattcggtatttcaaagggattaacatagtatttttgtaggtatttaaaaatggaacgcggccgtccatgacctgaccccgcttggtggggggggggccattcgatagtttgaaatggagcactcgatgccaagctcatcgagtatacttgagacagcggtgctgtcgggagcaacgcgatccgacggctttggctcggccgactcggccaatcccatgacgacgatactccgccggcgttcctgctcttggaccgcttcctctaccattttgtactgcttggactgcagcaggtcttggttctgcggcagtatgatttgttgttgcagttgcacctgttgtagagagcgacaaaaaaattttgaaaagtgtttgcaggagcggcgagtcgctggtctcatcgtccgcgtcgttgctattcatgaggcgcgcaacgtccgctaattggtcactaaggtcggagaggacaaaggctttttttggggcgcaattttcagagaggaggcaacatactgacgtcgttcttatcgacgtcatacagtacaggaaggaatatagagcaggaaagaaatgacagcaccgcgccgactatgaaactgaaagcagaatgtgatgatggcactcatgttgcgacggattccggattgtagaatattagcgaagaaaatctcgagaataattcaatcttagagagcgcattatagagttaccccagaaagcattgaaatcatttgtttgcaaattatgctagtgagatggataaaaaaaaagaatagattttcttgagaaatccacgtatttttgagcatttcaattttaaaaaatgcaaaaatatgtgctaaaaattggaaaaaccaatgttatttttgcataaaaattccaaaaacttcatctttatcatttttgcccgcaccattgcaaataaaaacatttggaggggtttggggggtaaaataagtccttttttg

SEQ ID NO: 30990 - DNA, 347 bp, Heterodera glycines
cggtgtcatctatgttactagatcggggatcgatccccgggcgtccgctcgagcaggacctgcagaagctagcttgatggggatcagattgtcgtttcccgccttcagtttaaactatcaagagagggaggagagggttggagaaggaaaggaaaaaaaaaatgaaggaggagaaagggtgggggcaatgaaggaaaggtcagtgtctttgaaggaacggaggagtagcatcctcttagccccatttcctcgccctattcatcggcgcagagaggagaaaaaaggggaggggagcgtcgcgtatcgggggaggtgggtggcggaagaagagatgggtggggggagta

SEQ ID NO: 30991 - DNA, 123 bp, Heterodera glycines
agcttgctgcctgcggtcgattggcgaatagctcggcggcagcattgccctctttatagcggatcgcttcggtggccagttgcgtattcagttcggccactttattcgtgtaatcttctgcgg

SEQ ID NO: 30992 - DNA, 1412 bp, Heterodera glycines
atatcattcgatagcactatatgtacacttttttacctatgaaattttcaaaaatttttataaacttcaaaaaagttacgatcaaaaaggtttggaaaaccagttttttttttttagttttttggtcctaacttttttgaagcttaaacaaatttttaacgaaatttcctaggcaaaaaagagtatataaagtgctatcgaataatattaaaattattcaattcgatcaactatgaaaggagttattccccaaaaacgcccatttggtcggcgcccattcgacccggtccgttcctcctcacctttcttttcctttgatttttcttcatcactttgatcactccaaatttcttttttttcaaatattttatcctttcatccaaaaatccagaatcccccaaaaaccctcagaacggagctctttctggccacggtgctgcgaccgatgccaaaattcgttttgccatgccgccggtgcgaatcggcgaaacggcgcggaattgcggcagaaaatgtcgcaaaaaaaggcaaagagagcggcgccatgggagaaattcaccagtcattgcgacgcctcagagaacggctcgaaattgtcgaagagttctcagaaacgctgcaacttttggaggacaccgcacaaagaggggaggcagagaaaaggaggcgcacgagagagtgtaaggggtcaacaaacggcagacagttagagaggcgggcagacagacgcagtgccaaggaacagctgcactcgcgcagcgcaaaacgccacgcgttggcgaagacgcgttcccgctcgacggagcagtacggaaggacgagcggaaagggaggcggaggaggaagagaaggaggaataagaggggcaggaagagaaggaggaggaaggggaggatggcacggggtgctatttgcaaatgaacggattggtgtgcatgattacgatgatagcaattacatgattatgactcgtggtgataacagccgcttctgactcgacccatccctttccagcaaaagtgccatggacgacgacaaaaggaatcgaaatgccgaggatgggccggaacatcaccgctggagaaggcgaacgagcggtacaagcggggccagctgcttactcagcggggccgagcagtactcgcaacaacagcaacaccgacaacacggacagaacggcggaggagcagacgaaattttggacggaggcaaaaggaggaaacggaagcaatttggaagcagcggaagggggcgcgggtggacgagttggagaagacggaagatgtcgggatggacaagcacagaaataacacggacggaacaggtggggcatgaggaaagggtaaaaagccacgggcaaagcagggaagccatggtttgaggaaaatgaccccaccggcggggggtgccat

SEQ ID NO: 30993 - DNA, 1938 bp, Heterodera glycines
tagttttgaaccgtcgacccttattttggaaaattagaccccaaagtggcaaatttttgattgttttgtgtaaaagcgctacaaattcctgcttttacgtccggcgatgggaaaattgcacttgaattttctgacccaaacttaaaaaaaattcttcggggtgctttccccgaaggtttttttatttgaatacgtgcctgtccaacggtaacgaaaaacgccgccagaaatttatttgaaaagttgagtgaaatatttgaaaattttgtcaaaaataaccaaactttgcgattttgaaaaaattgttcattctatggatttttggaaaaattttctcgaattttttggaaaatttttagtgaagtaggtcttggagggggcacgaacaaggagaattctaaaattttcagcaaaaatattattttcttaaaaaaattccctttttttttgctctccggcacagaaatttttaaataacactgaaaaaaaaatttgacccgaagaacaaaaaaaggtctttggatccccccccccctccgaaattttttctggttttggattttttggggttaagtttccctggtctacatcccccgggggtttttctatcggtccttaagttgccccaccgcttacccccggcctttgcgtgcgcctcggtacaccgtctcgatgatgtcgatcagttcttggccgtcgtgcattggccaattgattttgttgttgttgccggtgcccaagtcgatcatgatatgcttgttcctaaaaatggaggacaatttaaggaacaaacaattgggaaatttatttcgaattcaaaaaacagtcataggaaatgcagaaaatgttttttttccctaaattctgagaaaaacctgaagaagaacatcgcggtgaccgggtcgtacaactcgtacattttgttgaagtcaggcacctgcaaatggaaggcaaaatgacaaaaatatagatttatttggtgtcgtcatttttttgctcacaatcaatagcaaaattgaaaaaaaaacatttttctcttttttaatgggaccagtatagttttcaaaatataaaaaaattcggttgtctgttcgaatttaggtccgataatgggaagtgacataaattggtgcccttttgaacttagcgaatcaaaccccccaaaaaattttcgaagaataaaccaatcttaacaagacggggtaaaaaggagcaaaatttggattttattgaaaacgcggaaataaccaaacatttcttgactggttggtcaaatacactgacaaaatttcggtaaaaattatccgtctcttaaaaacagtcaatttcaaaaaaatcccacaaccttacaagggaacctcgctaggagaaacttgaaaatgtggcgcgcgcatgtaactttcaaaatagcattgtatacgagatgcgcttatgaatgagcaagaaagacaagaaaaagattgaaaagaaacgggtgcggtaccaattaatttttgcttcgggattatattattatggaaaattaaccataggtatgttctagccgtaatcgaggggtttaatattatatacctaatttatgacggtctttgtcatgaaaaggttatcatgaattttgctactcttcaatagaaaattcttcggcaaacaattttatgaattattattgagaaattcggacgaatgcattatcgaattgacaggtgcatgcattttctaagagagtatatgggcaaattgaacattataggcagggctaggcgaaacttcggcttcgaaaacttcgggttttttgagcttcgaacttcctgcttcagctatcggtattttccccgaagattcgggaaaaatacacccctaaagattgagtttacaaagtgaaaaagcacccgtaatgattgggcttttggcaaacttaaaattaattatattcataaa

SEQ ID NO: 30994 - DNA, 1013 bp, Heterodera glycines
atagggatacgatttattagtgctaaaaactgccaaaatagttagttctaggttcaaaaaaaaccaaaataggtgcaaaaatgggaaaatcaagaaaaataggtaaaacctaaaaaataatatccctaataattaatgggttaaaattattttaattatatttattaatattggtttacttgtccgacagtttgtggtccaccaccaaataaatgatcagaatggcacgcatgccgtagaaggagaagcgctcgcaaaattcgttgcccaacatgaaaaagacgcccgttgggtacgagcggagactctgcaaaatgccctcctctttctgcggctgccgtgccgcaccttcgcactccgtcgagttggggctgtatttgcctttcttccgccgttgggtgaattcggcggcgccattgcccacggcatttttcagttgtttctgggtgctcagatcgccgatgacagtcatttgattggagtagtactgtaaatacggtaaatgagaaaataaattaaacaggtaattattattattgtagaatacggtaaataatgaaacaaattaaataggtaattgtgattactgtaaattacggtaaaattaaaaacaggttcaatttaatgtctgaaaaggttaaatttaaaaaataaaatttagaaatgaaaggcgttaatcctttgagaattatgaacgccttaaatagaatatattttttacaattattattattttgttaattgagttttaatttcgtcagcatcttatgaccattactaatattattataattattatttaattgatattaattgatttgaatgataaaaacataattaggaaaatttgttgttaatttaattacgagttggcgatcacttaatgatcagtcagtcagtcaatcagcagtaattattttaattgttcataatcggcggttgttttcttcctctgacctccaattgttttttttaattattattttattttcaattcccaaaatttaaatttt

SEQ ID NO: 30995 - DNA, 570 bp, Heterodera glycines
acctcaaaaggtgcatagtattataatgatttcaatagagaattagattaaaaattatgagaatgaaagtgcctgtctcgcgatatataaatccgcaattcgcgaaaaaatctgacattctatctaatatttgctataaaaattcacccataatctcgtttgacggctcataattctgggctcataaaacggaagaaatccgcacatagattttacaaaattgaggctaatttctcaaaatttcttcaagtcctttaaataaaagctccagctctcgaaaatagctaagatacacatatataaagggaataaccgataacgaaggataaactataagaaagcaactaaaaaatagaaaagttcatatggatccaaatattttggcgccttttccaatttttataaagatctatgattatacgcctcattaacatcccaaccttccccctccccctttggtccccccaactcatcccaaccttccccctccccctttggtccccccaactcatcccaaccttccccctccccctttggtccccccaactcatcccaaccttcccccacccc

SEQ ID NO: 30996 - DNA, 1123 bp, Heterodera glycines
ttcattttgctgctgttcaccatccttctgccgactgctgatgcgttttcacttcgcatcgttttcataaatttgccttctttaccatcttttatattcattcatcttttgtacattcgtcccactttctctttgtttatttcatctttaaaaatttttttattttgaacaaaaatttattaaaaagatcattgtcgatttactaaacacggattctgacataagactttagagtcaattaaaataaaatttggcaaatatttcaaaagtattattaccctgaggatgaatcttgatatctaaaagctaaaacctattacaatatatgattatttgatcattcaatattaaacgtgattttgtgtaattttaaatcgtatgaacaaactcaatttaattcacctaaatgtttaggggctccgaattatacgggttttatcctacatatttgtcagcaaatgtttacccatggccaaggcgtgctggccccacaaatggttcacatgcatcgtttggtgggcaatcagccacacagcggagggtcggcattcttcacttccgaaaatgtggaattggtgagtgcgcgggcatattgaattttgccattttcttcataatgttaggtaaatcaatcgatgggtaccaacggccattgctccgtgggagtggcgccgcataattttggctcctttggacaaccaaccaatgtgatggcattctcttctggccaggccatggcttccggcatggacaatcccattgtcctaatgggacagaatttctcagctgaccaaatggaagttgggccgggtcggacggcggaaaccaacgaggaaacgaccggtgcatttcggatgctgttcaaatgcccggagtgtggcctcgtgaaaaactccaacggagagttggaagtgagtggagcggcaagagtccatgcgtttttggcacttccttcaagggcgtagccaggaccttcgtttcgggggggggcaactcaaaaagtcgattcttaggggtgtattttttcgttgttgtaaacctctatttttaggggtgtattttcgtgttttttttttaaattgaattgattgcattatcttatgtttcctttgcataaacgcgt

SEQ ID NO: 30997 - DNA, 1119 bp, Heterodera glycines
ttccccaataaacttttcataccccatttttcgcaccgtattataaaaagtcttttttcccccataactttttcataccccattttcgcaccgtgaatttttatgatgaaccgtgagtagcttagagtacaaaaaatgaaaaatttgaaatcatgtttactcccttctaggggtattattttgtaaaaagtctttttttccccaataaacttttcataccccatttcgcaccgtgaatgttatttttattgaattctgaaccggtttgagtagattagactacaaaaaattgaaaatttcgaaatcatgtttcccactcccttctcccaggggtattattttgtaaagtctttttttccccaataaacttttcataccccatttttcgcaccgtgaatgttatttttattgaattctgaaccggtttgagtagcttagagtacaaaaaattgaaaatttcgaaatcatgtttcccactcccttctcccaggggtattattttgtaaaaagtctttttttccccaataaacttttcataccccatttttcgcaccgtgaatgttatttttattgaattctgaaccggtttgagtagattagagtacaaaaaattgaaaatttcgaaatcatgtttcccactcccttctcccaggggtattattttgtaaaaagtctttttttccccaataaacttttcataccccatttttcgcaccgtgaatgttatttttattgaattctgaaccggtttgagtagattagactacaaaaaattgaaaattttgaaatcatgtttcccactcccttctcccaggggtattattttgtaaaaagtctttttttccccaataaacttttcataccccatttttcgcaccgtgaatgttatttttattgaattctgaaccggtttgagtagattagactacaaaaaattgaaaatttcgaaatcatgtttcccactcccttctcccaggggtattattttgtaaagtctttttttccccaataaacttttaataccccatttttcgcaccgtgaatgttattttattgaattctgaaccggtttgagtaaatagagtacaaaaaattaaaaatttcgaaatcatgtttccc

SEQ ID NO: 30998 - DNA, 1044 bp, Heterodera glycines
ttattttatgggcgtatctttttcaagatctgtaaatcaatagcaccacgttttttgtgccgagaacaattttcagccagaaaaaaaattcggagggataaatctctttttttttgcaaatggtcattaattatgctgtcaaaatttctttttcgagtaatttctgtcccaccttttccacgagttcctcaaatgcgcattgaactccttcgcgcgtctttgcgctcgcctcgataaaaagcattcggtgtttcttcgcaaattgaaggccctcctcccgcgagaccattcttcgctccttaagttggtcaattgtttcgttgcgaagtttgctctcaccgcgtcgattttgttgccgaccaacattttgacggtgtcacttttggtgcagtaagtgtccacctccaacagccaatggtcgagattctcgaaagacggccgattggacacatcgtacaccaaaatcactccttggcctgaacagagagacgctcttaaattctcaaaatcgctgcacctccgcggtaataactcggtgtaagcgtccgaaagcgttcttggcccgccgtgtcccaaatggccaacttcacaattcgatcatcaattgaaatcgaacgaacgcgaaagtcaactccgatggtggctgccatgtccgggtcaaatttatcatctacaaatcgcgcgattaggctggatttcccgaccccactttcgcctaaagaaaaatataagaaaacatggacaatggaattgttccacgaaccgatggttagaattttaagagtcgtcaaaaagttgtcgccggtgtccattttaattagaaaaaattacttttccgtttttcaatttctttcgaaacaaaaaatcatttacaaaataaaaaaataagtgaaagatgagagagaaaaaaatgatatgatagagtcaaataaattaataattcccttttcgtcgtcattttcttttctgtaactttctaatataaattcacttaagaatggctgagaattctgaccccaaacttatcgaattgcttgacgatgc

SEQ ID NO: 30999 - DNA, 1381 bp, Heterodera glycines
  misc_feature (1264)..(1264): n is a, c, g, or t
ccaattttaaaaactaaaaatagtgcacaaaaggggagcccccccgcggcggggcttaaaaagcattgtacagcatattaaaaccgaaattaattttggtatatttttcacaatttatttcaaaagacaaaaaaaatgattcaattttgaaacgaaaatagtgcacaaaagggagggatggttagacgaaaaagaggaatttttagaaaagagcgcaccccatctgatatttccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaaagacaaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaaagccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttanaagcattgtactgcataattaaaagctaaaataattttcgtatatttttcacaatttatttcaaaaagccaaaaaaaatgattcaattttgaaacgaaatagtgcacaaaagggagg

SEQ ID NO: 31000 - DNA, 1893 bp, Heterodera glycines
acgaaggattttgtggagtggattttaactgcttttaccaattacgatacgtacatttttgcgcacaacgccggacgatttgacggtaatttcaaaatttaatttttaaatcctaaatttttaggtcattttgtatttaattatctctgccgtaccgggaagaacccgctaccgctcattaacggactgaaaatttatgaatttaaagtgcaaaactcgaagaaacattcaaggctgatttggagagactcgtgtttattgatgccggtgaagcttgagttgctgaaggcgacatttaatttgtaatgtgaggacaagccctttttcccctactactacaacaagaaagaaaattatggagttcgattacaacatctgccaacaatggaagattattcaccagggtctatgaataaagagaaatttataaaattcgaaaaatggtaggaaaataatttaaaaaaaaacaataaaatcttatttttcaggtataacgaaaacaaggagacacccttttatttggatgaagaattgaaaaattattgccgaaacgacacggagattttattgctgtcaattattgagtttaggagaattttgatcaacgacattacgaagggatttgacccgttgccgaggagttgtacgaatgcgggggtcgcgatgaatatttttaaggcactgtttttgttgacggagcagttatcgattgtgccggagaagggatatgagcggtgtgatagagcgagtgtgatggccattaaatatttggagtggcggagcaaacgggatggaattgagatacggcacgcggggaatggacgagaggtcaaagttggaaattacaaattggatggatttattgcgaatgaaggaggtagggacaaatgcattgaggtgatgggatgttacatacacggatgtttgaattgttatgacccggcggcggaactgattggtggaaggacggcccaggaattgaacgatgagacgcaggagagattgatggagctgcgtaagactttggacgtcgaagaagtttgggtaagtttatctgacatttacatttttattgtgagtttttaggggtgccaaattgaaaaggaactgaaaaaggatgaggagatgcgggacttcttcgacgacagagggaatgagaaggggccgattgatccgcggatggcttatgcaggagggaggacgggaccgatgaaattgtttgcaaaatcggacgagaagaaaaaaattagcgtttacgatattgtgagtctgtatccgtctgtgaattacggtacagcttacccgattggattgccagagattattataccgaagagcgatgagattgatgttaattggacgagaccggaggatttgaagtataagggattgtataaagtgagggtcaacccgccgcgggggttacgggttccggttctgcagttgaagtgcgatgataggttattgttcccgttgtgttggagatgtgcgtcaaaatttaagaaggagactacgagatgtaattacaattgcccccatgatgagacacagcggagatacgtggcgacatataccagcgttgaattggtaagaaatttaaaatttgaaatttagataattttgacattttcaggcaaaggcgttggagtgcggatattctgtggacagattttatagagcgtggcattacgaagaagaggcggatgacttatttaaaggatatgtgagattgtttttgaagctcaaggaggaggccagcggttttccgaaaggggttgagacggaggagcagaagaatatttggagagaggaatataaagaaaaatatggaatagatattgaattggcaaaagtgaagaagaatccgggattacgatacatcagcaaattgat

SEQ ID NO: 31001 - DNA, 1233 bp, Heterodera glycines
tcagagggttcgttttattcagagggtcggtttagtcagagggtcgttttagtcagagggtcggtttagtcagagggtcgttttagtcagaggggtcgttttagtcagagggtcggtttagtcagagggtcgttttagtcagagggtcgttttagtcagagggtcgttttagtcagagggtcgttttagtcagaggttcgttttattcagagggtcgttttagtcagagggtcggtttagtcagagggtcgttttagtcagagggtcggtttagtcagagggtcgttttagtcagagggtcgttttagtcagagggtcgttttagtcagagggtcgttttagtcagagggtcgttttagtcagagggtcggtttagtcagagggtcgttttagtcagagggtcggtttagtcagagggtcggtttagtcagagggtcggtttagtcagagggtcggtttagtcagagggtcggtttagtcagagggtcggtttagtcagagggtcgttttagtcagagggtcggtttagtcagagggtcggtttagtcagagggtcgttttagtcagagggtcgttttagtcagagggtcgttttagtcagagggtcgttttagtcagagggtcggtttagtcagagggtcggtttagtcagagggtcggtttagtcagagggtcgttttagtcagagggtcgttttagtcagagggtcggtttagtcagagggtcggtttagtcagagggtcggtttagtcagagggtcgttttagtcagagggtcggtttagtcagagggtcggtttagtcagaggttcgggttatttccagggtctttttactctttgttgacgattgagattcttagaccccctatgaatcggtcggggtagttttcgcgtgagtatatgtttaggactggaattggtcgaatttgtgtttaacatccatgtttctaataccgaacccgcattcggacaaatttattaactttttaatttttttatttcttgcggctaatatcttctacagtaatttgtcagtttggtcggatgtgcgtcatacggaaataataattttaattttataataatataacaaaaaataacaaatttcagaacaaactaaggtcgcatttcatagtttcgggaaacaccggtgagaaaattgataatgtttttcggattccctttggcattggcataattggggtcatttttgggggaggggattgttattg

SEQ ID NO: 31002 - DNA, 1201 bp, Heterodera glycines
  misc_feature (1189)..(1189): n is a, c, g, or t
gcagcaaggagggcatgaacaaattgccgagcactgaatgggattgccatcagctgggtgccatccaatttacggctgtcagttttctgaaaatttaaaatttttcaaaaaaatttttcccagggttccacagggccaccaaaagcggtggggttgacgcattatcagctgatcaatgggtgccgaattgcggcacaagccattgacatcaagcgggaggtgaacgcgtttttcgaacaaattggcaaatatttaaataaatatttgaaaaaaaaattaattttttaaaataaattttttttttaataaattatttaaaaaagaataaaaagtgtaaaaatttattaaagaaatgttcaaatataatatagtttaaagttgtgaaatttatttcggtaaattttacattttaaaagataaaaatatttgtaaaaataattttttatttttatcgactcaatttgttcaataaattttaaaggctaattatttttttaaataccaaaatgattaattaattttcattaattatccattcatttattaacctaattttatttatataaattaatagactgttctttgctgtgcccttccactttttcggataccggtttttgcattggccattttcacgccatttttaattgaatcgcggtaataatttaaatttaaaaaaatttaatccatttatttttaaataattttaagttcaatttttcctgagccttctccattgcctcgtttactatttcaatccatcaacaaaaatcagttaaactattttaattaaattttatcatttattaatttattatttataaaaaaaataattaaaattacctaattatttttcaataatttaaatgttttaaatgcaacagatgctcaactttgttgacaaatgccacggcacttcgccttctgctcaaaacttcgccgcttacacaaggccaaaagttttctttgccaagcattgacaccgtcattttgttgggcgatagggtaaaattttgcatttttttattttaaaatttaaatataaaatattattgaggtatccaccgatttgttgacagccattgagtcggtgatgccaaatgcaaaaggaatagcggtaattttaattgaaattacttaaatttttaggtcaaaaaataataaattttataacaaaagcatcttttanatttcaaaaaaa

SEQ ID NO: 31003 - DNA, 1288 bp, Heterodera glycines
ttttatttaaatataattaaaaaataaataaataaaactaattaattgaataattgccctcctttcacctgatgttcagcgtgttcagttcttctgcgcaaaccatgaagaagatgtccgtggcacgtgtgctgagaatcgcttgtgccggcgattgttccgccggcacggcgcgccccgggggcaaaaagagtttggcaccgccgcctttttgccaaaattgcaaaataaaatttgagagcgccacctgcttcttctcgtgaagccaaatgaaagtccatcttgtcctccaattgcttctggtcgtcaattatatcggccttaatttttaggatttactaacgcggcgccaagaaattggaaatttgtttgaatttttacattgtttttcaactcagttttcttgataagttatggattatgaatacaaaaagggtgtggtcagtttcaaaaattttattggcatggaattcgtttttgattggcggcttccctgggcagtgccattccctgactgatcaatcacccaaagtgatctgacggattgaccattcaattattgggtcatttttttcttgttcaatcaattggttagcccggactgatgcgatcagttgccaacctctgatcaaatggctcaaatttggcgaattgatccatcattctttgaccgattttcgtaaatgtgatcagtagttaattcctgactgatcaacccatcccaagtgggctggtagatagatcagccaatctttgatcactttcccgtgggccgtctcaccgctgccgtttgcgtcccaccgcttctctgactcgtctgaccgtcccactctccgttggtcgccacactgtctcgtcgtccttcccctttctctgcccgtgccgtgccgccctctccgtttgccgtgatcatttcgcgcagttgcgcaaattccgcgtcccgtcgcgacagctccgcctgcagccgtcgcacgcgtcgcagcagctgctctttgctgtgcccggcggcgacggcgcgcgcgacttcgtccgaatcgacggaagagccgccggacgaattcgctggaaattcaaaagcattttcatttgatcacaagcacatttaagcgaattaattatcaattacttcacaaaagataaagcccctgaaaatgtaaaattaaaaattaaatcgtttgatttttgctagacaaatagtgtaatttgcttcttaaatttattcttttgaaataatttaaacgttttaaattaattaaaaaacattattaaattaatcccaatatttctt

SEQ ID NO: 31004 - DNA, 1703 bp, Heterodera glycines
ttgtacctcttctaatcactgttgcacctcttctaattactgttgtacctcttctaatcactgttttacctttcttaatctctgttgtacatcttctaatcactgttgcacctcttctaatcactgttttacctcttctaatcactgttttacctcttctaattaccgttgtacctcttttagtcactgttgtatctcttctaatcactgttttacctttcttaatctctgttgtacctcttttaatcactgttgcacctcttctaatcactgttgcacctcttctaatcactgttgtacctcttctaattaccgttgtacctcttttagtcactgttgtacctcttctaatctctgtaaggccaacaaaatttgaataacgggcgcgaagcgcccgtatgaatcaacaaactttaaataacgggcgcgaagcgcccgtccaaggccaacaaatttaaaaacgggcgcgaagcgcccgtcttgagcctcgatgtggactaaaaacccctaataattttttaaaaattcaaaaaaacctccccaaccaattcgatcaatatgaatcgcttcacagcctaggtagcgaagctcaagaagcgcgaagcgctttttcccagtgttccccgaatcagttctgtagaatgtcgtacccgtacccatatgctacaatacctcattgataactcatttttctattgttgcactttgatgtcatatccaactcatcctgttacccatggaaaaatgtcctcccaatgggtgataatgaccattttaagaagtgtaggacccaacctggacccgaatatcccgttgagtctcagaatcttaagggcacaatttcttaactttttaatttttttatttcttgcggcttccacatgcgcagcgttcatgtcgcacgaatgaactcacgaccaacttctgcacaacgttatttaaatccgtgtgcaaacgtcctgaattttaaaagattttcaaaattcaaaataatatattaacatacccttgcacttgtctgacgggccatgaaactcacatcgccaaaatttcttaagtcaatctgcgctcaattggtcgaaaacatagagtgcgccgtcatgttctaacttaactttgtttctttttgttttaattttttgctgctggtccatattatataattgaaagaaccttaatttagtttataaactcacttaattataaaataaatattcgttagaaaaaagagtgaaacaaattttcgttaaataaatgtgagttatgaattctcttttatatgcaaccacgcgaaaacagccacgcgaaaacggccacgcgaaaacggccacgcgaaaacggccacgcgaaaacggccacgcgaaaatggccacgcgaaaacggccacgcgaaaacggccacgcgaaaacggccacgcgaaaacggccacgcgaaaatggccacgcgaaaacggccacgcgaaaacgtcctggcccgaaataaaagtaccattttttttctccttcttttgtggcttatcgtataaatgattaaattcttggcaagtcgctttgcctttgacggttgagtgagattgctgttagtttgttgtccaaaatcttactacgaatttcttgattattcgacatagttatttcgcattttctcactttctatgcgtgatttcgacagcaagtgaacccgacaattagagactgggtttt

SEQ ID NO: 31005 - DNA, 1248 bp, Heterodera glycines
tgatgtttaattgtatttttcatttcaaattttgtatcaccggaccaaaaattcacttattatttaaatttaacgcaaatccataaaattatgttttttttgatgctataagccaaaactgtgccatgtgatacatttttcaattcccttttcatttttgccattcgcctttttaaggccgcttttcgcttgaggcgcgtgcccaccaattgttggccattgctcggcttcactgttacgaattctcaaatttttatgccaattgcgtccccaatttgctcagcgaattcggacgagagaacggtttgggcgagcagagccgcacaaaacttgagaaagcattggcccattcgctgttcaaagtcagtgagagacaaagcaaaacaaagcaaaaaaaaaaacaatgcttaaattctttaatttttgaattatttaattttcaatcatttaaatttaatttgaattacgtaatttagccattgattaattcgggagcagttcgtttgctcttattgtgtatatatttgattctcaaatatacaaatttatgtacacaaaaaaaatatttattaaaattatacaaacaattgttatttttctaattaatattattaatttttaggactttatgcgcaaatatcaaattctgtgcaaatttactgatgtcatttggccccagggaatgtctgacgaggccaaaaagcaaatggccaaagattacggcgagaaaaactccgaaactgccaaaaatccttgttcaaaaccacggaggtgaacaaaaattacaccaaaattgatatgaaaaaatattaaattgaattaaattagtcagaatgggccgaatgtttgagatgcgcgtctatggccgagtgggaaaccctcacaccgcaaagccgcgcagggaacacacgtggagatacagcccctataaagcgcactacgattacgcggattactattccgatggatccgttgatttctattattaaaggaaaaatatatttatatccatttggatattttttactctcaatgagaattattggccagaaattggaataagaattgttttgacatacagtaatggtcaaatgtttaacagcacgtacacttattacttgtacattggtgggaaaaagtcttactcaaacgtttaactccaccaaaaaatgtacaggaaaattcaaatattgacttactttttattttttgatacaacattttgggcgtttcaacttcggtgttggt

SEQ ID NO: 31006 - DNA, 999 bp, Heterodera glycines
aaccccatttttcgcaccgtgaatgttatttttattgaattctgaaccggtttgagtagattagactagaaaaaattgaaaattttgaaatcatgtttcccactcccttctcccaggggtattattttgtaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgatagtcttttttcaaaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttcccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaa

SEQ ID NO: 31007 - DNA, 1355 bp, Heterodera glycines
  misc_feature (39)..(39): n is a, c, g, or t
gggcacttcatcggcgggcatactgaaacagatttttancagttaatggaaccacaaaatgacattcaaaatatgcgcgttttgcgagataattcccatataaacctccacaagcaaagaccggactcgtctttggccgcttcaatcgattcaggaatttcggtgccaaagttaaccataactttgcaatttttggtagcaacatgggggaaataaatatcgccggttcggtactggaatttttttgatattagatatacaaatcgtttatcaaacccgaatgtcggtgaatgccgcgccaagtggttgaccatttttgtaatagcgaatttcggcacgcccaacatcctttaagaaaacaatttaatagaaagtacaagaatgtgttgcccaaaactaaccaaaactgaagtgatcacttcatcgacaaagaacgggtcgacaaaatcggtgaaaatgttattggtcgctttattgcccatcgaagaaaaggcgaaggaattttgttgttcgccaagctaaaaatattaatgtctttatttaaataaacaatacctctcaaatttggaaatgtttaaaataatataaaatgttaccaaattggaagagtcagctcgagaccaaccaacacggatttggtgcggatcagcttcgtcaaacggcaaatgtttgagggagagaaattcagtgatctgtaaaaataagaattatttagatgcgctgaaaaagtacaggaaattccacttgccttcacttggaacgctattggtggcatttcggcgcgctgattttcctcgtccggcaccaaaacaccccaattggcgcgtacccctccccacatcaacgcaaaaccatcactattgtcgggatcgacaagccatttgttgctgggacatgccttcatgttgaagtcggagttgtctaaaaacccactcatacttttggaaatttaggaaatgttacgttcaaataaggaaagaaaattttttaatgaaaaggggtcgcttcggacggagtatttgagaggaaggaaacctttttggacgaaatcttagaaggccagaatgcctgggactagaaaatggtatttgctaattccagatccataaaaagctcaaaacaaagctgaataaataatatactcacaaaagtccagctcaacatgctcggcgtcgggcaatggttcatcttcaactggcttcggctcctgttcgttgtttttgctcctcggtggcaaaccggcggccaactcaaagaggtcgtcgtccatgtcctctggcacctgagtaaatttgctcattgagtaccattaaattttgaaatgaacagataaacggcagaaatttaatcgacca

SEQ ID NO: 31008 - DNA, 1431 bp, Heterodera glycines
tatgagttttgcctttgtattttaatcagtttccccatcatttatacattgttctaatacgtaaacatatttaattcatagctttaggatagtttcaaaatcaacatagtatatgcaattaattcacatttgtttggactgccggcgaagaaatcgcacccagtatgtcctggacggtgaactcctccaattgtgttgattcgccgcccgactggagcggtcgtcgcagtagcagccgtgtgggggaacatcaactgctgaaaatgtctgagaatgatttggcccgagacggagatgatggagttggcctggtgggtcgcgtacagcggctagtacaacacggtgtagggaaagtggggcaaattgtccgtcatgaacacccgctcctcacggtggaccttatgaaattttaaattgtagacattttaaaggatgctttttacaaaataaaaaatacaaatatattagaaaagtggtactttgaagtagattggtcccgtgtgatattttcagaatcatatcatcattcctgtacggtgtcgccaaagaaaatcgatatagagaaaaacataaaaatttttgaaaatctgcccacagataacacacaagtacccaaaattgttacaccgccagatttttattttattttttatttttcagtttcgtcatttgagtcctaatgactatgaaatttcagttccgtctcgaagattggcttatttttcggaattttcatcacaaaaagtcaaattttgccttaaaaagtgtaaataagttcctgtttgattacgcgtatttagccggtttcaaactaaaaatgcaaagttcgaaaaatttgaattttcgaacttttgttcgaattcatgtccggggttcgaaattggtcaaaatagatgccggatcgtgatcagcggccccaaaccctaggaaacatgctttcatgttttttgaaaacaaaaaaaacctttatttgatttgagtcatttatgcattattcgaattgcctttgattgttcagggcaaaacggtgacccaaaaagacaggcacaaactgctgcaggcgaaagagttgggaaaacggcaaaaatgagataaaaataaaaactttattatataataaataaaaaaaaagtacaatggcgtcaggctatgtctactacaaatggagaaaattggcgagaagtgatgtcaaaaattaaaaaatttgaaatgacgcgtcccgccgtacattagtgttaaccggacggcaccgtgttttgtgaattgaataattaaatttatttatttaattttatcgatcactgagtttttgtggaacgcccacactgagcttttttgtggaacgaaatagcaccggtaaaatctatcccactttaaaagtgctctgtggagatgggacaatagaggctggaacaattggaaaattttgcg

SEQ ID NO: 31009 - DNA, 2343 bp, Heterodera glycines
tccttaaaaaaaattctttattttgggaaattttttcaaaaatttcaggagtttttcggggtcctcaaagggtttttttaattggtcatgtatttttaaaaattttttgtgaacttttcatttaatttttctacggttttttgtttttaattttaattagttgattttaaactttttacctttatcaaatttttttttccacaggttatgccagcacacttttgttccttgtgattgaatcgggaaaaaaaattagactgcctcccccaaaacccaagtcattattaaatttataatttgctacttttaattcaatttttattaaaaaaataatattttttttgcttattttttcaattcaatgttttcacaaaatctggaaaattcccacatcgaaagacaaataaatttttacaatttttttacaaattccccatataaataataatttaaaaaacttttttcattctcttcttaccgtaccttaattcgaaaatttttatttttcattctcttcttaccgtaccttaatttttaatttttaaatttctatttcaaaatttcataaaataaaattctttaactccataacattcccatttttcataaattcatcccaaaatcaatttcctctctctctctaaccattcctttcactttataattaaattcaaacaaattattaatttttttttatttctacaaaatttgtaaacgtccccatatttttttcttttttttttttttttgcaatttcttcgtcccaaatgtgttgtgattttgtgtgtgtgtgtgtgcctcgttggcctcccgccccgcctcgtccgttccgtccgtccgcgtccgttcctcccatttttctctctaatcatttcgcccattttcacttttcaatttttcgccgtcatttttcaatgacaaaacaaaaattgagagtaaatttttcgcgggcaaaaggaaagcagcagaaaattgaacaaacgcaacgcaaaaaaccaaagaacaacacaaagagagcggcgacgccggcgctcggcggagcgcaaaaaaagtgaaagtgaacgcaaaagcgccgccgggcgcgggcggcgcccaaaaaaagcacacaaccaaaagcaattatcgtgccttatgcacacaaataaatttgacgcatacacactattttcatgcttaatttgtttctctttctttctcacccctccaccctttctctctctctcgcctctctctctctctcacttcctcctcctctcacgctttctcatctctctctctctctcctccctttctatccttcctctcttcattttctcactatctctgaataattattccttccttctcatctcagcctcactatttccctctctctctctctctctgtctttccatccttccccctctctctttctcccttcgcattctcccattcgcttatccttcccattcctcttgctctctccctttctctctctctagcttttttctctcgctctcttccaccacccccacactatcatttggccaatttttgtttatttattttttttattttaatctttagtccttctttttccattgctgccagctgccgttgtgttcttgcgtcagccgcgcacgattctcacgaggacgcaaaaaaaaaaattcgctcattttctcctctttttgaactgtaacactctctgccctgtctgactgtctcgcttcctcaactatttcacaaaattcgtctctctactatcattcccgaacgcattcataacacacattttgttgtctgctgccagctgcgtgcgtcttccagtctttttggccattacatgcgctgaattttgtgccagccgcgcacgcttcccatcacgttcatttgttcctctttttttctctatctctctctctctccggttttccatcgtcgtccggttgccgttaatttcttgccgctgctgctgccagccgcgcacgcttcccccaccggcgcggcgccgttggcccgtcccccttttcatgctctcgagattttgacgacgtaactccgttcttcatgcgctttctgttgtgtgtatgtcttgcatgcactcgcaactcttgtctctgtttcttttcccctccactgtacatgtttcaattttcctccatttctccgtgctcctacataaaaaaaaatatctcctttttttttttgcgctcccctctggggattcattttggtccccattctcgttttgtgttctgtgtctgtgctctctaacaattccttctttctcactctctctcttttctctctctctctctcttctctctcacttctttctctctctctctctctctctctct

SEQ ID NO: 31010 - DNA, 1339 bp, Heterodera glycines
cccacttctttttaatactttcctttccgtcgcgggactataaagagcagccgcgaaccgggacgcctagttatctatatataaaaataaggggggggctaaccacaaaacgacctggccgcaagcgaatatcgagagttgagcaccgagaccggtaccattcgaaagagctcggttttctctacaattctaaccgtgtggaaaaattagcgacaagcagacattttcgagaaaatcgcgttcgaacaaaaaaaacccggctttttacaactggccaaaaatgggttgtaaaatgtgtgttttgaccttatttctcgggaaccgtaagagctacgcttttgcggtaagcgaacaatttgtagagctcgtcgagaggaagggtgagaaaaaaatttcgtagctctacgacaaattcgaacaaagttataccccggcaaaggtcgaaaaaagccgattttttttgtgttttcgccttccggtttacaatccgtttacaattgcaaattcatccggaatgtccggaatttcacggattttgatgtttttcacgtgttttcttcacgtttacgtgtgtttttgacgtgcgttctttaaaccggttccggtttttcacgtgttttcttaacatttacgtgtattttcgacacgtttgcatgcgttttcaacatttcacgtgtgttttcgttacattaacgtgtgtttcaatatgttagcatgtgttttcgagtattttcacattttttgctttgtgttttactttgtgtttttgcatgcaatttttacagtttaaacaccagaacaattctgattgttccggaatgcttcaaaatagttctgataattctgttacagaccagaacagttctgaaaattctggtaagcgtccgaatagttctgataattctgaaacacaccagaacagttctgaaaattctggaaaacgtcagaattgttctgaaaatataaaattaaattaaataaaattaaataaattaaattaaaataaaataaaataaattaaaataaaataaaataaaataaattaaaataaaataaaataaaataaaataaaataaattaaattaaaataaaataaattaaaataaaataaattaaatttaaataaaataaaataaattacaataaaataaaataaaataaattaaattaaattaaatcaaatcaaaataaataaaaattagctgttttgcacgataaggggcgggcgcgaagcggcctgcccctcgaggtgcgcgagcgaggagcggagcgaagcggagcgacgagcgagtgtaccgagtcaatacgaaccgggccttttgcccggtagccacgctct

SEQ ID NO: 31011 - DNA, 1011 bp, Heterodera glycines
ttttgtagggctcaaccgcagatagtaatggcgttttcttcacaaaccccacatgtacaacggtgtagaaaaaagagatagccatttttctgagaatatctattcttctgagacagcaattttcaaaccgaccttttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaccccacatgtacaacggtgtagaaaaaaagagatagccatttttctgagaatatctattcttctgagaaagcaattttcaacccgacattttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaacccacatgtacaacggtgtagaaaaaaagagatagccatttttctgaaaatatctattcttctgagaaagcaattttcaacccgacattttgtagggctcaaccgcaaatagtaatgcgtttttggggaaaccccacatgtacaacggtgtagaaaaaagagatagccatttttctgagaatatctattcttctgagaaagcaattttcaaaccgaccttttgtagggctccaccgcaaatagtaatgcgttttttggggaaacccacatgtacaacggtgtagaaaaaaaaagatagccttttt

SEQ ID NO: 31012 - DNA, 733 bp, Heterodera glycines
agtgtccgtttggggtactcaaaattatggggagccttttccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaaatccaacgcagaatttaaagtacagggtatagggaa

SEQ ID NO: 31013 - DNA, 933 bp, Heterodera glycines
taggcaccgccagttggacaggtcttgcaccttctctggagccccgttaagggaaacttgaacaagcgggccaacccaagctcacggtctatacgctacacctcgcaaccccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcaaagcattggtgcgcttgagttacggtccgtaaaacgcgaattagaaccacaagttcgcgccagcacaccaaaaccccacagccgagctgagcaagtaacgtaagaacacgtacaagtacatgatcccacgaagcaacgcacaagcagtgcattttatggtaacgaccctgaaccaggcgtgccaatggatgtaactccaatggcgcaatgtgcattcgaatgttttgtgttcaaggtttctgcagttcgcactaattatcgcagttggctgcgttcttcatcgatccacgagccgagtgatccaccgataagactagaattcattcttcaacagaagtgtaaaaaaaaataatgaaaaaaaaagaaaaagctggcggtgcccgagctgacactcattgagtcttaagccacgtgctaggccaagcacgggccctaccgcgtcgtctcatcacggccacggacgtagcagcaagcacaaacacaccgctagttacggcacgtaagaccgggaacggaaccaccatccccagtcagtgtgttatgtgcctggcacaacaaccgctcaacgacgcacagacgccagcacagccgttaggtcgccccacgagcgtgcatcccacattggcgcagcgaaccag

SEQ ID NO: 31014 - DNA, 551 bp, Heterodera glycines
atcaggggctcaccaaattttgcagggatacgtatcgccattttacaaatgcttactaattttcctagattttttaaacccgttgaaaattttttgcagacaccaccattttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctcccaatttgatagaaaaagcatcagagtgcctaaactaacatgtaaataaaatttggtgcgtttcagaaccctttctgaaaaaaatatttataaattaattatgcaaaaaacaaataaataatgaactctcttccttaataattttcctgcaccgaaggtactcactcggccgcttcgcggcctcgtggtgggccttcgccg

SEQ ID NO: 31015 - DNA, 1494 bp, Heterodera glycines
gcgcgctgtgctggcaatttcggcctctgggaccagttggccgcgctgcgttgggtcaaggtgtggatagagagggtgcactacgtttttcccccgccattcccctccataacttccccgcaagaaataaatttttaaatttcgttaaaagaaaattcaataaaaaaaatttctagcgcgatttttccaaaattttaagatgaattactagtacttacaattagtttttttcaaaatgacagggaaacaattctcgcgtgggtagtatttattgtttgcccgagaatttcggtctcgagtttcgacaactcgggaaaagtctgttttttttttgtcttgtcttgtctaggtattattgagtctcgtgtcttaaagtaaagtctcgttctcgagtctaattttcggtctcgagcagcactagtggacggtttttttttggccaattctaaacgccaaatttttgacagtgtaaaacttttcgagccccattttcttcacccaggaaaacattgccttcttcggcggtgaccccgaaaatgtgacactttttggccaaagtgcgggcgccgcgtgcattgacttgctgagcctgtcgcctctggccaagggtgtgtatgtacaatatttgtcataaaatttttaaaaataaaaattttttgagttttccttttcaggccttttcaaacgtatcattctgatgggcggaaacgcgtgcaccgattggtcaatgacgacgccggaacgcactcaacaggcggcgatcagaatggcacggaaagggggatggaagggtcggattttaaaggccaataaaattttaaatttattaaaaatttgtttttccattttcccggctttacagttaaattttattttttttaaaaaaaaaaacttaaaaaaaaaagaaaaagtaaaaaaacaccctctaaattcttagttttccagtgaaaaattgtaaaaaaaaaaattagaaaaaacttactttttgaagaaattttaattttttacaatagaaaaacattcattactaaaagatttcgacatttttttaaaatttctaccaataattatcgatttaaacaaaaatacacaccaaaaatgaatgccattttataccccacactctgattgattgaacactcaggtgccgacactgatctggactcattgctcacatttatgcgctcagttcccgcctacaaaatttcggcaccgctcatcggcaaatcggcgttcaaccggcacaaaaaagtgtgcaatttacgggaaaaattaaaaaaagatttttccattgattggatttatagggactcgacttttgcccagtgatcgacggggagctgatcaccaaatcgcctgagcaaatgcggcgtgagcttgactggcccttggaagtgattgttggcggcacagagtccgaggcattgcttttcggtgaaaattctcagatttatgcaataatattcccattgtttttattttaattgtattaca

SEQ ID NO: 31016 - DNA, 1455 bp, Heterodera glycines
  misc_feature (156)..(156): n is a, c, g, or t
cagcagtttccctgcaaaatttgtgagcttctgatcagtctagaacgttgggtgataaaatgaaaaaaataattaaaaaaaataatgctggtgtggtaagtgtgaagaactgtgttcctccaggcaaaaaattctaagaaaatttataagcattgnaagagttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcatctgatcagtctagaacgttgggtgataaatgaaaaaaataattaaaaaaaaataatacttgtgtggtattaattcataaatattttttttcagaaaatgctctgaaacgcaccaaattttatttacatgttagtttaggcactctgatgctttttctatcaaaaagggagatgaataaattttaaaaaatttttaattcctttttaaacaggccaaaaagtttaggcttaacttttttttcagaaactgatcagaagcgcaccaaacttagcagggatactgaaaggaagagaaataacctattttaaatattatctagtcagttcatttaaataatttttatccaaaaaaaatttttttttggatttcggggcagtaccctgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcacaaaattttatttacaacttaattttagcactctgatgctttttctatcaaaaagggagatgaataaatttaaaaaaatttttaattcctttttaaacaggccaaaaattttaagcttgtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttct

SEQ ID NO: 31017 - DNA, 1021 bp, Heterodera glycines
aaattacattaataattttattgttgtgctgttacgtcctttttttacatccatttgtcctccttgtcgtccatctgtcctttttgtcgcttagttgtcctctttgtcgcctatttgtcccatttgtcgcttagttgtcctctttgtcgcctatttgtcccatttgtcgcctgtttctcctaccatttgaaaaaccaatatttttcgttccggcacttgtgcaaaaaacatttggccaatttccatcgacaaacgcagcaaaaaaacaaaaaacaaatttaacaaattccaaataaataatttcttgtaaacaaattcctcttccaccatctcttccttttccgccgctttcttttccccctttttcatttcctttggcaaaaagtgccattaattaaaaaataaataaaatgaaaacaacaaaaatgatgggatggcaccaattcaaaaagcaaaacaaacggcactgagttcggcagttcaaaggatggaaaaaacgccaactgaccaaaattaacaaacagtggacgaacaacaatgaagccgccgcacctgtgctgctccgtattcattaagctccacataacttcttgattattatttcaatttctcgggctgttgtttctgctttacttttcgcattttctcgaactgcttcaattcttcggagttctgcttcaaccaactcctccgagtactgttttaactcctcagaatactgctccgatttttcggggttctataactctcagacggctttgcaattatttgtactgcttcatttcctctaagtactgcttcagctcctcagagtatggctcacaatcagcatttcctgaactgcttcaactccttgacgagtgttgctgtttgatcggcttcccattttctgctgtttgtccccaattttctcatgttctatttttctcccattcggtaaccttttcacttgtttcattttcaccactaattttggcatttttgagacttctcaccggggtggggcaaagaaaattaatga

SEQ ID NO: 31018 - DNA, 1436 bp, Heterodera glycines
  misc_feature (55)..(55): n is a, c, g, or t
  misc_feature (1427)..(1427): n is a, c, g, or t
gggggggggggggcctgggatttcaaaaatagattttaagggggtatattttttntttttagaaattccggattaggcggtgtgtttttgattaattagattaataaaaatatatttttttaaattttaataaaaaaatctttatatttatattagagtagagcgggacccggggaattttgggcaaaaccgggaccgggacttttcaggttggaaaaccgggaaaaacccaagacttttccctgtcccggtcaaaaccggaacttaagtactcatttgtacgttattttcagtaccaggtccaggtccagctctactctaatttatatgtttaaataaatatttacttattacaaaaaccattgtttgctaaaaaaaattttcgtttaatttttttttcattggatttggtataatccataaacaaacttcgaaataaaatgaaaaccatttaagatttaaaaaaaaatgaaaggatgtacaatatttgtgatgaaaaatacttaaaaatgttacagtcaaataaatgatcgcttataatttaagttcgaagacaaaacgccaatcaggtttacaccattttgattttttcttagatcacggtcaatatggacgatcaaaaaatggagcagcagcattgcgcgtcacatgattaatgaggctaaatgaagggattcattaacataattaaatttgaaaaataaatgaattattcccaaaaatgtagagaaattatactgaaatataataaaacaaataaaaaatcactttaaaatataataaaacaaataaaattcacttttgaacggggataataattaataataacttttccattctttaaatttagaatttgtcaaaatttattatttactattatttttctaaagaattttacaaatataaataatgaaatgatttctttgaatttacaataaaaaatattttaaattgttttgtaatctattttcgtcataatttgctcaaatatgattaaatattcatttcattgaatatatcttaatttaatgcaaaatttcaattaaaaaaaatagttaaaatttttttaaaaagtaatttccagacaaaaatagtagagaagttttaggtttcggaaaattacaaatttttctgaactgtttcgagtatggaaaaagttagcaattatatcatctttgcagaagaacaagattgcgtgaatatcaggcacatccaactacgtcggtcaatctcttgcatctttagaattattcctcaagagttttgatgataccaaaaggtcataattcgctcatttattttaaaaaaaagttggaagtgccaaatttgctcaattttagagttttaaaccgatgcaaaacaggttttttggcatttccgcaactggacacggaagaatgttttcgtgtttacaaattaactccccngagacgaat

SEQ ID NO: 31019 - DNA, 1479 bp, Heterodera glycines
acgagtacagcccgggcactccacgaagatactgcatttgaggggaattgaactgataaacgccgagcacttcttccactgttaacacaccggatggaactgtaaaatttcaaaatttattattcttaggcatcagtttttttcggccaatttcacataaatttgaaaaatttctgaccctccttgtccatgtatgaaattcaagcattaaaggtaaaataccttatcgaccaaaacaatttctatttaatttccgatttcaaaatttttaccgacgcattttgcaaaatcctcctcatggatatttggaaaacgaattttgaacagtgccggtccaagtactgaacgacgatttcccgaggagcattcaatgccattctgacgacatttttcatcggcccaacggagtgcctaaatagaaaaaaatatcgaaattaaaaaatgaaaataaaaaattaaattgaaattacagatttccaaatttcaaattcatcgctgagtaacaaacgatcactctcgagaagattgcacaatattttctgatcaatttgcaaaaattcatctgatccgaacaagtcagccgcattttgacaaatgtaacgcaaacatttgatggaaaaatccttaaaatgcttacacttggatcatgaatctcacacaatttcgacaagtttcgaactcaacgaacccgaattcgaacaaaagcattattaataagggttgtaaattatatggattaacatattttttctgcgcatatactatgaagaaaggggcttaaaaatagcatttctgcgttaaaattttttgatttggtgaaggtttttagtccatataaatccatattttgggggttttcgggaataaatccatatttcgccatttttgggtttttagtccatattttggccattttttggaaattttcacaagaaaaatgaaaaaaaaacgaaaaatacacccctaaagatcaactttttggaaatttttaaaaattacaccccacaaaacacgaaaaatttgagttttcgtcgtcattttggcattttcaataaatattttcgtcatttttttgcgaacatttctttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatttttggcctttttagtccatattttgggcttttttagtccatatttaatgtccatatttcgcgttttttagtccatataatttacaaccctaattataaaaataaatttgtttttctcactcccagtcgaaaaggagagcctgggcatacgcaaagaaaacattgcg

SEQ ID NO: 31020 - DNA, 1494 bp, Heterodera glycines
ctgattttggacataggcgtaatgtctgaacacttgccaatatttggcacacaaaaataaggtgtttgattttaaaaataatttaaaaaaattaggggggggggtataaaaaatagaaatattcatttcaacattttagatatcatagtgataattaaaaaataaattggttctaaagactcaaaatatcatctattacctatcttaaagctatggaatctgaaattgtaagaaattacaaaattttgataagaattcactgaaaaatcataatgaaaatactgagagaattaattattttaaaattactaaaagctcggccttaatcaaaatcccatttctcaatcccgactatttctaaatattggtctaccagtgacagaacaaaataggtgctcgatcgtttcgtaaaagtgccgctagacatttcatcaaaatgccaattttgtgatatctttgcaaaaaagcatactaattaaataatttattttatcgacagaaaataagatttaattttcaaaaaattcgaattgaacccgcatgcaaatactattggttactcatgttaaaacaggaatttttgtccgtggccttgtcaggatccacatcagaatcaggatatgatccgatccaggtaaatttgatcaggataaccctgaccctgattattatttttcacaattttttttggcattacttaaaataaattatgttaaaaaacaataattcaaattattaatagcacatgagcagaaacaaagcaaattcattcaaaattaaacaaaatatttcaccctttgaacatttaaacgaacattttaatttagggtttcgacaaaatatgcataattttgcttaaaaataacaaaatttcatattcttcggaagatagcccaggtttttctctattagactgcaaaaaaatgccagtgattagagctcggaggcatcgggatcaagtagggattttcctgagatctggtcccaatcacgtcttttttaaacggatcaggatgccgaccaaataatatatttaaacaataaaaattaaattatttaatttcaaagtaaaatttacttttttttaactttggcccatcaaaaaattttgtgtaaatttggtcgaagagcaatcctaatttaatcatttacttttcattaattataatttaagcgattaaaattgactgccatttctttatagagcgaaatgaattttaaaaatttcattgaaacattgtccgacatataaacggaaaaatgaacacataacgagatgaacaacattaatgggcaaactaaaaggagaaaatgagcaaaaacaaagctaattaattaaatatcacattaattaaccaaagaaatttaaaattaataatgtttaatttaaattgaaatataaaaaaacaaatagaaaaaaaattagagtcaaaattaaattatttttatagggagaataaagttataataaataaacaattaaattatcttaaa

SEQ ID NO: 31021 - DNA, 1009 bp, Heterodera glycines
cgtgctcacgttcaaagaacgctgctttcgtccagattcctttctttttcgggaaatgtgttcagcgtaaaatgagaatacggcacgtgcacattgcagtgccccctgggtgataaaccattctccgtcttccatccacgtgtgctttctgtcttcgtcctccacaccaaccgcaagcacattttggcttaagagaataaaaagctaatgcttctgaagacaattggatttcgttaattacatgattgctttgctggtcagaggacaatccgcccgttcacattcgacggcgtcttcaagccattgttttttgttgatttcgacttgcgccgagcgcagtgaaataagcgcacgatcaatcaaaagtggcacacgctttgcttgacctcgagtctcttccaacctggcagctgcgatccaaatcattcgttcggtaggaatattttcacgtgctttgttcaaaacctaaagcttactttatgtttgatcattacaataaagaaactttttgagcattttcgtaggtttcaagttttgccaatgccagccaaagttccgtgctcaatgggcagcattcgaccgcccgcgtgagcagtgatcgggcatcttccggcccttgtaggtcaacggcggccttccataatcgaaccgaacttgggttgttttctagtgctttgagcaacacaatcttccgccctttaagatcggcctccaaatcagcagcttttaaccaaattttaacagaatggggcaaagcccgtacagcattcgcaactgaattcaaaaagaatatttttaaattgtttaccgtaatttatagtaccaatgttttttcccacgttgggaggatgaagacgaatcgcttccagccaaaggtcttctgacttttcaatcttctcaagcccctccatgaccaagtttctggccgcctgcaattttccgctagcttcttccagccgtgctgatgcaatccatcctattttataagtttattatattaatgccacct

SEQ ID NO: 31022 - DNA, 1786 bp, Heterodera glycines
  misc_feature (19)..(20): n is a, c, g, or t
  misc_feature (26)..(26): n is a, c, g, or t
gaaaagttcgtatacctcnnggattngatcagcagccttaactgagctttggtcttaaatttacatcacaattcgagatgattgctcactttagcagctgtcttgccagaaaagcccaaaaattgtgcaattttttggcattgtccctcggttattccgtcaaagactgaaattctttcctgaaattaaaaatcaaattcgaagaggaaaggattgtttctgttattattagcccactttgagtattaagacgggctgtgtagcagcaacttcttcaatgtccacgccacccaaaggacacgcaacgaccacctgaaaagagagagagagaatttgaataaattcaaaaacgaatgacaggtccggccgaagtggggtccatcagaacagaaaggtaagtctctcgtctgatcgtaattgattctgcaaccataacctgagcaaagaaaatcagtaacgaaacaaagacaaatcgaggaaaacgaatgaatgccttttttacgaccactccctcgtctcccgtctgttttgtgacgagtcttttcccgagcattccttcagtataacttttcgctttttccacgctgaaatttggctttttaaatcaacaaaaattgacatgcaaactcacgatttggtgattcgaattccccctccgttctttggacagccgataaaatgcccttttccccttcctccggccaaaatttgagctttaacgacgtattcagcatatgctaaaaatgaatattgtcgaaaaaagagtcgaaaatgaaccggtattttggaattggttgtccgtttgtttttcgttctgttcaattaggaaaaagttttgtacggtgcatccgtttttacgtaacaggcttttgctttggtattcttgcaaattcaaatttctgatttgagtcgctctgcacaatctattcaggccacaaattgaagttgttgcgagtgaagtggatgatcggcccagaaaattcatttttatcttgtggtatgaattgaagcaaaattagatagaaatgaacaagtgaaaaataaatatgtaggttaaggaagaaaatgaaaaggaatcgcggatggaaaacataattagttcgcgatcgcggaaaaaaacgctgcggatcgcggtcgcgtcccaccccggtagaggtagtataatttatttattaattttgcttacctattcaaaatatttttattttcgtggctattttagccgttgcccaattaaatttttgtaagcttaattgactctgttgctactgatgattgacatgttcaatttgtcatatgcttcccattcctcccaaattatgttcgtcattgtgataaactattttaaaatttattaaataattattaaacgtcttaaagatgactgtttcgttaataagcactcggaattttgcgctttcttctgttgtattcatttattttgccgctcttttgaccatttacctgcgttttcccgaattgaggccgtaagtttaaaattggatacttgtacagtttagaccacataattttttttaatgataaaaacatgttttagaggggtattcggggtcgctggtcacgaatataacatccatttcgatcaattttgaaccccggacccggattcgataaaaatttttgaaagttattttttcaccaaaatccacctttattgtccaaaatcgattcaaaacaatcccgggtttttatacaataactttttccatgttcgaacaaaccctatctttttggaatcattctaaagcacggtaatactaccgat

SEQ ID NO: 31023 - DNA, 1240 bp, Heterodera glycines
  misc_feature (1229)..(1229): n is a, c, g, or t
ttctcgacataattatggtgtcatccatgccttttcaattgacccatttgacaccgaattattgttgcgattgttttaaaagcggaaaatggcacggcaaaagttggcacaattgttccgaattcgtttgttcagcagcaaatacaccacgggagggcaaccttttgcaaaaattatttttattttttaaaataaatatgctaaccactcgtaaaaacccatgcgtaagtgccaacgatgatgtaaattttgctgattctgacaaattgcattgagacataaattacgcaggcaattgaattgaacaaacttatgataatcacttggataaaaatctgaatatttatactagagcagccctaattcaatcaccccctgaaaaagacctcaaaaacgaaaaaaagtgtgatcaaaatgcatccgttcacaatgtttgttctttcttcaagtgggattttgtccgcattaaatccctcacagccgtacaatttgtcaaattcgtcatgacgaaacagcaacaattccatcgggatgaattttttttatttattaaaaaataaaaaattattatttttttagggaacataaaaattatgaatcataataatttttttgtttaagaaaaagaaatatcatattttggagtaacagttgttacacaacagcaaatatcgtgacaaaaacgcgtgttacatacccaattaaaaggacacaaattttaatggcaaaaaaaagtgaatgaagcgcgagaaaataatttaaagcagacatgaagaaagtggtaaaacttttaattcattaaacagaattatcatataaaaattgaaataacaattataaaaaatatctcgaatttttaaaaatttaaaaagtcaatgcggttcttaatttattaaaaaaaatccgcgtaaaagtaagaatatgcaaataaatttttccaacgaaaaataaaaattgccaatattggaaaaattgggaatttttccgttttatttccattaaaatcggcaaaaatctggaagcgagtatttactgctgatttgttcatctttgctgttgcacatggttttgttattgtttctgtttttggcattgttcctcaaaaagcgaaaaatggcatggcaatagttggcacaatcgttccgatctcaacaatccatgcaactgttaattgccagcaacatttcgtcacttgtttaaggaaaccacaaagctttaattttcaaaantaataaataaa

SEQ ID NO: 31024 - DNA, 1195 bp, Heterodera glycines
  misc_feature (58)..(58): n is a, c, g, or t
  misc_feature (65)..(65): n is a, c, g, or t
  misc_feature (171)..(171): n is a, c, g, or t
aaattaaaaaaatgattctttaataaaatcattagaaaaaaactaaaattaaaaaaanaattctnttcttaattcattgaattattttacttttttattttttgtaaaatcatctgcaataaaatttcttaaatatttattcaaaaaaaaaaaaaatacataacacatatntaaatagaaactacgaaacaattatataaattatcaataattaagaaataaaaaataataattcggataagcttgcttaatcgtttaattaaccacctgctgttgttgttgatattgttgctgctgctgttgatgccattgccgatgaagatcaaaattgttttctgacttttgctctaaaagttgttgctgttgttgtccatcatcataattctaaaataaaattattttatctaatcaaaaatcgatttttaattgctttattagcaatttcaattttttttaaatgaaattccattttatttttatataaattttgtctttcaagccatattttaattacaatatacagaacaaaactggatactgtctgtacgaatgttaaatttttttggttttaaaatttcaaattcgatttttctcaatcgaaaagagttatttttattttacaaaattttgatcactttttatacccaatgggatcgctgaggaaatagaggtgattgttgtatttgttgctgttgttgataatttggcataaattgtcccattgcaatgtttgccgaattaattaccattgctaaaaggcccattaagcggcagtgcttctgtttctgttggcacatcagacgaataatgatgaagaataatgaataatttaattaattattattattattattgaggtaattttgaaatttatttaaagccaacttttgctggaaaaaagtgaaaattatttattttaaatattttgcaaaattaagcaaattggttgaatttgttgatgaaaaatagaattgatttaactccagtaactaaaattgtgaaagtaaataataaatttaaatttattttaaaattcataaaatataaataaatttaaaaattatttgttttaatatttaaaaaatttctttaaaaaatagagattaagttctggaattaaaaataaaaaaatagaaaaaaatttaatttatcgcctcattaaggcatgcccaataatgtcattcgatttagacaa

SEQ ID NO: 31025 - DNA, 203 bp, Heterodera glycines
ctgaaattgctcaaattgctgaaattgctcaaattgctcaaattgctgaaattggctatataaagaggcgattttgttcagtctgctcagttagtcacgtacagatggaaagcctggagttccggcggaggctgtgcgtgcgcctttcctctcttttgcagaggggataggtacctctagagacagggtctgtctttagaggt

SEQ ID NO: 31026 - DNA, 1533 bp, Heterodera glycines
tggatctgaacccatggcccaaaaaaaccatttgctcccatctatgatcccgaattccaaaatcagtttatttttgtactttttttcaaaagttttataaaatatagaataaacagaagcttatagaggaagaatttcgtgtttttcaaaaaaccttttcagaacagcgctattaattttttttctcaaaaacgaatttttccaaatttatgtaataacttcttcagtttgaagatagaaaattctaaaaaagtataaaatgctccagatttttctctatttttaatgcttttttgcactttaattgattcatttagaagtgaattgaattttcaaacattcgcctaaatttcgaagggggcaaaaaatgaaaaatcttttcaattcaaaaatttcagattaagatttaaattgtaccattatgcaaaaagcaaaaaattttgagaatttataagggaaaggggttgaacaataaaagcccccccccctcgaatataagccccctttggaggggggttgaacaatagaagccccggggcttataatcgaagaaatacggtaactaaatcctattctatccttccttgccaaatatgcgaaaatggatgtcagaatcgggttttagaaaaatattgaaaacaaagccaacggctttttctctggaaaaaaatgtgggtgagattttcgttttgatgctctttaaaaacccaaattattaagtgattgccaaacattatgccaatttataaaaattaagcatgaaatttaacaaattctgacgattttccccaaaagcctcaaaaatcatcaaaatttctcaaaaaaccacaaaaagcctcaaagcctcttttgaaaatatatgcaaaaatggagaaaaaaataaatcaaaaaccgggatgtcggagattccccggcttggccggtcccgatactggtctttccagctctaatctattttcttgaaaatttctaactcccattcctttatggtattataatagtgaattttttttgaaaatcttcttattctaaaacaggaaaaagagccaaattataatatgcggacatggaaatgagctcagacaaaccgaaccaaaaagtaagaaaaaatagaaattataaatttaatattgtatcttatacatattaaatagaataggaaaatttaaaaatggcagagaataaatccagttagtttttattcgtttttttgtcaacgccaataaattaacggcaaaattatgacgccataaaagaggtgaaaacggcaaaattataaacagaataatatttgattaataaactgaataaatttgaatttaaaaaacggcaaaattatgacctaaaaaagaacaaatggaataaaatttataatttgaaaaacggcaaaattatgaccccagaaaggagatgaacaaatggcatcaaatttgaatttaaaatataccagaacaaatcttttttataaataaattctttatcccatggttttgtttaatgtagaacttctaaaacatttatttctccattttg

SEQ ID NO: 31027 - DNA, 1152 bp, Heterodera glycines
ccgatattcaggttatttatttttaactaaaatttattattttttttttattaaactcaatgtgattgaaccaaattgtctaaaatgaagtcgctgattattcctttgcacacggagcgtaatgcaagaagataatcgcaataatgaccaatttcttccttgattatcgcaacactttcattccgcaacagctcaacgacactcataattccatggcacaaaagacaactcacggatccattcaacgagctaacatcattcggcgtatttagggaagtctgcaatcccgcatatagtgaggggcaagcaccatcaacaattaatttgccattgcgaaactcaatcagacatgctggctgtcccactggggctgggtgacaagtcttagtccaggcgagatggggatcaaaagctgaacaggcgattgcgcatgactcaaattttgaatcgaaggacatttggtaaaacagtaatttggtgattttgggcatttcggtaatcgaagaacgcaatgcatgagccattagttgattggggaggtgtaaacccgtttgatgtttcaaaagacaaaatgacaaaaatgcccaataagaataacatagtggtgttgaatggtgacaaaaacgctcagctatttataccccaaaaatgtacttttatcgcgtgacaacttaggtggcaatcattcactcaaacgcagtctactaattgaattgggaaattaaacagtcgaaacgagaattgagttttttcgtgagagaaattgaacaattttcatatgaaaagacacaagaagaattattaaaaactttaaaattaaattttccatacttaaagcgtcttggcgcataaaaaaaatatggaccataaaaatggaatgggacgcataaaaattcattctttgggacgcataaaaggtcacgggacgcataaagcggaacagaaccaaaaaatttcaaaagggagctccttttaaatagcgcctacgattctgagttcaattcgtgaaaattaaaaagtaaaagcaaaattttctttatttcataaaatttgtctaatgacattttacgcgtcccataacaaaaaataaaggaaaaaaaaattgaaatagaaaacttaaaaaaataagatagaatcttctttttataattt

SEQ ID NO: 31028 - DNA, 1392 bp, Heterodera glycines
  misc_feature (1371)..(1371): n is a, c, g, or t
ttccccaatgtttttattttattataaactttccttgttcttaaactttaaaatataaataatttaatttattaaatactgaaacatttgcactaagattttttaattaaatgatttattcaaataaaaaattattcaaaataaaaacgtattttcaattttttagaaaaaataaatctaaaacaaaatctgacactttaatggcccaaaattaggtggtcatgatatcttgcatatgatctgccgtatgcattcctttttttctttaatatagatttttagagttttttttagcagatataaatcaaatccgtgttaattacttattaaattttaaacaattttgaataatagttaaatagtattttaattttatctaatttaaattatttaattaattctccgtgtgtcctggcttttaacattttttatcatgttatattgttttcggcttttgtgttgatatttaaattgcatagtttaaaataattcattttttctcatgtttcctttaacacgtcgggtagttttcttcttccgcattatctcatacattaatttgtatttttttttgttgttatatcataattttaataatattaattatttatttatttttattataaaattaagatataatataattatagaaaatcttgtaaatttgattcagatttttatttcattagatatttgtgttatagagcacgctagttattaaatttttagtatgcttttatttatttaaatataattttatttattaagaaatatgtaaattttcatttttatgcaatatataaataatgtctttctgaatttacttatgtgttaatgaattatttttctctttgatttcgagataaaactgtaattttaatcagattgttgctaattatatatttttttaatttcttgttttacattttaaaaaattacttttttaatgtgatgattattgcataaaaacccataacataatacaacaaataattaaaagattacaaattgaaaggtttttccaaaaagattatgataataaatttaaaattaattttaaaaaaaagtaaataatttatatcaaagaaattaaagtaacattattaatgtcgaaaattaaaggcacttatgagagttaaaaccgaataaagaataacaacttatttcatcgaaaagaaatcagttacttaagtgtatgttatacaagaaaataataaaaataaaaattaataaatccatttttaaattaaattatctgacgaaaaactcaaaataaatgtttaaaataattgcagaattaaagaattaaataatattttaacatttcttttaaatacctttaattactaatataatagtgctaaagcccgntgacaataatataaatacaat

SEQ ID NO: 31029 - DNA, 1050 bp, Heterodera glycines
ccttttcaagaattctgctctgatgcgttggatgagcccggaggagcccaatggcctaattttgcattatattgtgcagattgaccctcaaaatcctgaagatgatgagttggatgatcagcgacggccatggactgagaaaattgtggtgggcaattccgaagcaaatgccaaagaaagtgccgaacattctgtcggagggcatttggaggagaaagtgttggagggattggccggcgggcgccgttaccgcgtggaagtttggccggtcaacgaagcgggccaaggccggggcagcgggctggtccaattggacacgccaatttcgggtaatcgacggcattttcgcaagtcatgtccattttttttgttgccatcctccttcttccagcgccgcctcggcccgatcagctgagtgtcgaagtgctgcccgactccatccgggcccagcagctgcgcgtgcgcatcgacacggcacggcttagtgaacggaacggacgactgaccaaaatggcattgatcgtagcggagacggacgaaaacggcgaattggaggaaaagggacagacggagaaagtggcagaaaatggcggcggaagtgcaaacgcaacggtacgggttcaaccgagttattacacgcaaagtcataaaaaagcacttcctgcaggtgccctctcccacttgggcgatcgcccggcgtttgccgggcctttggccgcctttcgttgcgctcgaaatattggccgcaggccatgacaatcaacgcattgataaaaatgggggacgatttggacaaaaaatattgacggtgacgctgggcgacgaggagcggtgtgaagagagaccggcaaatgcaatttgcaatgggcggttgaaagtcagtggggggggggggggggattcattctttccttgccggagattacgcgcttttattttggcttttgaccacatgcctccgttccgccggcgtgtccaggcgacgagctgctgtacccgccgactaacaaatgtccctctggacgatgcttctatggcgaccataacggc

SEQ ID NO: 31030 - DNA, 1053 bp, Heterodera glycines
  misc_feature (40)..(40): n is a, c, g, or t
gaaaaaatattttgaagcaatttttattcgatgatttatntacagccaaagtgaatcgcattccatcggcagaaaaaagttcaattgcatcaaaaagcgtaagaaaattgccagtatttttgacatctgaaatgcgtgataaatgagaaagttgcatttatgaatttgtatattttaaagttgccttttcattgttcaacaacaaatgtccatttgcacgaattccctgcggccaaaactgcggctgtttacgccaaattgccacgtggttgaaaatgtaataagtgagatgattttggatcaaatctttgccggaaaccccttcaaataaaagtgccattaaaagaaagtgccgatgaataaataaaaactcactcatatcgacggggtaccaatactcaaactcgtgcctcattctcttcagttttgcttcttcaattggcattttagtcgaatcatatggaataccttcaaaaatacattaaatcgaattaaataataaaaaacaaacaaattacccatgaatatgtaatcccaaacagcgtcagtcagttgaggtggtaaaatgccgagttcacccgtttcagcaccgtaaatatcattttgcagcaaatgcgaaacagtgtaataagcgttgtaaatggtactgtcggaaagcgactcgatcaaatattgtgggtcccatggaagtttagtgcctaagaaaccgaaaaaatataatagaaattgtgaataattggcgttaattgttttaccaagtccaaacgagcgagaacaagcgtattcatgcagccattcgatggtgtgctcaaagttgcgccgcacttcatccgaaaaagtgttaagcgaagccaaacatttgcgagtcgcttctttccatgccgggtccccgtagttaaggtacctacaacaaccagtacaattcttagttaaaaatgaatcaagactaagtttgccatttccactgaccattggtcgcacaatgccaccacacattcgtcgcccgaccgagagatcactttcttctcaggttcgacatatttgcacgcctgc

SEQ ID NO: 31031 - DNA, 1274 bp, Heterodera glycines
tcttcagggtcgggtcccccccccccgaaaaatgtttctagatacgcccctaggttgaatcacaaaaataaacagtgaaccgagaaaaatcgatgatcacaaatctaagtaaaaattttgcacttatattctgtgacatatttcaaattgactaaaaaaaattttatttctcaatttttaggtaggattgattaactgaaaaactatcagattcggtcaaatttagctatttaaatagggaaaagcggaagccaatgtgttggcgtaaattctccgaactttctacttttcatttccgtccttttaaatgagtcaacatttatattataaataaaatttattcgaatgaaatatttggctggaatttgataatcgtcgtccttgttattattatggtgttctttgtgttactatgcttctcactgtcaacttctgtcgcttattcgtccgctttttcattgtccgattcccctgtcatcgatttcgatgttataccgcaattgtttagcagagaaccacgagtaatagttgtcgaattcgattatgtctgaagggacagacacaaaaagccaattcttccgatttctcatcgcttacatcggcccgactgctcacaaaggagggaacccgaaatgggcacttgggaacattccaatcgaatgtaactgaagaaaattggggaggcgtgggaaaagcgcatcggagggaaagaaaaaaaaggggggcaatcccgtggaaaaacggaaaaaaaggagggggaatcttacggaaaaacgcagtccatctccgtcagattgttggcattgcccgaggggtcgaagtacaccgcaaaaccgatgtcctcctcctcggtgaggtattgccaactgaatcagtcatgtttctctctctctctaaacctctcgtctctctctttctctgggctctctctgtttctctcctcactctctcccttttctctcttcgtctttctctccctctctctattctccttccctttcactctctctttccggcacttcccccccgcgttctcacccaatgcgcgtgttcgccttcactttcagctcaatcaggtgtttgtcgcccgcgtagacggtggtcaactggtcatagtcgggcattgcttgggaagggtcgacgaaaaacgagtcggggacggggccgaggccgtagcggattttggaggggcacctttagggcgacggattagcctcggattggtcgcccactcactaggaagtccgttagggtccatcatccgaccgccccaa

SEQ ID NO: 31032 - DNA, 1222 bp, Heterodera glycines
acagagacaaattgggatagaacagcacgaaatttaaacattttattgaaaaatcagattttttaaatttttatctaaaattttgtaaaataattggaagagaaaataatatgtaaagaaaaggccgacaaaataccgataaaatttagtatggtagggtctggaaaccgtttttttttaatgtcaaagcgtcagatccggcgaatttttgaccgatttttgatttagcaaagaattcttgctttttcattttcttttgaaaaatatacttttggcataatgttactaaatttttttccgtcaatttaaattttttttatttttttttatgttttatgggtatataaagacgtcgaaaagatttttgatgcataatagcgcaaaaatgaatagacggtgaggaattttttttaattacaaattttcatttacctttactatttttttacggatttcagctggatttgtagcgatgtttggatggacattctcccatcttttgaccatgctcaactcggcctcaaattggcattgctttcttatcgtttcgatgctttggtggacacgcatttcgatggaaaaagcgaattgacaatttggcgactaatcagaattcgcaaggacacatcaggaccaaaaccgaaaatttgtgtaacgctggatgaaaataacaatgatatcgatgacgatgacaattttgtggattttccgttttcggaccgtcagctgcccaacaaaaattgctttaaaagcctttggattgagtaatttgaacttttcatgtgtatattaaggcattttaatttttcttcaggtacattgaccattccatcatcacttttctccattccaagaagcgaatcttcgacagaagtggcaccaatttgtatttgagtgtggctacggatttccagccgatttggaatgcttttgtccgtcaaatttggccaatttttgcgggaagtattcgccatttgagttttgacgctggcgatcctttggacaatttgcgtcgccgcatttcaccaacatttctcaccgatctcaatcgattctggtgctctgttacccgacggtattgctgatgatgggccaaatgcaactgctggtcaggcgttatccaaatggttacacactccgacaaaaaatggtcagccgaagcgattgtatcgcaatgaatatgtgggtgcaaatctcgaatgggtcgacaacttcaaagagg

SEQ ID NO: 31033 - DNA, 1433 bp, Heterodera glycines
  misc_feature (1428)..(1428): n is a, c, g, or t
tagtactgggacgggagacgtctggggaatcgaaggtattgtaagcttttttacttttttcacttttaaatttatttagattttcaatttttttggcttttttgataaaaattttgtctattttttcggcaggcactgcctctgacaatgttttttatttatttagaaaaattaatttatttttttttttctttttgattattttaattgtatttcatcctgaaattttttaataaacattttcaaactttcaccttattaatttaaggcgaattttgccttttttaataaattctcttgtgaaaaggcaaaaaaataggcttttttaaaatatgcctatttaaatgactttaatttttttcacttttaaatttatttaaattttcaatttttttggcttttttgaaaaaaaatttgtctattttttcggcaggcactgcctctgacaatgttttttatttatttagaaaaataaatttattttttttcttttttctttttgattattttaattgtatttcatcctgaaattttttaataaacattttcaaactttcaccttattaatttaaggcgaattttgccttttttaataaattctcttgtgaaaaggcaaaaaaataggctcttttaaatatgcctatttaaatgactttaattgctgtcctttcgcttacgaccataccacgttgaaagcacgccatcccatccgatctggcaagttaagcaacgttgggccttcttagtacttggaacggagacgtcctgggaatcgaaggtgttgtaagcttttttacttttttcacttttaaatttatttaaattttcatttttttttggcttttttgaaaaaaattttgtctattttttcggcaggcactgcctctgacaatgttttttatttatttagaaaaataaatttattttttttctttttgattattttaattgtatttcatcctgaaattttttaataaacattttcaaaactttcaccttattaatttaaggcgaattttgccttttttaataaattctcttgtgaaaaggcaaaaaaataggcttttttaaaatatgcctatttaaattactttaatttttttcacttttaaatttatttaaattttcaatttttttttggcttttttgaaaaaaattttgtctattttttcggcaggcactgcctctgacaatgttttttatttatttagaaaaataaatttattttttttctttttgattattttaattgtatttcatcctgaaattttttaataaacattttcaaaactttcaccttattaatttaaggcgaattttgccttttttaataaattctcttgtgaaaaggcaaaaaaataggctcttttaaatatgcctatttaaatgactttaattgctgtcctttcgcttacgaccataccacgntgaaa

SEQ ID NO: 31034 - DNA, 831 bp, Heterodera glycines
atggtaggttaaccaaacgcaacaaacactcgcggaagctaagaacgaacgccaaattcagtaagtagcggcactcagtcgagaaacgcgggagagttggcatgcgcaatgttcatggcacagatggtggagaatgcggagttgcgtcaggaagtgcacaagttgaagacggagttggactcgctcaaggcattggtggcagcggcggcggttgtgggcacgaacaacggatttgacaacggcgcgaacggacaccaccggccgacccattgagcggcacggcactgccaacgttcggccgatgtttgacgggggggaggggtccttttttgttttatttgagttaattccaattcaaattaatttatttttatttgcttcgactttcttttgtctcctccgcaatttgtgatcgtttgccctccttcgccttctctcggattctttctctttttcttgccttccttctgctgttccattacttttttacggcaattccaccaaaaagtgcaattcgcataatttattccatatttattcacttcattttgacaagatattaattaaattatttatcaatttcacaatattttttacttatttatgtttttttctttttcgtgactttcttttataaatttgtctaatgaatgatttttcgactcagtcatttctatgagagagtctccgaactaacaaataagcacaataatcactttacttaagctaattagacatggaaggagtgcgcgagttgcgactaagtgaacttcttggatttttgttttttgactgaaattctctaataatttgttgtacttaattacctaa

SEQ ID NO: 31035 - DNA, 1001 bp, Heterodera glycines
  misc_feature (888)..(888): n is a, c, g, or t
  misc_feature (949)..(949): n is a, c, g, or t
aaaagttacttagacaatttatgtgctcccgattccttttgtaatctcatttatactccttattcttcattgtccctttgcaattatgagcacataaattggagaagtgccccaaatcggaaatattcccaaaattcaaagaatttaatttttcgggaccaccagaataaaaagttacttagacaatttatgtgctcccgattccttttgtaatctcatttatactccttattcttcattgtccctttgcaattatgagcacataaattggagaagtgccccaaatcggaaatattcccaaaattcaaagaatttaatttttcgggaccaccagaataaaaagttacttagacaatttatgtgctcccgattccttttgtaatctcatttatactccttattcttcattgtccctttgcaattatgagcacataaattggagaagtgccccaaatcggaaatattcccaaaattcaaagaatttaatttttcgggaccaccagaataaaaagttacttagacaatttatgtgctcccgattccttttgtaatctcatttatactccttattcttcattgtccctttgcaattatgagcacataaattggagaagtgccccaaatcggaaatattcccaaaattcaaagaatttaatttttcgggaccaccagaataaaaagttacttagacaatttatgtgctcccgattccttttgtaatctcatttatactccttattcttcattgtcccttttgcaattatgagcacataaattggagaagtgccccaaatcggaaatattcccaaaattcaaagaatttaatttttcgggaccaccagaataaaaagttacttagacaatttatgtgctcccgattccttttgntatctcatttatactccttattcttcattgtccctttgcaattatgagcacataaattggnagaagtgcccccaatcggaaatatttcccaaaatcaaagaattttaattttt

SEQ ID NO: 31036 - DNA, 1102 bp, Heterodera glycines
gggtccactgcgtttcggcgccagcatgtttttggctataacttttttctatctaatccaaatccaacattgttgatatcattcgaaagcttaacatgtttagaagctttcttttcgtttttaataaagctaatagagcatgttaagagctttcgaatgataccaagattgttggatttggatgccaaagaaaaaaagcttaagtggaaaaacgagctggcgccgaaacgcgtgggtcccatttattcatgtggttggaaaagagaaaaactttaaagtatgtttctaatttaatttataaataaacgggggaggattttgttaaaaggtcggtcatttaaactttagatgttgaaaaaaagagaggatttatcaaaccgatccacacacttgaggaacagatagaatacatgaacagcgaaggtttgagaggccaaacttttgcgcttttaagcttgtttgcttttcagtttttgccgaaacttacaaaggacgtccaatttgttttatgtggaaacgtaatatgaaaggccagtggaaattgcaaccgccgcctcgacttttttgcattgaccgcaatggtaaactccgaaatgactaagaattggcatttcctgtgtctgattgcatttcccatttaaaggtcgtttcaacgttggaaatgcgtgtacggtgtgtcgtgatgagtatttgttcttcgattatagagtacgttcctcacaatgaccttcaatttccactgttttttagaatcccaaattgcttgagcatttcctttaccccggcactgatcagcccctgcccataattcaaaccggactttgtcaagaacagtacgtcaatttgcaagcccaacttctcaaggccaaagagcacggtcccttttagtttaatcgttggtcttttaaccctcaaattgttaaggtacgtttattttcaacgtgcccttccgtcacttcaattatggtcaatggtatccaaaagatgcgaatgcattaataagcagtgatttgggaggaggatcaaccgagcagagacttgacaaacgtcgaagacatttatccgaatccctcaatcgcatttgaaacacacaaccgggaca

SEQ ID NO: 31037 - DNA, 1148 bp, Heterodera glycines
  misc_feature (16)..(16): n is a, c, g, or t
  misc_feature (23)..(23): n is a, c, g, or t
ttctaaaagccacaanaaagatntttgaaagcaattccccacccgatcggcgcgagaaaatgataataatttttgggctaattaattttggatgcactttttataatgctaatttttgagcaataaataatcaacaattaacggatcccgctgcgagattaattgttaaaatccaattctcaacacttccgtgacttttgcgcatatgcccaaatcggtttttaaaaaataggaaaaagcaagaattttctaaccttttttacatcagtaaatgcaaccgtgaccgaaaaatgcgtaagtgaaaaatgcgtcagtgatacaaatattctaaaataaagtctatagcattaagtattgtagtataaaaaaaaatctataagaaggtctttctgaattacgaaccacggacacgaactcgaacaagaacaaaaaacgaaactcaaattcataattagcgtttttgcttcaaaatggtttaaacactcggaaacaaactgaaagccatcaatcctgcaataagagatcattagtgccgtttttaaatcaaaaatggtaaattcgagaatttggactttcggctttttgttcgaattagggtccggggttcggaatttggccaaaacgaattccggattcgtgtttagtgagtgaccttcaaggtgctgctgaagcctagaaattttcaaaatttaaaaaaacccaatattaaatttcaatattttggtcaaatttttaaataataattgccaaaatcggaagcacaaaaaatattgccgtttttcactttggcaaatgaagaaaaaacgaaattaaaatttcgatttctaattttataaacctatttttctaccaatatttacataaagttggttgattatacaatataaaaagattaaatgaaaaattgccaaaaatattcaattaattggaaatcaaaaaaataaagtaaaaagaaacatttattctcctttttgacaaattaagaacttccaaagttttctcatctcgtctaccaccaattcatttgcacattttgaagcatggcttcggttcgtatttcatttttaattgattctaaagaaaaaaaattaagcatttaaaaaatataaattaaattatttaaattttttatttttttaatacgattt

SEQ ID NO: 31038 - DNA, 1250 bp, Heterodera glycines
  misc_feature (1147)..(1147): n is a, c, g, or t
  misc_feature (1184)..(1185): n is a, c, g, or t
aaaaaaaatttggagcgatttgaatgagaatagaaaagagccaggtttcgatgaagttttggttagccaaaaaaaattccgaacatttaaaaatctataaaaaatttaaaaatgagaattcatgcgagatttctggaaataagcttaatatggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaatttggggcgatttgaatgagaatagaaagagccaggttcgatgaagttttggtaagccaaaaaaaaatccaaacattttttataaaaaatttaaaaatgagaattcatgcgagattttctggaaataagcttaatatggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaatttggggcgatttgaatgagaatagaaagagccaggttcgatgaagttttggtaagccaaaaaaaaatccaaacattttttataaaaaatttaaaaatgagaattcatggcgagattttctgggaataagcttaaatatgggctagtaangctgtaaaaaaaatttggggcgatttgataagaatanngaagagcagttcgatgaagttttgggtagcaaaaaaaaaatccaaacatttaaaatctataaaaa

SEQ ID NO: 31039 - DNA, 2082 bp, Heterodera glycines
tcggaaatagattataccgctggtatctcgatatctgcgagtgtttttggtatttggaattgacccccggctgcatgacggactctactgacagctttctccattgacggaattaggggaaggcttgcaataacttcatttgacgcaccagcgaggcattcattcacaactgtgcgtggcatatttccacgggatgacaatgctgtgttgcggacgcttctgttgatcttagcggcttcacatcgtgttggagaaggggcatgattgtgcggctttcctagttgaacttcaactccagctctcatcccgatagtttttgctgtcccggtgcagttcattgttttgttttggtcacagcgccaataaatgaattcccttcgtgcttcttttttttggtacatatggccttcgaaaacgagtttgtagccgcccatttgtgaaggaaaaaacgtagccattatatttaatgaattttgtaaatttagttcagcttttatagcacctattcaggttattcgggcaaatccattggcaaaatttaattctaatcagttcagattagtggtttttggtcatatagaattttctcattaataggaataatgatttttggtcatatagcatttggtcatgtaacatttttctcattaagattagtgatttttggtcatatagcatttttctcagtccaatttgaataaatttagtaactggcatttctctcacagcttattttaaatcttttaatatatttgaattaattattattttgtgggtcctctgtctgtgggtcctttgagaggacaccgtgcacgtcacatagtccatttatcgattcccttttgacccgggcattcttctgtcttaagcagagcccattctctcatcagtcgttcttctcttcatttcgctttgtttgtcttcgtttaaatttcttattgataatatttatttcggcttttagttattttcttgtttagatttattcgtttcgtttttgacctgtatttccatcacaatcaactgaaaaacggcaatggatgattcggttggttttcttagcataataaatcttgcatttgggtggtcttccaccccttacgacagtaaaattagtctgttccgttcgtttacagttatcctctcgacggctcccttccgacttctccttctaaaaatttcatccaatcttctgtataatttttctatttccgtatgcttaacagctgtaaattcccaaaaatcatcctccaagtttgtgggaggggaattcaaaaattgatatggatgttgaaactgaaacacagggtagaacattttggccgacgacccaatgggaaggaaactcccagccgaacttttgttcgaaatggttctctgtgttcgaagagaacatgcccacgcgagcatttgcctctcgtcccttgtttatgcaaataatgctacctcgtgcttcattatggcggaaaatttgggtttcagtatgattttggatgtttccgctttttttttaaattttcgttgttgctgtttggacttgtctttttatttttgcactaacaattctgttattttatttttggtatttatttaaacgtttttgtctgaatgtggtgattaactcttcttccttccttttctcatttccattggtttttattggttttttttgtgcgtttccttttgtgttcggtgttcgctgtttgagcctttttgagacggtttatttgaaattcaatttaatttaggcatttttcaagctcaaagagaactatcaagacgcgatagcagctggacaagattggaactttgtgagacagacggcgcgtgatgatatcgcatgcaacaacgttatggtggctctggacagactgatggatgtgccgcaagtacgtacggtttgagggaattactcacatcaacttgaatttctaagaaagcgacactgaaaatggagattttatgttttcatatttaacacttttccttaacaggcacccgacaagaaggcaatttgtgtgctcgcaaacaaccgggcagactcaaaagagggtgtgggaaccgtcatgtttcagcaggcaa

SEQ ID NO: 31040 - DNA, 1120 bp, Heterodera glycines
aaaaaaaaaaatggattttttcaaggtgtcgtttggggttctcaaacaaatttggggagcaaaaaattccacgccggattaaagtacaggtatagggaggttttccgaaggattgggtttccccataaatcgggggcatcggctcggggggactgccccgaaacaaaaaaatcgatttttcaagtgtccgttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttatgctcaattagcaaaaaatatgagtgatcgaattttcact

SEQ ID NO: 31041 - DNA, 1436 bp, Heterodera glycines
gcgcatcggctcggggggactgccccgaaaacaaaaaaatcgattttttcaagtgtccgtttggggtactcaagcaattatggggagcaaaaatccaacgcagaattaaagtacaggctatagggaagctattcccgaaggattcggtctccccataaatctgggcgcatcggttcagggggactgccccgaaaacccaaaaaaaaatttttttggataaaaattatttaaatgaactgactagataatatttaaaataggttattactcttcctttcagtatccctgcaaagtttggtgcgcttctgatcagtttctgaaaaaaaagttaagcctaaactttttggcctgtttaaaaaggaattaaaaattttattcatctccctttttgatagaaaaagcatcagagtgcctaaactaacctgtaaataaagttttgtgtgtttcagagcactttctgaaaaaatacttatgaattaattttgcaaaaaataaataattaatgaaaaagtcagaatttcgaaaaattttaaaaacaacaagcgttggcattttttcaggttaagttagtcctttacaatggagaaggcctgcaaaatttggagagattatatcgatgttagtgcgctaggttcgatgaaactttttaaaatataagcctaaactttttggcctgtttaaaaaggaattaaaaatttttaaaaattttattcatctcccttttgatagaaaaagcatcagagagccttatttaactttaaattaacatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaagttaagcctaaaatttttcgcatatttaaaaagcaattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaaaagttaagcctaaagtttttcgctcgtttaaaaagcaattaaaaatttttagatttttattcatctccctttatgatagtgaaagcatctgagtgcctaaactaacctgtaaaaagagttttgtgtgtttcagagcacgttctaaaaaatattt

SEQ ID NO: 31042 - DNA, 1224 bp, Heterodera glycines
ttgattgaaattaatgagtttaaccagggttgccagatttatttttcaaacgcctcatttggtcggcaaaaaagcctcattttgggtcaaaaagcctcatttttacaaatttattcaaaacacattaaaaatgttcaaatattatatttttattttccatgatcaatttgagcaattttttgttagaaataagcatttggtgaaattcttagcacgaaaatcgaagttgattttttgcggcgcttttttctaaaaaaaacttggggaaaagggaggccggcggtgccgataggcgccgccgggaaaaattttgtgatttttaatacaatttgttaacagatttgaccacaaaaatgaccaaattttgcgattttgagcaaatttttaagaaaataaaggatccctggagctcaaataaatgaattgaaatagaaaacccggcaaaaacccaaaaacccggcaacttcaaaaacccggcaacttcaaaaacccggcaaggacccccaaaacccggcaaatgccgggtttccagggcaaaatcgcacccctgactttcaaggacgttttcaaattcaagaacgtccttgaaattttttgatccgtttttctcctttggctttaatagcccaatcaaatgtatatctattggacaaaagaaaacagaaaaaaattcatttaagaactcaattacctgtgtgccttggtcgcctttgggacctaaaataaaaaatatttttaaataaattaattcttaaatagttgacaaattatgattgcagatagaaagtgccaattctttaaatgattttacaattggcaattgacatagcgaatgaatgacaaacaaatgaaaatatatcccgataaaaataaaaaaaattcgaagaatttttgcgaaattgaaattaagcattgacaaatgagaaaaatatttaaataatacacaatatatacaacatgaatcttttgacaatttcattttttcgtaattttcataaaaaattgtttgatctaaaaaaccttttcccatatttaaacattgttttatttgttattttttaaatttatttaattgtaattagtcgcataaactttttgagtcaaaaattttttcaaaaaacgcacacatttaaaaaaaaaaattcattttttatttccgatgggcagctgagttccccacaccccctgaaattatttagcccaatattttaattgccataatta

SEQ ID NO: 31043 - DNA, 1004 bp, Heterodera glycines
aggtcgaacaaaaagactaaaattcaatttttttttatttttaaactttggtttctattcaaatttagtttagggattgtaatagaagatgaccagcgacaccaaaaacctttcgggaatagggtaaattgaaatgctaatattaatttgtggattaatttagctttttctataaagtaactctacataaaagacaaagattcgatttgaattgtagagtttttatttttattttttattaatagaatttaatacatttattaatctcccttaaaattataatattttacaattaaataaaattttatacacaaaatgttaatggattttatgcaacctttttttgaaatgctattaataaataaattgataaaaacacattaataatctttttttataaaaatgaatttaataatttgacttacactttaataaattattaaataggtaatttgattaattacaaattatataaattattaatatatgaaaatccactattatatttaaaaactattatttttttcaaaacctttcatgagtagtcagaagaataacgagaaagttttatagtccaatcatctaataaaataacaataatatttattaaatatcaattacttatatcgttcattctttacactatattatgtggttggtcaatcaatctgtatattttatattttatttgataataatttttgaaaatattattattattttataaatcttttaaaaatgtaaaatcttttattaatttaattttgattttgtttttgaaataagataataatgttaagttcatttaaatttttattatttattaaattattagtattttaatttaaaattgaaaatttatgaattatatgttttataaagaaattggatgcttttatttttaaaaagagctgcttcgtgcttatatcgatattttatttaataattatgattttttaatacttttagaataattaatagggatgcgatttttagttaaatac

SEQ ID NO: 31044 - DNA, 1135 bp, Heterodera glycines
ggaattttcttttattaaaatttatgtgtaaaaggaattgtaaaagaaataataaaatttacaaaaaaaatccactaaaaaaatatttgggtttcagactaatggattcccaactcaaatttataaaaaaaaaatgcgagaaaattttgccatttaagaagtttacatattttataatataatttgatgacagaaaaatatttttccaataaaggattagtttctttcattcctacataaaaatgggggggggggggtaaaaatttggtaaattttaactccgttaatatttgaaaatacaaaaatttcttactgcgatcggagcccaaatgattgtgaacaggtagccccgccaatgctcatatgagcggacaaacacagttgccaaaatgcgttcaacaatcaaaatgtgtggcacaacattgcgactgtaaacgccgacgaaatacaaattggcaattgccggaaaaaagtgcatcttctcggcaccaattgggtcccaaaggatgaatttgaacagacaaattatgaagcgacaaattccccgctgtaaatagaatttttggctctatggtcaaagtggtgattttgaaatttgttaaagaacaaaaaattctaattcctaacctgactcgaacaaaagtcgaaaattcaaacttttcgatttatttcttttaaatttagcttaggaactcgggattttgttaaaatagatgtcagattggtgatcagtgaccccaaaaactaaatatcggacaaaattataagtaaattccaaagtgctttccgcaaaaaaattctttcggattcgttcattaaagaacgagaggaatctaaagataaatcatttgtaggatttgatgaggtacaaaaatattcatgaattttacatctgtgcaattcactgattttggtaccaaatttaagaaattaaaatcgataccaaaaaattttgatattaattttttgcctattttgaaaaccacttgcgaaccctatggtatacaacaaattttaccgtaagaatggtgaggctttggaaaatcagaatggctttcatgttcgggtggatgattgatgtgcgtgccaccaggcacagattggtcagggacaacggaatgccaaacaaatttat

SEQ ID NO: 31045 - DNA, 1070 bp, Heterodera glycines
tctgccgggagatgaagccggggacagatgctccccttactccccccatcgctatatcccgtcttaaaatgcttcttctcctgcacccgctttatcccctgccttctatgcttttcctctcgtctctaatgcttctcctccccatgcttttcctcctcccgcctctctatgcttttcctcccccgtctctctatgcttttcctcctcccgtctctctatgcttttcctcctcccgcctctctatgcttttcctcctcccgtctctctatgcttttcctcctcccgcctctctatgcttttcctcctcccgtctctctatgcttttcctcctcccgcctctctatgcttttcctcctccttgtctccaaaatgcttcttctcccgctctctttgcctttgcttgctcactcttgccctccttccccttcggtgcccaattattcagagaaaaagtgtgagagaggtggagcaggagggatgaagcaaagattgacaacaggcattatgtgacgagggcacaacaccaatcactcctctgcttctctgacagcaagcagcacactctctttgatcatcgcacactctctcaacacctaccctgccgctcccatatgaaaacatgtctctccaactcactctgcttctctgcccgcctctctccgatcagtgaacacacacacgcactactcactaaatgctctgatcagctaacttctttctgcttccgctgccaccgcctggtgttgatctgtttggccagcaaatgctgtgttagcaagcagtgtggtgggtgtgtaaaatgagccactgatagttcggccgaggagctgaggaaaagctgactgatcagaaaatggatttgttgcggggtcgacagaacaaagcgggggagggtgatggatcaccgagtaagaggcggataatgatgatcaacacagccacccatccaccttccggggagcttatccaatccaacccgatctgaatggaatggatgtgattttattgtggcaaatccttctaagccgtgccattaaccgaataagtagcattacccatgtcaacgatcg

SEQ ID NO: 31046 - DNA, 908 bp, Heterodera glycines
tggaggcggagcggaagggcctgctttttctggccaacggaacggtgtccgcaccgggcacggacaattagctgtcgctggaggaggcggtcaacctgggcatcctggacgcccggtcgctgaatgtacgcgacactaacagcgggcgaatgctgtcgttggatgaagcgctgcagaaaaaggtgatcattttccctccgtgcctctaaaaaaaatttttttttaatttgaaaatttgagcagtttctttggttttatgactttactcaaaaaccatcaaaatgaaaatttttgcttataactttgctaaaaagaaaccttattttgaattcttcatataatccgatcagcctaatatgctctattatccagccaaattccaaaaaattatattcgagaatatgcttttttgagttactctggccataaaaatttttttagaaaaaaacataaaatttatttgggaattgagtatttgcaaaattttatgttgaagcggtgctgagtcattatataaaaaccatcaaaaagggcgttatataaaaaaccatcaaatgaaaattttcaacataaagctgtccataacttttgtcacagtcaaccaaattcaacattcttgatatgatttgatagccttaagtgttctctataagctcacctaaattacaaaaattttggtcaagtttggcagttgagtattgtttataaaagtacacaagcaaccaggttttcacacatttttggccataacttttttgaaacttagccaaattttttgaaattttgcaggctaatagaggacacttagggctgaatgatatcaagctttcttaattttgttgtttctgacaaagatttgatcagaatttttgatgatctaaataattttatttctaattaaaaaattt

SEQ ID NO: 31047 - DNA, 1692 bp, Heterodera glycines
agtcaattttagatgcatatattattaaattaaactttcctaaaaaattccttttttacaacacaacaaaattgatgtgttgttagttatgatggtaatgttgtcaaaggttggcttcacgtacatcattttcggcacgcaacggttccgccgtgtccacactctttggcacgggatgcatgccttaaatttattttacaaaatttttaattgattttttaaaagtgccaattccataaatttaaattataattcaatttttaaaagtgcctgcctacctcgtcccaacaattcttgtgtgtcgccaaagtgaggctgaacacggtagggcatgttcagttgcaactcttccattgggtcaggaagaattggcctaaacaggggggagggataaaaatgcttttggtctcggaaaattctgattatattaatcttccaataatggtaatacaggataagaaattccgttaaattactgtacagccccaattactactgtatttcttacaaattttttgaaacttttgttaaaaatctattaatttcacaaggctgcaatattcggcttaaaatcatcaaaaataaagattttttttgattaatttaatatatattttcgtgtaaaaatgaagtttgtttaaaatttaatatttattgataattaatcccatgataaatataaagcaaattttttttattgttcaaagaattgcgttttattttttcaatatttttaacaaataaaaatgacaattttaattctaaaaattcaatttttctaaacatttctacaatttacgggctaaaaaaaataaatttgaatcataatccaattcgttaaaattttcttcattcaattggattgtatgaagccacttgatcagtatgagtactgaaaaagtaaaaaataaaatatttcaattaaatttttggaaagttcaatttttgcttttaaatttttggggtaattaaaatcaaaaaaaatttaattaatatttataaacacctgtagaatgcgtgttgggcccgctgagggctttccgcgcggatgccaaccgttgcggtggattgacgcgagccgggcaactcgcgctcaaccgcgcggattggccgcggcgtcggcaagtcgtactccgtcatttgcgatggcaccacagtagtgcgacgtgtcgttggcactgatgctggaggcgtttttggcagaatctatggaaacttattaaaaaaaaaactttgttaaaccgagtcggaattaaaatatgaaggtttatataatttgaatgaagttttttgggtcaaaaaattcatattttggggtttcgtaaacaaaaacccaaaatgtttaaactacatttttttattatttatttattttttaattttaattttaaatattaaaaatttattttaaaatttctaaattccaaatacttaccaatggctttgtttgttcctttttgggcaatggcgatgatggaactattaaaatttgtaaaaaaaatttcttttgcctatttttacggatattattcaatgttattttaaatgattaaaaaatatacgatattcaatttaatttccaattaatttgtcctctaataattattatggctaaagaatgtaaaaataataattttttttttggcatttctttatcacatattaaactggtggttagaaattgtgcaaata

SEQ ID NO: 31048 - DNA, 1212 bp, Heterodera glycines
atgcttgatgtttttctccgtcacaaaacctctttgctttccatggaatcataacgcactgaatttcattagcttggttcaccaacaaagcggtcactgctccattttgcatctgatcatttaccaccactaattcaaaatgattctacatatctgcgccaactatgtcctttgatgaatctatttagcaaaaaaacggacagaggaataactacttaacttataacttctattattacctaaatatacgtattcacgccaacagtcaccttgactcctcattatgccaactctaagaatcctgtctgatttcttaaccagacaagaacaccctcaacgaattatgataattgcgcatagtcttgttgaatcaattgactctcgaatgcacaattacagacaaaatgaattattgcgaatttcaatgatgttggacccccgatttgcataggatctgagtttatttatgagtggtttctggaaatcattgcagaggatttaattgattttgcaaaggaaagtaattttaacaattttaacagaagtttattttattttaagttaatcccgaaatgaaaccaatgagcaaaattttaacgaaacacaacaaatggatcaatcagaatctgctcattatacggattttagtgaaagtgatgagagcgctttaaaatgtaaacaatgaatgaaaaactttaatttttatttaaaattttagtggacatttggaacagtaacccaaaatatccttgctgttcatcaattataccatcggccctttctggagaacctgccccgccgttggcaccaaaattgaagctcaattagcgctttacaaaacataattcttttaaaaaatgcaataaaaaagatttttctttgactcgatgacattttttggcgacatggtcaaaaaattttaaaaattttacacaaaataattctgtcgaaaaataatccccccttctccatttatcccccaatctctaattatcccccccccctttctgaagagaatgcgaaaagcgaaacctcggcccattcctgatgtacacccctaaagattgggtttttgaaataaacaatggcatttttttttgggaaaaaatttcgcattttcgctttttttgggcatttcgctttcgccttttcgctttttattttgatttcgcttttttcgctttttatttttctctttgcaacatccctgat

SEQ ID NO: 31049 - DNA, 1342 bp, Heterodera glycines
gttaggtatccgacatctcaaaaagcagagcagattcaaattcttttgtttttttaatttatgaattttattttacttttttttctaaattttacattatttttgatttataattaaattcctcaaaatttaatgataaaaattgaaactgtgcttgttatcaatgatggcacgtgcagttgattctgtaaatttttcaagcaaaaaagggcaaaatttctgaaaatttttatttgacgagaatgaagaagcttttgtgctttaataattttaaatttggtacttatgtggtttacagaccataaaaaaaattttttttaacacatttctagggggttttcggggtcgctgatcacgaatctgacatccattgcgacgaattccgaatcccggactcgaattcgaacaaaaagtcgaattgagtcccaatgtttagaatgccggagatttgagtccattgtttggaatgccggagatttgagtcccagagattggagaaaaagcccagtctattttatcattcttaattctataacacaatcgtactgcctagcgggggatgcgccgaaggcgctgaccccgctataataaaaaataataattctcaactatgagcaaaaaattgacataatgccataatttaatatccaaatatgttataaattcaaaaatttaccaaatttcctttgattattttttccacttttccaaatgctcattttcaaggaagtccttgcatccaaggacattttttattttcaagaaagagggcccaatttcaaggacgtccttgccattcaaggacggatcccatccctgatgtagctgaaaaagggaaaaaattctgctttatattttcgtaaaaaatgtatttttctttttttcttactcattccattcattcattctatacatatttcttttttctgacatttcgcatttttttttgttttttgctcaaattttaggcagaattgtgagattaaaatttcaaaattaattttgaaagattaatcttttttgaagctcaaagttcgcatttggattccctcgctttgatgcttttcccttccattaattcatacattttcgcaattcatttttcagtttgcataccgtgcttcttctgctgttgctcgtttgtgccaccattctttgattcttttttggccatgccataaaacgacgacgcccccacaaaaaagaaatataaataaattaaacgagatttcgaaaaattcttcatttttcagctttatctgcagcgattgttggcttttggtgttcgattttcttgcgccttctcagctcggtctcgaaattgcactgattagccgccgct

SEQ ID NO: 31050 - DNA, 1680 bp, Heterodera glycines
taaaatatttaggcgtgaaaaaatggattttcccgttgtgccatgacttaatgacttccaaatcacaaccatcgtacgaaagaatgtttacacttttgcgtgcagcgtggccaagttttgctcccacttccttttccgtggattttgaaatggctatgtcaaatgccgttacgataatctttccctgatgccatattcggttttgcttttttcattttgtacggaacttacaaaaaaatgtgaacagctaggcttatggcaggtaattttccctttattttaaaatttttttcaaaatttaagcgttattgtgctgaaccggtgtttgctttgagtgttcggatgctcacatctgtcgcattcattccacttttgatatcaggaacgcagtgacagctcttgactcacgctagtttggaatttcttcgaggtatttcccaccattatcaaatgaacccttgaaaattgttgttttttgttaccatttatttattgttttttggtatttaataaaagttttattttatttttttcgttttaccaagtatttgaatttaaaaaattttttctctcactttggcgtactatctcttcattttaattatgtaaaaaacaacatttacttctctccatataactttttttctatgcataaaagttgcaccagattttgcatcgaatgttctataaggttttaataattttcaatcttgtttttttgtaatatttatttaagatttgtttgacttttttaattgtttaatggctaaaagaaatttgccacacaagctcaattgcaaaagagcaaggcaaaaaagggagaacaagcgagaggagcgacgaaccaaaatggccaaggcgacacacgcccgatgggccaagaaaggtgagtttttccattggtttttcgtaaaatctctaattttccaatttttagccgctccccagcccgacaccgatgccgaaaagccacaaccatctgaagaagggccgtcgacatcagaagcaacggcgcaggacaacgacggacaaccatcatcaactccaacaccggtgacaccgctggaaatggacgtgccatcggtggagatgatggtggtgtgtcattcccttcaacgcctgccgacgaagaccaacaaattcaaccaatgccgtcaacatcgacggcacgctgtgacgtggtggcgacaccatcgacttcaaagggcgccggtggctttggtctcgacgatcgtgagtgagaaatttcaccaaaaatttagttttttaactcgtttcattttcattacattgaaattttaattttaggttggccgctactctcatctcggcacacaagagaagatcgttgagaaactggtgaagcacacgacgatgttgaatgcactgcacgaccgtggcgttgagaacaacaaagaaaatgacaaatacccagattttgaccaaattttcacctcacttttatttattttcacattaatatttcgaaaaatttgagtggtttgaaatgagttaaattgtttagcattcacttagaaaaattctccattttaaaatctttttttgtataccaaatttattcagtttagttgggtatgaagaaagttatggcttatcaaaataaacaatcaaaaatgcacggatcagtgtaagtttgaattagcgcgcaaaaaattacgc

SEQ ID NO: 31051 - DNA, 1058 bp, Heterodera glycines
  misc_feature (66)..(66): n is a, c, g, or t
  misc_feature (904)..(904): n is a, c, g, or t
tgaggtcttaacgatgtcagaagtaaaatctgatcacgtattcgtgatcagcggcccaaataaccnctaaagacatatttttggaagatttttgtgagaaaaatttttccactcaaaaatcctatgctcacccctttggttccggacccccccaaaaaaccttttatttttgtatcttattttaaaaaggtgataaaaatgtaaaataaattttatttaatagagcaaaaaattgcggatttttgtagtattttacttttacagaatgacttttcagaaccgagttctgaatttttttctgaaaattcggatttttccagaaattcttgaataactttttttcatttcaagatataaatttcaattaatcccataaaattctcctgatttttctctatttttagagctttaattcacttaaattgaccaaaccttaactgagcaatgaattttcaaaatttaacccaaatttccaaggaccaaaaaaattaaaaatattttcgaatttttaaaaaattccaaaaattatgaaacttaaaatagacatcatattcgtactcagcacctcaaaataccccagaaaaatatttttcacaccctttttcgaccccaaaaaaatttttgaaaatttctagggggcctagctcgaaaatttttgaaaattttacatcatttagtacaccattcgatagcatttaaaatgctctacaaaaatgttctaagacaatttttcgctaaaatcaacccctgacgagttatgggcccaggactcaaatgtcccgctgaggccaaaaattttttatatttcagggaaaaaatcgaaatttttccaaaaaaaataccagtcgatagagctcgaaaaactatgttttggaagtggtctccgtttctctgggaaaattcngttaaaaatcataaaattcaaaaacccgaaaaccgttttttaggcctaactcgaaaaattttgaaaattttcgaaattttaaaatttggaaaaatcggggcttttaaagctctacaataagtctgctggccaccccccgctcagatcaaaccct

SEQ ID NO: 31052 - DNA, 954 bp, Heterodera glycines
gaacagcggcttatggacactttgaactgaaagcgcaatttgcccatgtcgtcggcaactctgttttttaaagggagaaaaagggggttggcattatgttaaaatatgccaaaatcaaataaataaaaaaagactgaccgaaatgaatcggaaagtgtcgttatcctacagaaaaattgaaattttatatttttttaaagaaaatttatgtaacaaattgacgagctcatttttcagtttccaaccgattttccaccgtcaaaaaaaattttttaattttatttggagaaaggtgaatgcaaaacaataaattttggggtacaatttcatttttttggaacggaaaaaccccccaaaaatcagtttttttagttaattaaaatattttagtcccacaatttagaaagttgggcaaataatacttaaaatagtgggcctaccaattgacaatttcgccttgtgcataagtgattacgccttggccaaactgatgcctgccgtcctcgcaaaagttcaaaatgccattcaactttaagaggggggtgggggacattaaaatttgaaatgaattttttaataatttaaaaaattaccgaattaatggaaagcaatgtctcctcgtcaagatggactaaaatgtttaataaaaattagttgttggggacatattaaataaatttttctgtgtcttttaaaataaaaaaggaccaagaaaattctttaattttttttggaattttttttttaattttaaaaactgtttaaatttaatttatgaattttcgatttcattaataataaaggaaaaattttgtggaattaccattgcctttttgagcatttaatttgatttttaaaataaaaatgtaaaaaaaaaaattttttgtaaaaaaatcgtaaatttcaatttttcggattttattaatattaattgatcatatttgtcaattttat

SEQ ID NO: 31053 - DNA, 1552 bp, Heterodera glycines
  misc_feature (41)..(41): n is a, c, g, or t
cgagactaccccccggggccgaatcctgagcatcattttgncgaggagtgatcagacgaatgagccggccatcagctgggatgaattggcaaagcgaccggagctcagcagacttgtggacggacagaaggacactgcccgattgatgttggacaatgtgccacgtatctgcaaaatgcaggcccctccggggacgggaaaaactgacgtggcaacgagaattatgctgtcaattctcaaagaaaatgacgaggcccgggtcctattcattgccccaatgaatgttgcagtggtgcgagcagttcagcagatggccgagaacatggaggaggtcagatggagagagcggatgctggcgctgtttgctgggacgggaaaggctaaataccgggacgaaattgcgcacatcggttcacatcttttggcttctgccgtcagtgctcctcaacttttggacactttggatgaggagaagaaaaaggtagtggcacggtatgtaaaggcgtgccaagacacaccgaaaatggctaatgagggaaaagttacggaaatattaatgggaaaggaaaagcggcgcctcgtcttctgcacattaagcttggcggaacaactgggggggctattttcagatttcgattatgtcttcctggacgaagccggacaagcaagcacagtgcaggtgctttccatgctgtcaaaattcccgggattgaagaaattgctgatcactggagatgaacatcagctcggggtcaatctgcaagaagtgccggaggcagttcgcgacaaatgcggtttggacaccgttttggagaatttaagggtcgcggaatcagtcgacaaaacggttctgtccgtcaacttccgtagtcacccagtgattacgaaatgtgtcgaagcagccgcgtacgcaccgcacggaatacagctgatctccggacgatcagcagaccaaatgaacatgctgagcggattgacaggatcaggctcccatccccagggattcccttaatcctgatcaaccaggactcgccaatgcagcctgatccgacctccttttcacagtcgaatgctggacagacaaggacggtaatggcccttctcgaacaactaaaaagccgcttcccgggaacgatcagagtggtatgcttgtacgcggggcaagcagccgaaattggactcatggtagcggaacggattaatgaagatggggaagaaggatggggcgaaataatgatcacaaccagtgacggcactcaagggcacgagagtgacttagtgcttgtcgtgacgacaagtgccgggggaggggtccattcagatgccttttggaatcacccgcgccgtgtgaatgtcgcactcagccgcccgcggcacggcctgatcgtcatcggtgatctggtccatctttggcgggcggaaggcgtgtggaaacgcttccttgaaagggccatcaaaagcacaaccgtggtctgtgcaaattacgccaatttgatgtttcaccggcacgcgcatcatttaaacggcaaattagtcggcgctgatggtctcc

SEQ ID NO: 31054 - DNA, 1692 bp, Heterodera glycines
atgttaaaaaggaactttttgcatgttgcgaccccatctaatatctgagccttattattggtgaaggcctttaagaataataaaatctccgaaacgtcctgctcattttgcaatttatgacgaatcatccttcaaagagcatttaatttcgaaattacattccaataaaaaagtttcatgttcataattgtgcattattcaacgcaaaatgtgataaatttctattttttaacaggcccaaatgtatggaaaatgtctaatccaatctagcaatttttgaagaagtcccctcattttcaaccgctttcttttcagtatcgccaattttcttttcgcttgacttataaattcgtgtgaccacccagtcgaggccgaaaaagttttgactgtcctcctataattttgttctacaagtaacaatgtccaacaaaaaaacatttaccttaatggtcacttttgcattaattgttgttcccaatttggcttcaaaatgctcatacagtttctgttcttccatttcatggacatcaattgccttaagtccgagaaacgcttccgcgacctgaatgtgcaaatattacgaaaattaaagaaaaattgaataaccgccgaaaaaattgttgcacgttgagtgcaggtgctgtcgtctaggtcttgtaaaacaattttcagataaatgtttttgactggcttctccactgtttgcccgcacgaatcgcacgtgagatttgttggtagtttgcgacgacaggggataccacgcactcggagcgggcacgactaaaggaaaatgagaaatttactagaaaacacaaaaaaatattcgaacatcataaacttgatagtgcaagtccgcaatggttgcagtaatgtaaaatgtcccagctcctgcataacggagaacatctttcaaacttttcgggttctccaattcttcctcatcagcgctggggcgttttgcaggaatttggaagcgtgagagctttcatctctacgcaagcggaggcatttcatctctacgcaagcggaggcatttcatctctacgcaagcggaggcatttcatctctacgcaagcggaggcatttcatctctacgcaagcggaggcatttcatctctacgcaagcggaggcatttcatctctacgcaagcggaggcaaacagtttactattctttttaagcccaattcactttttaaaattcggttgtatctgaaaaatttaacactatttaaaaaacatttagcaaacagtctcaaatttgttccaatttttgtaggttaatttaaaaaataattttagaaagttactgaaaaaataaacacaaaaatggcattttgagccttttttgaagaccgtagtaattcaaatcttacttagaaattttacaggctaaaaaaagagaaggattgattaaattcttaagattgaaaaaaaacagaaaagcgtgacaatatttttggtgttatttaaatttaaacagaaaatttttaaatgcaaaaaaaagaattttcaccgatccataatgctgttgttgttgttgttgttgttgttgttggcgacggcgaccttgcccagcgctatgccagacccaaggcattttggaactgaaataataaaatattattcacagtaaaaaatagttgaattaataagaaataattataatttaaaatgaattaaaataatttaa

SEQ ID NO: 31055 - DNA, 964 bp, Heterodera glycines
atgcgtggcacccgggagcagttggaatgggcatgcgtgcacccgtgaacagttggaacccgagggcttgttgaatgggcatgcgtggcacccgtgctcagttggaatgggcatgcgtggcacccgtgctcagttggaacccgagggcttggcgaatgggcatgcgtggcacccgagggcttggtttatgggcatgcgtggcacccgtgagcagttggaacccgaggggttggaatgggcatgcgtggcacccgtgagcagttggaatgggcatgcgtggcacccgtgctcagttggaacccgaggcttggcgaatgggcatgcgtggcacccgtgaacagttggaacccgagggcttggcgaatgggcatgcgtggcacccgtgagcagttggaatgggtatgcgtggcacccgtgagcagttggaaaccgagggcttggcgaatgggcatgcgtggcacccgtgctcagttggaatgggcatgcgtggcacccgtgctcagttggaacccgagggcttggcgaatgggcatgcgtggcacccgctcagttggaatgggcatgcgtggcgcccgtgagcagttggaacccgagggcttggcgaatgggcatgcgtggcacccgtgagcagttggaatgggcatgcgtggcacccgtgagcagttggaatgggcatgcgtggcacccgtgctcagttggaatgggcatgcgtggcacccgtgctcagttggaacccgagggcttggcgaatgggcatgcgtggcgcccgtgagcagttggaacccgagggcttggcgaatgggcatgcgtggcacccgtgagcagttggaatgggcatgcgtggcacccgtgagcagttggaacccgagggcttggcttatgggcatgcgtggcacccgtgagcagttggaatgggcatgcgtggcacccgtgctcagttggaatgggcatgcgtggcacccgt

SEQ ID NO: 31056 - DNA, 1364 bp, Heterodera glycines
  misc_feature (1358)..(1358): n is a, c, g, or t
ttcgcagcccaacgcgacggtctccacgccctccggcacttcgtctccgacgttttcttcgcgtgcctcggcggccgtgcctttgcgctgtccgtttgttcctcggggctcaaattcgaccagcaaaagggcgaatgcgcatttgctgatcaatgcgggaaggaacggtgaagcgaagcggaaaaagattaattaagtgccattttcagaagggaattaaagcagacgaaaacggagccaatgggagcgaatttggagcacgggacaagcaattattacttgaggagtgaatacgaacaacggcaggaaaaagtggggggggggataaattaaaatttaaaagacaattaattaattggtaattatttgccaaattaattatttgtgtccattggcccttcaaacattgtcaagatttcctccgaaaacactttcttttgtccggacaaacgaagcgacacttacgcaaaaagcttctgcacttcttcgttcttcaagtgcactaatggtaatgattgtgcttttattgcgttaattaattaataattaaggcgttgcaaatgaaacgagatgctcggacaatttggtttatgatgcgaaatggaagcaatgcacgacacagcaaaattgttggcaaaacaggcattattcattgtggaaaagaaaggagaaaataattgtgcacatattaagcactaattggacaggaaaggcacaacaaaatgttcaaaatccaatggcaccgtatcaccacgcacaaacccaagccggggtatcgtatccttcagcgcatcccatggcattccaaccccaacccacggcacatcccatggcattccaaccccaacccacggcacatcccatggcattccttcctcagcccacggctcccaatgttccgctgtcgccttcctccctcgcctttgactgcgtcggcaaatccgatggaaattacgttcaccggccttgtcaggtgcttcttccattttccttttcccaatgctttcatttcgctgtcctttagcccatttatttggtctgctcgaataatgcgccggttcaaatgaattgtccagcaaatctcgtcttcgacccaacaacaaaagcgtgcgaatattcggagagatgcacaaaaaataacgccccggggtaattctgttcggtaaaatgccgaaactcttctcccccagggcttctcgtccgccgtcccccgcccctccgtcctccgtcggcgtcacccaccaccctccttctccgtcccattcgctttcgtcctccgtccatttgccctcacaggtgcgactgttcatgcataaaactgggacggttcggtataatgtggcactatttaggcccanaatcgg

SEQ ID NO: 31057 - DNA, 1435 bp, Heterodera glycines
  misc_feature (1357)..(1357): n is a, c, g, or t
aatcgctccttatgttttttacagcttccccccccccccccgccctctcctggccatggcacacgcactttgctgactaaaatgtacaaagcaaagcgttcacgtgccaaattgaacagcggataaacacaaaagatcataaacagatgccaaggaaccaataagtgatttgcaaataatggaacacatttacactgtcaaatgacgacggatcaagtccactgcagttcatttgtagaggaattaagaaaattttctccaaaatattttgaacacaactttaaaacttcctggcaataactccaatagggaaaaaatttttttttcattttaacctaaattattttaaaactttcctatattaaattttatttgtgctgaatttcatataaaaacgctcctaaatcagttttatttaagaaaaaaagttagttgaaggcctaaaattagaaaacaatgcaccaaaaacaaaaatcttagaggttaataaaagtgcaaaagttactaagattaaattaaaagaaaaaattaaatttcatttttcccctcggcatatgtaggaaagcattagcacagtttgaatataattgaattttatttacttttgccctagaccaatcttaaaaattaattttccaacaagtgaatatatataatcatttttaccgcactaaataaagccagaaaatcactgctgccaattaatgaaaatttcacagaacgataatatataattaaatcagacggacggaccacccaactgctcagaactgaacaagtaattacgaccgcaccaacaattagtgcttacttttaagtctaataatcacctgctgctggcgatgctcatttttgctcttttattaaaaaaatagcctaattcggataaacggacgggcccaaaacatctgccccaatcatcgagagcgcagttctttttttctttggcgaaaaattggcatttacaaatggagtgattatgagaaatgcttaaaaattaattaaatggcggtgtgatggtgttggaaaggttatcggcgaagaatttttgatttaattaacgaaagaattaagagaaatgcttactagagaccgaatttaaatatgaaaaaacacaaaaatacggattataatatgaaaagttcatgaaagatggacgaaacatggaaaaaatgctaaaatattgtgttcaagtttcgaaaaattataaacattacatttttgagaataaaagcgaaaaacagattaattcacgaaaaaataataattcttgaaaattttgggttcaaggagtttgttttttcgattttcttgtggaaatgccagaaaatggaattgttttcaaaattcattattncaatttggcattcgccttctctgtccatccgtccggacaattctttgcgtatttctcatctcgttttcatgcgcaatg

SEQ ID NO: 31058 - DNA, 1285 bp, Heterodera glycines
ttttaattattaaattaataattggtgccgtaattaacctttaattgtcaaaattgccctcttctttgagttgcctcaccaaaagcaaattctcgttttctcccccatttaatcgccgtccgtttttatttccgtctcaaaataacaaaactcaaaaaatggtggcctttaatcaaaatgaatgaattaccaattgaaactttccgttattttaaacatttgcaattaattcccaaagaaatttcctcactttctttctgtcagagaatgccttttatcattttattcgccttttttaataaaataatattttattaaaaatttttttcatttatccctttcatcaaaagtaactaattagcatttaattttcttcagataggaaaaaatgtctgacggcaatctgccgccgcgacccccgggcggcagctcctcagcgggactgccaaagtcattcggtcagccatccaaatacaaattttgtttttgaagtaataattaatattgaaaagtaaggaaattaaaataaattattaagtgtactgtacataataatttgtcgaccttatcattgtaggtaattaattaattaattaatcaccaggggctcctgtatggtcgatcacgagaaaagaacggaaggaaatgacaccaccgacaagagggagcagagaaagcagcgaggaaaagtcatcggcaacggattcaccgtaccaatcgagaacagtgacaagcacagaacgggtcagtgttagccgagaatgatttatgaacagatcaattagcaagaaacttaaggttcaaattgtgcaaatgccattggaattgagcgaagcgagcgttgaacagctccgaatgttgacactgtcaccgcggacggaggcgagcagagaggtggccatttatgaacgatttgtcaatgggattatgctttttaaggtgtgcaccacttcaaccacaattggggcgggaagtgtccccctaattggcggtgtcactgctaatggggttcattaatcaaatgtcattttgtatcattatgttgatccatctaacactaaggtccctacgattagcggagtgtttgttcacggggaatcccggcaaacgaccacaataatcaccactaccacgactacctacaaaatattggaggatgaagggagcggggacgactttgaactggtcgacctcgaggaccgtgcccagacgacgtcggaactgagcggagaaatgccgttgaggatgacctcaaagacggaagaaggatatgtgatggtgaagg

SEQ ID NO: 31059 - DNA, 1157 bp, Heterodera glycines
aaatattgaataattcaataatttgttaaataaacttaaaaatacttaaactaactaaactaactaaaaattggtttaaactttagccttaaaaatgccaaactttatcaaattcgagcttcaataattacaaataaataaatctcatggttttttggtaataatctcattttgttgtaagtaaaaatttccggaagcgaataaataccaaaaaaatttgacaatatttcgaaaaattatctttttgttttttttatttccaaaaagtcgatccttaggggcgtatttttcgcttttgttgatttgcccaaaatggccgaaatagacttaaaaaagcaaaaatggcaaactatggatttattcccgaaaaattccttttggcataaattacacagattttgtctaaacaatgaccaaatttattgatttatgctaattttttaagaaaaaataggttttttggggccggtggtgccgataggcgccgccgggggaaatttgttttatgaattttgttagaaattagccaaatttttcagaaatttcattcttttggatgaaaatacgccctaaaatcagaacatttcttagaaataagaacataaagaaaccctacattaatcagatagaaataaattcaattgaaaacgccaaccggtgttgaactcctaacaagaaatactgttagtgttcaagcactaaccactaaaccacaaatatattggaaattaacagcaaaatttactttatttcataaaaaatttgtcaaagatggttaaaaattcaaatttgaataaattttttgccttttatcccacgaatatgccattcttgggggtgtattttcacccccgtgcccccccccccccgggggcgaaggtcgcgggggtggggattgcgggggtcagagtcgcgggggcggggacgggggtaaggccaaaaaacctgtcacgcccccggcgggggcgggggtgacgggggcggggctcgaaccctactttctttggtccgttcgttcaccaattcaaatggcacaatttgtgacgctgacagagtaaattgaacagtgtaactgacagaagaaaaagtggtggcatggcgaaatgtctaaacaaaaataaagcgtaaatttagggcaattaaatcaatcaattagt

SEQ ID NO: 31060 - DNA, 613 bp, Heterodera glycines
cattaacaattttaaaagaaaacaaataaaaatttaaatatagtcttttgaaattaatacttaaactataaaaaaaatatatatttcctaataataattttttttaatattcagtttcttctacaccaactatggtgtaaagttgatttgggtccttgagatgtgccaaatcactttgatgattattctgtggctattgttttattcaaggcttgtgccgttaaggatcaccaattgattttttgtaactatgtgaacaattaatataaattaaaatgatttcaaaattagtttcttaataatagaaaaattacattttcagcgtttaaacccaaaataatctaaattgacgtatatgtaacaccatttttaaaattatattttcaaattttggcttcttctggccataatttggtcgatttgccattgtaaattttcggcttttttccatagtcccgaattgagcagaaaaaaatctctcaaataacattataaatctgtctagcggattcgaacccatcatgacaaatgaagcaataaaatgtaaacgaaaaagtatactacctatattaccatagtttgctttctagggtgttttcggggtcgctgatca

SEQ ID NO: 31061 - DNA, 1828 bp, Heterodera glycines
aattaggatggcgctctgtttttgccaacttttccatcacaaacttttgtcgtcctggcattttctactttgttatgaaagccatcaatttggaaaggtgggacatttgaatggaaagtcaacttttattaggacgcattattattcatcatttaagggactaattttacaaaaaataatttttgcatttttataattttgaatttttattaattttggttagattaaattatgaattttcaaatgaaaccaaagtataaaaaaagaaatgttaaggctgtgttctattatattatttttattttaacagttttgccacgattggattcgccacgaaggaagtgccattggacgggtcaattggccaaattttgaacagttacggataccgaaacgatggctcatttggctgtaatggcatcaaccggccgtgcaaaatgccatttggccaaatgccaatgtcattatttggtattccatcgtcattttcccccgtggcaatgccatcggcggacgtgacaatggcatataaatcatcggaattttccactggcgacgtggtcggatgtggccttttcttggacactcagctgatctttttgacaaagaatggacgacgaatgggtgggccaattaaatttaaaaaacattttaagatgactcatcgtttttcatttcttctcccgccaattctcttttccgtgagtttctttgtgggcgggcgacaaaatcgaagcgaactttgggccaaatttcaaattcaatttggccactctttgaagaaagcagaaacaacggaagaaggcgataatcatttaaaattcattaatttttttgtgttttcattcttttttcaatttttgattttgtttttaatgctaattgtattattttatttgttttaatttattttattaaaaaatgttctggcgatttttggtgaaatttttaatagattctaaatgattgctgctcggcgcctggaaatttataagagttgggtattttgccagaattcggtttctaataatttttttgaattgataaatagacatctgcaatgtataaaaaaaattatgaaattactttcccccaacgcccacccccttcgcaatatacaaaaacgaaaaaaaaatacaataatccatgttcagttttgtaaaaagatgtctcaattatggacaactgggaatggcatttgtgtaatgattatgaattctaaaatgctaatgaccgaagtatttcttttttaaatgctaaaaacaaaatatttccacagcctttaacaaagatttattctattctctgaaactattaaatccaattttccaaatgaatttttaaataaaattctcaattggagcccttcttttgaggtcactattttgctcgaaatttaatttggttatattctaatgtaaatgaaattattaaagattttaacgtttttttcgagtaaacacaaattttaaccaaaaattttttagcaacgaaaaaattaagtgttggcgatcaatttttgagaaaattattcaatcttaggagtattttctgaatttttttgagccatttattaggggtgtattttcgtttttattcgatttttgataagaatttttccgaaaatcctgaaaaaagcgccaaaaattgcgaaataagcacaaaaataggcatttaggcattaagcaaaaatccaaaaaggcaaagttaggcattataaaagtcatcgtatacacccaaaaccaagcggaaaatgcgtttttcgtgcttaactgtgcgtattaagtgcgcagaatttttaggcatttgcctaaaaaacgaatcccta

SEQ ID NO: 31062 - DNA, 892 bp, Heterodera glycines
tgaataaagcactaatagtgtgtttgaaaacgcacgaaaaatagttcttgacaaaaaatggctatctctgaaagtcactattaaatcactaccgggaattggacaccaacttttgtcttctgttgtagcgctgaataaagcactaatagtgtgtttgaaaacgcacgaaaaatagttcttgacaaaaaatggctatctctgaaagtcactattaaatccctaccgggaattggacaccaacttttgtcttctattgtagcggtgaataaagcactaatagtgtgtttgaaaacgcacgaaaaatagttcttgacaaaaaatggctatctctgaaagtcactattaaatcactaccgggaattggacaccaacttttgtcttctgttgtagcgctgaataaagcactaatagtgtgtttgaaaacgcacgaaaaatagttcttgacaaaaaatggctatctctgaaagtcactattaaatccctaccgggaattggacaccaacttttgtcttctattgtagcggtgaataaagcactaatagtgtgtttaaaaacgcacgaaaaatagttattgacaaaaaatcctatctctgaaagtcactattaaatccctaccgggaattggacaccaacttttgtcttctgttgtagcgctgaataaagcactaatagtgtgtttgaaaacgcacgaaaaatagttcttgacaaaaaatggctatctctgaaagtcactattaaatccctaccgggaattggacaccaacttttgtcttctattgtagcggtgaataaagcactaatagagtgtttgaaaacgcacgaaaaatagttattgacaaaaaatggctatctctgaaagtcactattaaatccctaccgggaattggacacc

SEQ ID NO: 31063 - DNA, 1124 bp, Heterodera glycines
  misc_feature (1067)..(1067): n is a, c, g, or t
  misc_feature (1107)..(1107): n is a, c, g, or t
taatatatagggatgtgaaaaatatgtacaaaatgtggtcaaaatatgtacataaatatgtaaaaaaaaatcccaaaatatgtacaaaaaacccaaaatatgtaccaaatatgtaaataaaaaatttttaatggttattttttagaaaaaaaaattactctaaaggatgaaataggcacaaaatgccataaaaatcatgcaaatagccttaaatcatcttttaatattggaaaaattaatttttggttaatttttattttttcaacagaatttttaaatttcaaaaattctcaaaatatgtaaaaaaaatatgaaaatatttacgaaaaattgccgaaattttggactttttttcaggattttcaaaaatgtccgtaaaaaatcctcaaaatatgtaaaaaaatgaaaatatgtaagaaaaagtacaaaatatgtaccaaatatgtataaaatcctgaaatatgtaaaaaatatgtaaataaaagtcccgatttttgttcgcaaacacaaaaaagaaagtgtttccctactttttagagcatggagaagccaggaaaaaaatgtatttacataaaattgacatctctaataatataatattgttcgtgcaatatttcaggtaaactgtgtcacccaatttttgccatttgcattgtatccgtccccatttccccgtactttgttccaacaagctgtgggcgtacaccaggtaaaatactactgctaacaatattcggtatcagtgatgcgatttgagccctatttgttgatattttcccatgttttcagagtattcttacacaattttacagggatgactgtaatttctctctgtttttggtaacatatgtttacaggaataaagaaccgccggagctaaaagctctttgaaaatttttcaaaatttggctttaaaatctaagatgaagcagttaattatatatttttgaaaattgttgggccaaaggttccgatcagggatgtgcgaaaatcacaaaaaaaaaattttcatatacgaaaacgaaacgaaaaggggcattcgacacgaaaacgaaacaggaaacganaaaagaaaattttgaaacccgaaacgaaacactaaacganaaaaattttgacggacg

SEQ ID NO: 31064 - DNA, 990 bp, Heterodera glycines
ttaatgggggctaaataaaacggaagtgacttgcccactgttgaggaagcacccgctaacagtgatgggatggatgactcctcggcggttaagagccttggccaaaataaccaccaaggcgggggggggggggaggggcatagagaggttgttcctacaagaacaagggaaaagtatgaaaaaaaaaaaaatggggaaaaagaggatggaaaattgtgacgtaaaattgggtatttttttaatgaggttcgagaccgaaaatcgccaagacttgagaccgagaaacccctaaaaaatttaagaattttgatggttcagagggaggataaaatttgacggaaaatattagagggtctcggagatatgtaagtacaaaaatggcgggatttcgaatcagtttcccgcgcacaatttaaaaaaattcgtaattaaattaatttcataggtgatgcgacatttgcggcgcagacacttatcactttgggtgggcgccgcaaatgtcggcgccgcaattgtcattggctgggcgccgcaagtgtcggcgccgcaaaagtcgagccgcaagtgtcggcgccgcaagtgtcactttgggtgggcgccgcaaatgtcggccaatcatttcataatacatttttaaaactttaaaacacaccaatgatttctgtgctttctaatctgtgtgtattttgttgtgttctgctgatcaatgtgaagaagacgacaaatttttgttgaacatataaattacaaatgataatggggaaggaaagtgttttggcgctttgtcgcaggacaaattgacgaagaacaaagaaaaaggacgacaaattgtccaacccctttggttggggtttttttctgaaaattgatttgagaaacataagaaattttttgttggaatataaataactgataattatggggaaggaaaaaggggaaattgttggtaaaatgttttggcgctttgacataggacaaatggacgaacaa

SEQ ID NO: 31065 - DNA, 984 bp, Heterodera glycines
  misc_feature (58)..(58): n is a, c, g, or t
ataaataaataaatttagaattgtagcagaataattgctcttttagtattacggcagnatattcattctttgagttccactttttaggcaggaccagactttgtgcgtataatgaacgcgaacagctgcacttcaataaaactggctcgacaaatattagggccaggaaaagctgtggcatttttaagaaagttatccttcaaacatcgcgctattttctattttgactccttaattaattacaaatacaataaataaataaatttagaattgtagcagaataattgggtttgtattattacggcagtatattccgtctttgagttccactttttaggcaggaccagactttgtgcgtataatgaacgcgaacagctgcacttcaataaaactggctcgacaaattttagggccaggaaaagctgtggcatttttaagaaagttatccttcaaacatcgcgctattttctattttgactccttaattaattacaaatacaataaataaataaatttagaattgtagcagaataattggttttgtattattacggcagtatattccgtctttgagttccactttttaggcagggccagactttgtgcgtataatgaacgcgaacagctgcacttcaataaaactggctcgacaaattttagggccaggaaaagctgtggcatttttaagaaagttatccttcaaacatcgcgctattttctattttgactccttaattaattacaaatacaataaataaataaatttagaattgtagcagaataattggttttgtattattacggcagtatattccgtctttgagttccactttttaggcagggccagactttgtgcgtataatgaacgcgaacagctgcacttcaataaaactggctcgacaaattttatggccaggaaaagctgtggcatttttaagaaaggtatccttcaaacatcgcgctatttttctattttgactcctt

SEQ ID NO: 31066 - DNA, 1601 bp, Heterodera glycines
  misc_feature (1597)..(1597): n is a, c, g, or t
gagtttatagagcatcgctagaaatatctcctagtttcttttgtccacaaaaaaggtccagagatctctagcgacttacaaataaaatcccaaatcagcttttgatcccggcaggatcggtgttttacgaaatccctcccgccgtcaaaccccaattaaaccattttccctctgttaggtctgtggcgctttcatgcagttgtgctgggacctggtcatctttctccactttcttctggcagcaaatcgtctgctgatctttatgaaggcctcttttaagccctccattttgaacaaagagccaaagtcggagcaaattcttttcaatgtaagccgaaaatgattagctaatttaagcaattaactaatgagttcttccaccatttcagtctcttctcgtgctgatttggctccttttgatcgctttgatcattgcgtttcaaacgccgttccttggcgttttgtttcagcgcgattatgtttattttttggccgatcagtctctcccggcgatgcccatttttcggctctgtgaattttattggacctgctttctgttgccaactacaacaactttctatatatccattgttgttttgttgaaaaaggttgagtactacataatgctaaaattttggtgtaatcaaaaataattttagccccattatcaaaaattgttaatccgtcccctaattcccgatctttttgtccttatataaaaccaactcccaacaataatttaacgattcaattttaaatttccactttatttcagtatagaaaaaagtcatccgatggcaaaacggccaaaaagttcgtgctgaataagcaggaatggcgcattttgggccaatcggtggcaatgttcgttctgatggcatttattgtggccatttgggatttggtcgatttgctctcgtgggttctgcccgacgggctcattctgctcagtgatttcttctttttgctgttctgtggcatcagcccaattttgtatctgtgcactcttccgtatgttttaggggcaacttttaattgagtcccattccaattcacccctctgacttcctagtgaatgggtctcgcggtgttaggtcaaacctaaaaaaagaatcaatggggtgaagctaaaaagtatcaatgtgggcaaaccaaaaaatcaatgataataacctttaaatttaattattatttaaatattttttgccgaataagatcacaatttagctcaaacttagtcaaattaaacaatcttggtagtgagtgataactctatttgtactctgctatcggcatgtcaggcgaaacaacggcacatattggcgatcatttcgtattatttcgtcatcatttcgaccgtttctcctcaagagcgaatcgctatcagtgcggccttaactttgctggacagtaccactggcttcagagtgcgtactgtttctgccaatgttctgttttgggtccgatcactgcagtttggcattcccaagcgccgcaccggttcgacacacggagaacggcacaaaattcatgatcttcctgatcataagcacacaagacgttccagccaaaaaattacttaattaatgagaaaaantgag

SEQ ID NO: 31067 - DNA, 1369 bp, Heterodera glycines
aaaatcaaaaaatttttgaaaatcaaaatccccgaccccctaaaaaaaaaagagggaccatcagaccaagttggggtaaagcctttttgatcagccattttaccccgaaattagggcaatttgtggggacgcacaaaagataattcctctttcccatctactttggccatgcctttatacttttccgataatcgacattcctttactaatcatttcatttttcccattatgctttcattataaacgcatttatcttttaacttatcttttaattttagccaagtactataccatttttattttttgtcttgttctcccggaggagatacgagccggaacgcgccaccctttcatcacacattctcggcccctcactgcctcccgaacaaaaaaatgagggacagcgcgtccaggcatcgttctcccggaggagatacgagccggaacgcgccacccccttcctcacacattttcgtcccctcactgccttccgaacaaaaaaatgaaggacagcgcgtccaggcatcgttctcccggaggagatacgagccggaacgcgccacccttttataaagtcacacataaaataaaaaacactaaaactaacccgggggagatacgagccgaaatgcgtcaccctttcatcacacaacacataatccgttcatcattgatcttcattgccaaagaactgtccttcaacatgcgtacaatcacgttgaagtggaaggcacttcttcaaataattagattataaaaattcgttgttcgatttataaattaaccattttcactctgaatgatgctgccaagaaattgttgcatccaatcatcagttttaactgaaacgtaaaacaatttcttgaatctaaattgtatcggatttttaaataccaaatttgttctccggcgtctcaagagtatagactttgatgcagcttacgtacttgtcttcatctaccggtttgaacaaaatgggcttatgctaaaaaggataaacatttggaaatacagtttttaactatttagtaaatttcaagtttaacattagttcaacagaaaaagaccaaacaaaaaccatggacgttttttacgcataattataaaatagactatttactagaatttaatcttatcatctataaaataaaattataaataatgaagcattctctttaaaatataaaataaaatattaccccttttttaaacaataaaacattcagcagaagtctggaagtccttccatttccatcatcaaaaggatgaatttcgagctgcaaaaggagtttttaattaattattttaaaacatagttaaagatttatttaaacaagaccattttttgattttaaattatctcacgagt

SEQ ID NO: 31068 - DNA, 1561 bp, Heterodera glycines
  misc_feature (1510)..(1510): n is a, c, g, or t
ggtaaaaaaatgaaaaaaaagaaaaacccttttttgtcaagatttttttttttttggtttcaaattttgtaagatttttttatggggccaacaaaaaaaaggcaacttttggttccaatttttcggtaaaaaaaaaaaaaaaagaaataccctttttttgtcaaagatttttttttgtttgcgtttcaaatatcgtaagattgttgatagggccagacaagaagggcaactgttggtaccaattttgcggtaaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagaaggcaactgttggtaccaagtttgcggtaaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagatgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcgagaattttttttgtttgcgtttcaaatatcgtaagattgtttgatagggccagacaagagaaggcaactgttggtaccaagtttgcggtaaaaaatgagaaaaaagagatagctattttttggtcgagaattctttttgtttgcgtttcaaatatccgtaagattagtttgataggggctagaccaggagaaggcatctgctgggtacccaagttttgcggtaaaaaaaatgaggaaaaaagagatagccattttttttggtaangaattttttttttgtttgcgtttcaaatatcggtaagattgtttgataggg

SEQ ID NO: 31069 - DNA, 1792 bp, Heterodera glycines
gtgcaacagtgattaaaagaggtacacagtgatcttatgaggacaactgtgattaaaagaggtacaacagtgatcagaagaggtacaactgtgatcaaaagaggtacaactgtgatcagaagaggtacaactgtgattaaaagaggtacaacagtgatcagaagaggtgcaacaatgattagaagaagtgcaacagtgattaaaagaggtactacagtgatcagaagaggtacaactgtgattaaaagaggtacaactgtgattgaagaggtacaactgtgattaaaagaggtacaacagtgatcagaagaggtacaactgtgatcaaaagaggtacaactgtgatcagaagaggtacaaaattgttagaagaggtacaaaagtgtttagaagaggtacaactgtgattgattagaagaggtacaaaaattgaatgcaatttattataaattttaaaaaataaattaattattccttttattaattaaaaagagaattttgaaatgtacaataattgaatatttaaattaatatgaaattaatttttataaattcaattaaaaaaaatatgaaattctttattaaaagataattattattttttacataaattcttttattattaatttacaacaaatctttaaatataaattgatacaacagtgattagtaaattcattaaattaaaatgaaaatatttttaacaaatttaattaaaaaaatacatgaaattctatcaattaaaaaaataattaatttaaacttataaaatttatttatcaaaaaaaattaaattaaatataattttttatttattaactcaacaaaatattttaaattaattaaaatcattgaaaataacgtaaaaatgcacaaaaaaataatgttacaccgtccggattcgaacctgcccccccccctcaaaatgatgcctcagaatccccaatcacacggggattctgaggtcttgacgatgtcaaaagtaaaatctgatcacgtattcgtgatcagcggcccaaataacccctaaagacatatttttggaagatttttgtgagaaaaatttttccactcaaaaatcatgtgctcacccctttggtcccgaatcccaaaatcacttttatttttatatctttttttaaaaatgtgataaaaatgtaaaataaaatttatattatagagaaaaaaattgcggatttttgaagtattttacttttcaagaatgacttttcagaacggatttctgaatttttttctgaaaattcgaatttttccagaatttctggaataacttttttcatatttatgctagaaaatccatataaaacccataaaattctcctgatttttctctatttttaaagctttatttgctcaaaattggtcaacccttaggctagatatgaattttccaatattagcccaaatttccaagggccaaaaaattgccaaaaaataaagaatttttaaaaaattccaaaaattttgaaacgaaaaataaacatcatattcgtgctcagcacatcaaaataccccagaaaaatatttttgacccccattttcaacccaaaaaaaattttcgaaaatttctagggggcttagctcgaaaatttttgaaaattttacatcatgtagtacactattcgatagcatttaaaatgctctacaaaaatgttctaagacaatttttcgctaaaatcaacccctgacgagttatgggcctgggactgaaatgtcccgctcaggccaaaaaaattttctatttcccgggaaaaattgaaattttttcaaa

SEQ ID NO: 31070 - DNA, 1256 bp, Heterodera glycines
ggaaactttaacaatgcacaattggggtcaattgcttcgttgttgtcaaaatagtcaccccccgccatccccgaatgccgaactgcttggtcccgtcgaccgctgtccagcagaattgccgaacatattttgctgtgtaatgacttgggtggacgatggcattgtcaacattgaactggtggcagctgcaaagaaaatgtcggatggcgtggcggaggttgccagcggctgagaatggcacaactgatcagctgatgcggacggaagatagcctaaggcacaaaccattcattgtaaaaggataataaactgattaccgggcacaaggaattggagggcagcggtgagattatcggacgacgaagtggagggaaagtcaatgggcgggaggcctgggaaaatcattgtgtttccggcaaggggttaagccaaaagaaaaggaaaccgatgaaagggacggcactgatcagaaattggacccggtttagcgagaattcgcttagcgtccgttgtaagcggcgaacatgaagcggcttcgacgccataccgaccttttttaattgccatatttaacaaattacgccaattacccgcctcatttaatttctctttttttttgcttaccaatgacattatttccagaaattcctcctcgtcacattgcataatttggtcaatatcgtcaccgccttgtgagatgaaagtgtcgaaatatctcaaaagattgtgcaggtatttactaaattaggcacctgatggactgactgagtgagttttgcgcggtataaaactgcttggagttgccattcggcgagtgattgtgccgttcgcatgccggaaatcagcacggaggaagttggtctgagttgtaggatcattttgtatgaaatgagtgaaatcaaattctgattaaaatcaagcttatttgcacgtaaaacccaatttgattggaatgaatgtccaaattttgagaatttgcaaggaatatttgatcagattcctcttcaatggccacctgttgtttgtgttgttgctggtgttgttctgttgctgtgtgctcggcgactgctcattcattggcggacttggcgtcacatttggctgctgttgggccgtactgctcgaattcgtcgcgttggacttttcccccattttctgttgaattttcacaaatcaaatcaaaaaattttctgtaactattggaattatttttgtaaatattcttgtttaaattcttcaaattttatctttgtgct

SEQ ID NO: 31071 - DNA, 2354 bp, Heterodera glycines
  misc_feature (2275)..(2275): n is a, c, g, or t
aaatataataatgaatttaattttaacttaccgccgtgtcctaatgtaaaagtacgaccataaaaaacaggacaaaatccgcttcaattgaagacgaacgcataatttattaattaataaacaattaaaagataaacctactaaaaataaataaaaccgaaaaaaatttcctattattaatgatgaattatactaatacaataaataaatgcaggcttttcaactgatcgtaaatgtaaattttctgctttcgtgttcaattttattgcttttacattattatgattcacaaaatattccgcaccaatcgctgatgaaaattagtgcaaaatgaaaatgaaattgaaaaataaataattaaaaatggatatttgtaattgaaaaaatcaaatcaattaattgaatttttatttttatttaattttttactttattaaactatttttgttaattttgataaaaattctatcataattggtaattttttttgaatggaaaaacattaacaatttgtaataataataataataataattactagtgctgttcgtgaccaaaaatttcccgagactcgaccccgggactcgacaccgaaaaacccgagaattttctcgagtttagattcgagaccaagactctcgaacagcactaataattactaaaaaaaatacataaatttttttattttgatagaaaaattggctgttaaaatgtaaattttaatgaaaattgataaattttattttcattcaaaatccatccgaagttgctgcatttgcatgccaagatcagccttctgctccggcgaaagtgcttgtgacaaaaagtgccagacaactcgtcgaatttgtgcaattgtggcaccattggaacgagcacgggcaactcttaaaaaacaaaatgttggcgaaaatgccaaaattggaaaatttaaattatttaaataaccgcctatgaaggtgaagcaaatcggagcgggacaaatagcggcgaacaaaaagctgcaaaaatttcaatttttcaaggaaatatttttttgccattttctcgcaacaaaaaaatttaattcctatttaaaaaaattgtaaatgaaactgtgagtaactttagctttgtccatcctgcttagaaattgatcactttcttcttcaattggttgaattgctggtggcgatggattttgtgccggcgcaaaaatgccattattagcagtgccactgaccaaagcccaaatttaaaacattaattaaatatttttagagaataggcctattatcctttagagtcttaaaaatataataattaaaatttactaaggagtctagatttattagtcacggtccaagaattttacagctttttgcatgtcggacagaataaatttcgggtttaactgcattaaactttaaaatttaatcatcaattttaaaataagctttcttaacaatgttagaatttttataattaattttaattgaataaattgttttttttttaaatcgaaatacttcgattatttcagacggtccttgcggaaagcgtaaggggacgggcaccaaagaaaaatcattcacgggaattttaatgacaaaggtgagcagaaaataataaataatcattaaataatatttatgcaaataaaaatttaattaatattttgatgggagaagagaatgaatgggatggaagagaaactcataaaagaataaaaattccaggagaagaaggaagggtcattaaaggtaattaatacaaccaattagaaaggaggacgaatgattaataggaaaaatacaaaaattaaaatatttaaacattattactgatcaagaggataaaatttatcactgattgaattaaattattttaaaaaacaacattccgtaaatatttattaatcaaaattttaattttaatgaataataaatattaacgaattgtaaatttatgtgtctctaatcagtgatcactttttgaaaagattcattttcttaattgaacaaattcattaacaatttaattattttgatacaaatcttatccctatttatcgattccttcatttacaactctgatcagttataaaaaggcacttctaatcaaatttcctttttaatggcatttttatcttataattaaattaaataaaattcaaaaataaataaataaatcgtaaagtcccctattttgcaatatgccaatgtaatgctggctaatttttactctcgattatttttacagctgttgcttttctcggctatataatatttactanaaacataaagcaaaatagtatagggagataaagaagagaaaaagaaatagttcagcctggcatagaaaaagagaagcag

SEQ ID NO: 31072 - DNA, 1201 bp, Heterodera glycines
  misc_feature (46)..(46): n is a, c, g, or t
cagagacaagccttcgcaactggagaagagaatttaaaagaagatntagaatttcacactaaactttttccgaattccgatccgatttcgtttttttaaatttatggtaaagattttgctcactgccaaatgcttggagtccaatctcaaaatttggccacgccataaaactgctgaatgacctaatctttttggatcagaaaattgagtgcatcttttagaaagatttcttttaggaaagtcattcaccgtgtggctttgttggtgttgttgttgcgaaaaataaaaacaacccacaaaatgaggctaaaggctctgttctgacggaactgaccacttcctgccgggaagcttttccttctctgctaatggacatttaattatttttttatgtaaatataaaaatttgttgctgtttcgctaacaataataaatgggcgcatcaatgttcaattcgtataactgttggacaaaaaaacacttctaagaattggtgatgctcaagagtctcgagccaaaatttcgcatttatcaaacagcgcttaggtataggcaccgccgatgccccgcgttgatcaaagatttttggaaacatatgtagtgcggccggccaaaaattcttgattttacaaaaatgaaaaatatttttaaggaaaagattaaaattaacaataaattaaattactcaatttttttgcaccgagaaaataagccggttcgttccgttaaaatataagtaccggtcccggcttttctggtctcggcgagtcacggtcccggcttttcccaaaatttacggtcttgtgcatttctaatttctttttttttataatttgtatgtgactaatctaatcgctctttgatcagaaagcgataggatgagtttttacctccttaacaaaaaatatttggaaaaaagaacctcaaaaatccttatttctattgaactcatcagcttaggttgttcgagataaaaaaaaaaattgcgacgtgggaaacgagagcgaaaaaggattcataaaaagccccgccccctcgctttggctttttaatttccagaaatcactaataatgaaaaattacaagcagattttacgtgggtttattttagtgaatcaataaataagcaatttttttattttatgagttttattttctaatataaaaattttccattttcttattggaaagccaattattt

SEQ ID NO: 31073 - DNA, 2277 bp, Heterodera glycines
  misc_feature (1443)..(1443): n is a, c, g, or t
ctatcggacaaacaaaaagtgtactgtgaatgccaacacgggatggaagggcacattttgtgatcagtcggccgaaaatgcagagaaagcattgtaaaaataaatttaaaataaaaaaaaagtaattaaataaaacatttttagcaatcaaagctgtccattgcataaaaatcttaaacttttaaaatcatcatcagatggctcgtggggatgcaaatgtttgaccggctttgagggagaacagtgcgaaattgagcgaaatccgtgctcaaaaagtacaaattttgaataacatttcgataccaataaattaaaacaaaaataaaattgcattaattaaaaattaatctgaaaataataaaaatattatttattaaattgcaggcccatctccgtgcaaacacaagggcaaatgtgtgaacattggtaacgatcggtaccgatgcgattgtgccccgggttggattggcctgaattgtgaagagaatcgcaacgactgtgaaaaaatgtggcaaaaataataataacatttatatgcatgccctttttaattttattttttaaagtgtctgtgccaacggcggaaaatgccacgacaaagtcaaccatttccaatgcgaatgttcgcgcgggttcactgggcgccattgtgaagtgtttttctgggcaaaatatttatgaaataaaaaaaattcgaatttctttagacctcagtgcccgttgacaaattcaatcggaccgatgtgatggacaaggaaaactgcaagaaagcgggatgcgaggccaaatacggaaaccatcggtgtgattcggaggtgatttgttgaaaaatctggaaattaaaaaaattattattaaaacaataaccattgtgcttaattctaaaaaacaaatttggaaatttatttatttaatttagtgcaatttatttgcgtgccaattcgacggcggcgattgttccacaaaacaggcacaaccctttggcaaatgcccacaggcaagctattgttcacatgtgtttgcggatggcaaatgtgatgaagtgagtcggttttatgtcaccacaactcagcttatttttaatttgttttatttttcctatacctatttagcaaattaagttttaaatccgtctattttctgaattaagatttgcaacaacgaacgctgcttgttcgacggctttgactgtttggagcgacaccaggcgacgtgtccgtggatggtcgactgtgccaaagtgtacgcggacggtcattgtgacgagcagtgcaatcaggcgaactgcggatgggacgtgggtggacatttcgcgcgggttcactgggcgccattgtgaagtgattttctgggcaaaatatttatgaaataaaaaaaattcgaatttctttagacctcagtgcccgttgacaaattcaatcggaccgattctgatcactttgncccggttgtgtggcttctctttggagcatttacttcttcaaggaaatcgaaatggtcagtcagtcaaattctgatcaatttttaattaataataattttttttttcgtttttcacagaatctcgcaactctctgaccattttctgctctttcctttccgttttttgtggtgcttcgatgattttcgtctccaaatcgaaagttccgctcgacagactccaaattttctgactctacttaatttattagtgttaatatcaacaattaatttccccatgttttttgccgttttttaatcgttcggtagtggcggataaaatttctcaaaagaagagatagtcatttttcttggatataagataaatttaaaaattctctgagaaattaaatggcgatgcgattgcgcaccgccctccctctcacgctcgagcgcttttgtaacgtataaaatttctcaaaagaagagatagtcatttttcttggatataagataaatttaaaaattctctaagaaataaaatggcgattgcgcaccgccctccctctcacgctcgagcgcttttgtaacgtatacaatttctcaaaagaagagatagtcatttttcttggatataagataaatttaaaaattctctgagaaattaaatggcaattgccgcaccgccctccctctcacgctcgagcgcttttgtaacgtataaaatttctcaaaagaagagatagtcatttttcttggatataagataaatttaaaaattcttctaaaaataaaatggcgatggcgcaccgccctccctcttccgctcgagcgcttttggaacgtaataaaatttcc

SEQ ID NO: 31074 - DNA, 1152 bp, Heterodera glycines
atacacgccgaagaaaacattgagtctctaatggttaaatttaaaatatgtattttttcgctaagttcggccagaaacattcgtcccatttctcagcactgtaattactgaatgaaattcaattgtcctctgacggattgtccggcggtgcccaaaacggcgccggacgatttttttttagacattagctttgttaattaaattcaataatttactaaaatattatataatatttttttaaattttcaagctaatgagttttccaagtgctttcgaaccgtatcaagtatttatgtataatttgaatgacaatgaaaaagttatggccaaaaaaatcatctgcgaccatttgtcctgctccgattgtctgggcatccccagtccaattgtcatgacattttgcacattcgaaagtttcctcttacttttattcgacttttctataaaatttcatccccgaatcaaatagccgtcatacatgacattctttaagaattaagcaaccttctctgataatttggtcggaaattcatccctggcatttgggaaggaatccaaattaaaagtttaaaatcattgaatgtttttcaattggccaaactaataaaaaaaaataggcggcattcaaatgccatcatttttctttggcatgtgccaatgtcatcagaaacccttcccaacttttacggggagaagagcggagcagggagtgggggggggggggggagaccaaataacacaatttccgttcctcaatttgccccttccttttgccccatggccggatggcaaattcgtcatccttttttggccaatttcgttgtgccccccccccccccgggcacaacgaaattcgatggcacgacaaatttagttgtgtggtgccagcgaagaagcagggccggatgacccctcaaagggatggcaattggtttttgtggttgaacatttggaaaatttgggggggggggaggcgggggagaaggagggccaaaagatgggacttccccacttcacacttcaaaatgtgtccatttacgggaggagtgaggggggggaccgcaaccgaacggacatgacaagttttgagtcgagattctcaaggcctatttggcaattaaatttggaataaaagcgattgggcttgaattt

SEQ ID NO: 31075 - DNA, 1087 bp, Heterodera glycines
aattttaaagataaatagagaattcttagggctatcgaatgatattaattaagtttggctcaattacattttaatttttttttccaaagcaattagattaaattttctttttagaatttcaagtcctctatttatcttttaaaatttcaaaaaatttcactgggtttcaaaaaagttccggacaaaaaaccgactaagattttgtggaatttaataaacataacttattttataatattttcaaaattttcaaaattattactctgatagagaaaaactagtactattgaatgacatcatgaaataataatttgttgaaattgagccaagatacgaatttatatgttgtacattttttattttcctacaacttggtagtttttcaaacaaacgacctagcaccctttattttctatttgttttttttactccaaaataatttttaataaaatatttagccgtttccgtgagatttacatagtagcaaatttaaagaaattttttgaattttttttttttttggtttacggaactcgctcatccaatttgtccttatttataaggactgtgtccttagtcactgattgattatcaaaaaccaggaaataaaaatttgagctctcacttcatcctcgcttatggacgccatcagcccatcattgtttttgtcctccaatttttcgatcgctttgcgcatgatcagtccaaccatacggcggttcttcttcgcgtcccatccggcctgtaaaggataattcttgatcaagaccaaccccgtcttgacaatttttgatcaagactggtcaaggccaaaccccgtccttgacagtttttgacaagattggtcaagccaaacctgtccttgattgatcaaggctgaccaagcccaacccgtccttaacagtttttgatcaagactggtcaaggccaaacctgtccttgattgatcaaggctgaccaagcccaacccgtccttaacaatttttgatcaaggctgaccaagcccaacccgtccttgacaatttttgatcaagattggtcaagggccaaacctgtccttgattgatcaaggctgaccaagcccaac

SEQ ID NO: 31076 - DNA, 1188 bp, Heterodera glycines
ttttttttttttcggggcagtcccccggaaccgatgcgcccagttttatggggagaccgaatcctccgggaatagctcccctatagcttgtacttaattctgcgttgatttttgctccccataattgtttgagtcccacaaccggccacgtgaaaaaatcgattttttgttttcggggcagtccccccgaaccgatgcgcccagatttatggggagaccgaatcctcccggaatagcttccctatagtctgtactttaattctgcgttggatttttgctccccataatatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtacttttatttctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttcccatagcctgaattttaattctgggggtgggatttttgctccccctaaattggtttaagaaaccccaaacggaacacttgaaaaaatccattttttttgtttttcggggaggcccccccaaacc

SEQ ID NO: 31077 - DNA, 1516 bp, Heterodera glycines
  misc_feature (13)..(13): n is a, c, g, or t
cccccccccctcncttcccttccccttccccctcatattccgtatcaattttccgatttcaaaacataatattgcacaaatgtttagcttctttcaaagatttgtaatcgtaaaattaattaactggcgctttaatacaattggcctgttttttgaatctgtttttatttttgattttctaccttgagaatttttttggtgttgcacagttaaaatccaaatatgagtatttaaaaataataaatttgtagaaatttttataattattatttattctgtcaaatgaatttgattgctcaaaaaacaaagaatgtctgttgatgaaacaattcgcgagttgagcgggacactcactcaactcaaaatattagtggttagtcaaaaagtgtttttaaattaaattgtgacgccgacataaaaaaaatgaatttttaattatttcaataattagaatttccaaaaactggcataaaaccaataaaattgtgttgaattttttgaacaaaacatttattaatgataaattctttaacagggtaaaatcaatgagcaaattagcggtgtcagtgcccgaattaacataacactgcaaaactttgatgactcagtggctggcattgctactgatgccaaccaaatgacaaaacaggtggacaccaccattgaccaggtgaaaattggtaaaaaaccaatttaaatcacataatataaaaatgggacaaaaatatttgaatttaaattgattactttttcaatatcgcacgcataaacaacattaaagttaagaaaaagcagctcttgaaatattagggttcattattcataatttgaaatgtaataattggtttttcgaatttaaaaacgaaagaaaaaatgagacaggactattgaaatataatcacatcattaacacacttatagagttttgttaatattattgtgatagaaaacatagaatttaatttaacgaattcaaataaaaaaattttacactaaattattgacaaaatagaaaatctgagtttaattaagatccctggttcctgggccttttacacgctgttttttgcgctaattgccgtgctcatccttctctcagtgctcatcataatcaatttaatcataaaaattcaatcattttacggcacaatgcgcgggggctcgtcaagtaaaagccatttaactattttaaaattataaacattaatttatttaggagcgtcgacgccgcttcaatcgctggtccaatccgagtcaaagcagccgcttcacacgcaacaaattccagccatttatcacgggcacattccaacagaaagcaacaagcagattgagggtgggggttttgaatggctcaactgatgcagttcacgcgaccaaacaatgagtatattccacaggttcttatggatattttttcttactttttataaactatttcatttttggaataaccaaaaacttgaaacccatttcatatttcaaattttggggttaaggacaataaatttaaaaa

SEQ ID NO: 31078 - DNA, 731 bp, Heterodera glycines
gggtgaatgcagaccagatacgccagctctgtccgtttcccctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcaaagcattggtgcgcttgagttacggtccgtaaaacgcgaattagaaccacaagttcgcgccagcacaccaaaaccccacagccgagctgagcaagtaacgtaagaacacgtacaagtacatgatcccacgaagcaacgcacaagcagtgcattttatggtaacgaccctgaaccaggcgtgccaatggatgtaactccaatggcgcaatgtgcattcgaatgtt

SEQ ID NO: 31079 - DNA, 863 bp, Heterodera glycines
ttctgaaaatttttcaggtcatttcttaggggtgtattctctagaggttattgcatttttaatgtaatttttcggtaaaactcgccaaaaaagacaccaaaacggcaaaatgccaaaaaaggcattaaaggcacgaaaatcccgaaaaaggcaaaaaaaaggcataataaaagtcaactttgaagcctcaaaccaagtggaaaatgtgttatttatgcttaatatatcgaaactaatgcgcagaaaaaaggcatttgcctcaaaatgcggtctcttgctatgacgttactcaaaaaccatcaaaatgagccgaagttatgaataattttctgtcaaaaatttttattttgacccggcacccaaaataaaatatttttgaaatgaaatgcagtaaaattttaaaagtgcttcaaaaattattattattttctcatttttcttcgttttgtaaaaaaataaaaaataaaccaaacttcaaaaagtagtgaaaattctcaatttctgaaccttgaatttgattttcacataaaatattaataattttttaaattttttgctcccaaagataaaatttgtattcatcaaaatagaaaatttaaaaaatatataattaaaatttgggtacaaaaatgtggtttgcttactcttgctgtgaattgccccgtcggattagctttttggcccggctggcaccactggccatcatttctcccgcggtcataacaccggcggcagcgctggcaccagtgccagtgccgacgtccccctttgtgccaccgccaccgaccaaacggcgcaacgaaccgcccatcatggcaccaccaccaccactgggttcggcactggtgctgtggtgcttgcgc

SEQ ID NO: 31080 - DNA, 1247 bp, Heterodera glycines
  misc_feature (38)..(38): n is a, c, g, or t
gtcgaattttaaaaaatgccaaaattttgggaccaaanaatcaatcccgggtttttgtgagtgaggggtttcacaggtggctaaattaccgctacaaattggtgtgccaaattggcaacccaaccggaaaccagtgccaaaaatcaatttaaatgattcaatagcaaaacccgaatttataggtataattggaaaattattttttatatttcaaaagcccagcttgaatttgtttttaaaaaaacgtgatttagacttcaagggtatgtgctccaaataccctactctactggttaaactgatcattgggtcccaccaacaaataaataaattcaataaattatacgtacatgccaacccaattcggcactgccagtcggtcgacaagcactcggcccaaatgtgccctggcataaaaatttgtgcggggttcgccgccgtgcagcagcagcacggtggtgcccgccttctccgccaagcgctgctgctggtggtggtgcggaggccgcgcattggccaacgccggcggcctaatcgtgggaggagaagcggcagaaaacaacgcaatgggcgaggaggaggaggaggaggacgaagctgatgaacaacgcatgacgatgtaatatgggagaggggaaaacatcagtagggagcagagaaggctgtaaaatggagggccaaccaaagaaagcaggcaaatattgattgatatgggcttaataggtattatatcattatcattagctctaaaaaatattattacattattcagactttgtgctttcgaatgctaccaaaaagatagtgtttgttcaaacatgaacaaagttattgtatttattgtataaaaacccgggattgtcaattgattggactcataaaagtcaattggactcataaaagtcgcttggactcataaagtgcattagagcccaatatttttatacaaaaaaggggggaatgggaggaatcaatctttgtgaaggaatcggcggcgctatttacaaagaggagtcttttgaaaattttttcaacttttttttggtcaaaatttttttttgtttaaaaagtcctgaaaccaagtacccgggtgttttaaaggtcgctgatcacgaatatgacaattatttgggcctattaagcaaatttggcgctagttataaagtgatagattttgaattttatcaaaaaccataggggggacccttttgttttgtaaatttttttttggataaaaatcgtgaata

SEQ ID NO: 31081 - DNA, 1857 bp, Heterodera glycines
cgcaacaaagtgtggacttgagttgcatgacgtttgccaatgctggactagaaatggacgaagctgagcagacgatgatgaacaacgaagacgaacaaaattgtagcgatcaacccattgttcaacggacaactcaagacgaatacgtcgtctctgaggattggccaaatgccaacaatgttggcacaaaaaaggcacgaaaaagcgaaacaacaacaacaagaaggacaagcgtgaaattgactgctggccaaaaggcattggaggtggtggcgagagttaattgagttatgccatgacaaacagaaattgtctcgagagcagctctcccccgccccgcctatcatttccaccctaaaagcggcttaaaaagggaactgaaaatttttataaaaaaatttaatgaaaaacgcgttgaaaatttttttagcgattttttggacaaatttttgaaaaaatttggtaattaattattaaatttacaaatttcaacaataagaaaaaacaattttaaaagatttttctcaacttgagtgagcctattgaatgcgatttgattgaaacaatttttgacggaatttggtaatttaatgaatgatgtggtgaccattctgcaggcattctcattccaacggcttcgttctgctgctggtccatcatcaacaacaattgaaacttctgctgttgatcaccttcacactgaaccgcaacaacgacaacagcaacgaacatttgctgatcaacaaattcagaacgaacacaattttggactggctgatcaaatcattttaccgaaaaatgaaccaccaaattcacaaaattcggtattttcaaaacagtttttaactgttttatgggccagtcaaaaagaaagataatttgttaaatggcggactcttattgcctttaattttcccataagattcaggccaatgcaatttttggaattttgattcaatttaataaaaatttaaaaaaatcataaaaaaaaattgaagttggatcaaaattaaattattcaggaccgaaatttgcatttgcctgaaacttgttggggacacaacaccttcaaatgaaatcaaaaacagtaaaattgattggatccataaaacagagggaagcaataaaactaatttccatacgatttaattgactactaattgttcagcagcagtactactacgattctgcagcagacgattgttgttgtccatcaacagcagcggaggatgaagcagttgctgctgttggctttgaatttgttggtacttccgccgctgctgctgatgatgaagaatggggttgtacttctccaccaatctcatcacaacagccaatttcacaatgcttttccgtcgtcacaaacacatcggcggcaacaacaagttgctcacaaatgacgcaacaattcatttatgatgaagagcatgacgaatttggtgatgagattgatgataatgacgatgaagcagcaacagcattgtcgtcgtcctcctcttttcgtccacaacaaattgtccatgtcgacatggatgtgttgcgcacaaattttgcacatcgttgtgaacagcagaggcgacagcggcgggagcacaacaatttgttgcggcaaagttgtggaggcaacgatgacggcggcacgcggttgcacgttgtcacaacttctgctggaataatgtcatctggaagtcaggaggaggagagggaggaagacaacgcgtcggtggaacaacgcttgtcaatgatgctgaagttggtcaatcattgatagagataaagggcatgaacggtggcacttcgtcccccctaaaaaactttaaaatttcaaacatggaaatctttcaaaaatcttattgt

SEQ ID NO: 31082 - DNA, 1234 bp, Heterodera glycines
atgattattatgatcattatcgcctcaattgatcaattagtcttcctctcggggaggcttcttctattctaaatcaaagccaaatgcaggattttaatctcagaaaacaggtcctgaaaaatttcaggctttaaagttagcctaaaatggatgctatcaaacggctaggttcgtgacttgcttggtaaaattttatcagtgtttaatcatcccaaggagttgattagatttgaatgtggtcagtaaaccctaagaagcgagactcgcgcatttattaggtttggtgattgggatttggtgtccgattccagctcatatttgctggcccaccttcatggcggcacaagtgccgtacggtttgaactcgggcgtcacgctgttctcctcgttgagcaccttctccatgtctacccaaatcaaatccacccgaggcatcattgtgaccagacagtggcgacggtactttaaaaggatggaaaagcaataaaattaaaaggatgaagatgaaaaaactggtacaaagatttcaatcaaattttgacattttttggcaaaatcaatgatttttaaaatctgaaccgaaaccggtgatttttcgaaaaatccggtttgaacagtttttgagaggccgggcccagaaaccggtcgtttttgaaaatgcctaactggcccggaaccggctatttttgaccgtttttgaccagtttatgatccaatccagtcaaaaattattcatttttatacattttcctttgaaaatatctctttcgaaaattttggaaaattttaagcgatttttcaattttatgatgaaatgaattacttactaagttgttccaaaaatataattcttttaaaaaaaactttaaaaaattttttttgaaaaattttgaagtttatatctgaatagctcatttaatgaagcctgagtgaaataaagccgaaatttaagagcaaatcgaatttttggttaatcctaattgaaagcccgaatccactcgcctcgccgaattaataaatgatggccaagaatggcatggcacccctctcgacctaacaaaaagtccgtctcacctcaaagtaccgcttgcacaggtgcttcaacttgtgtcgtagaaatccttttgtgaatttattgtttattattttttttaaatattttttattttttactttttgttgtttgcacacggtaataaaaggaaggtacggtacaacactttttggcactgat

SEQ ID NO: 31083 - DNA, 976 bp, Heterodera glycines
cccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcagttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcagttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaattccagaacaatagtatcggcgtaatattctgagaatggcggtggaattctattactggtgagcagaaaagagata

SEQ ID NO: 31084 - DNA, 918 bp, Heterodera glycines
cgtacccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggag

SEQ ID NO: 31085 - DNA, 1101 bp, Heterodera glycines
taagctggtgccgaagcgatatccggaatcattggaaattgcaacgatcagtgagatcaaccggatgatcaacagcatgtaagccgggagaagggatgcaactgatcagatggaagggcggcatatatcaaaaggattgctcataaaatgtaagaggggcgagcgatcaaattgatcagatgaaggggctctgcatataccaaactagttaagggtaattatgatgagacaaacaaattccatgctgataaaatgatcagaatacttttctgatcccgaagaaatgggataaaattagataatatcgtcatgatccgttgggtaaaaggttgatcacaagaaattaaaatcgaaaataatgcccccattttaaatccaagtattgcaggggcatcgaaggcgcaatgaaagatttgatggcggtcggcaagaaaatgttcggctgtacacgcaaatgcatgagcagcaaggcgggcaactgcgagaagtcgctcaggtggggaacaacaattttcgttttgattgttcagaccgacaaagaaaaacaaaaaaaaagacgagacttttctagagcgagacagaaacaatgcccaaaaatcaacattctgacattggaattttcatttgctttgtcagtggcattcttctgtgttctgttttccccccaaaaaatgccgcatcaaattttgaattgccatgcccaaaaacattgcctttctccgcacattcgtcgttttgtgcaggtgcggcttgaacttaccgccggacaacgtgttggtccagcaggtgaagcggtgcgccatcaacagcggactgaacaccgccaacgcgaaagcgatgtgcaaatgcgcgtccgccgcgggcgttaagtgagtgtaattttaattatttttggtttgtcctcgtaaaaaaaacaattaaatttgattttaattaagttaataatttggttaaataggatgtcactgatcaacagtgactcaacagtcatattcataacgcaatttgtactaattgcctaattactattttaattctttccagaaatttgacgcctgccgtctgcgcaaagatccgagtcacctaaactaaacatgatcc

SEQ ID NO: 31086 - DNA, 1228 bp, Heterodera glycines
  misc_feature (156)..(156): n is a, c, g, or t
tagccctttttttttggagggaattttttaattttatactttatcccaagaaaaatgtctatcttctttttttgagaaattttatccctcacaaaagcgcttgcgtatgagacggaggggctgtgcacaatcgccattttatttcacagaggattnttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctcttttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatac

SEQ ID NO: 31087 - DNA, 1329 bp, Heterodera glycines
  misc_feature (15)..(15): n is a, c, g, or t
  misc_feature (24)..(25): n is a, c, g, or t
  misc_feature (50)..(50): n is a, c, g, or t
  misc_feature (106)..(106): n is a, c, g, or t
  misc_feature (130)..(130): n is a, c, g, or t
acaacaaagaagacngaaagaggnnccagcaaaggacgccgacagcaganaacccccattttaaagagaaccccaaaacaccgaaggacgcaccaaaaagcaaagncaaagcgcgctcgcgcaacagagnggaggcatccgccatctgtgttttgctttaagccatccaaaaatcctctattaaagaagacaaaatttgataaaattacatttgattattttgatcatcattctgatcaaaataaatttctttcattctcataaataccgtatccaattactcattgattttgttttttattagaagaggtttaagaacaaaaaataaaagtgataattgataatcaattaaaattaattaacataaaaatacgagaaaaataataataaatagaaaaaagcaattaaatgttcttagataaaaacaaaaaattaataaaataagaaattaaaataaacaaaaaagagaattatgtttccatacaattaaaataatataataaaattgaaaattaataattatgatgaaaagttttaaaaaacataagcagggccctgactttctattttttgcccattaaaacaatttttgcagcgtttgactgaaattttagcttaaatatttggcaaaaagtattgttattgaaacgaaaatttagtcacattttaaatttaattattaaaaaataaagcgtaaaaattttggtattttcatgttaacataatttttaatattttcgcgtatttcttttccaaaatctgaaccctgcttattaacaaaagaaaaaaacgatgaaaaaaaagattaattaaaaaaatccacactttccactcttcaatcactcttatcattattttcttccacctaaaaatacaaagtgacaaagagagagaggggaagggggggggggggcgtaagtaattcgctgcacttacccaattgttttgcctccttctcaatttttaactgaagattctcgatcgtcagcttttgagtctcgatcgtccgcttttggttctccatcgtcagcttttgagtctcggtcgtcagcttttggttctccatcgtcagcttttgagtctcgatcgtccgcttttggttctccatcgtcagcttttgagtctcggtcgtcagcttttgagtctcggtcgtcagcttttgagtctcggtcgtaagcttttgagtctcggtcgtccgcttttggttctccatcgtcagcttttgagtctcggtcgtcagcttttggttctccatcgtcagcttttgagtctcggtcgtcagcttttggttctccatcgtcagcttttgagtctcgatcgtccgctttt

SEQ ID NO: 31088 - DNA, 877 bp, Heterodera glycines
attagtaccaattcccgttggtattagcttttgcaatgacattaataaggctcaaggtcaaacgattgagaaagtttgaataaatttgaggaaatgtgtgatgaaactaatttgtaaggtaatacgatagtcccttcgttttaatttgaaaagttttttattgcctatttggcgttatgcccaattttttaaccaaaaagcaataaaaacgaaaaatacattcttaggaattgaccacaaaaatttcagaaaaatacaccctttctcttattcgtcatgcgctcccagttttattaattttttttcttttgtcaatgcaatgataaagcatagaaataatcggctttactttaaaaaggaaaaataaaaatccataattcgcttctatttcaattgttaaattgataaacgattattataatactgtacaacaacgtaagaattcttcatgcgtactttacgtatcgacatcaataaggaaaagaaaacaccaattattgttgaaacctatgaagcactggaagcacttagcacaaatcgcgcccgaaatcgcgttgccgttgttgggaggacaggttttatcaccctaaaataattgtggtactttccgaattcaaggagtaattttcacatacatttttaaaacaccaaaaaatatattatacatacctcttcgttcagttgcaaaagttttcgcactgaatggaaatcgggtggaattgcgcactgaacgaagcaaaccgcgcacggcgatgtatttttcgggaagcattgcttggagtccattgagaggcaagcaaaagtgtgatcatattcagcgtatttgtcagtgactcaaaaaatccccgtaaatatttttataaaaaattttttaatt

SEQ ID NO: 31089 - DNA, 1181 bp, Heterodera glycines
attttttcggaaatcggaattccgaccccaaaaatgtcggaagtcgtaaatcggaattccgtgccatccctgtgtgcagccctgatttggaatcaaaatttcacaatttctttgatttttcgatttttctaaattataaatgtgaattactggctgttttttaactcaaaatttgttttccattattggcacaaaactttacgattttaatgtcaagcggaattaattatttatttattttttttttttgcttaccgccccaaagtcgtatttcttgcatttcctgcagccatcaattcatatgcaaaattggtgtcgatttgaaaatttcttctaattgcataagccaatgcgatgtaggttaaagatgaagcttaacaaaaactcgataattaaaaatattttttcagcaaaaaaaataacgaagaaatttctagaattttgttcatgcgattttccgactgccggactttccacccatcagaaaacctttgaaaaatagcgtagaaaattcaggattagaaaatttttggtctccagtcccaccctctgtggattttaattagctttaggctcaaaagttgtgagcggctccctgaaaaggagtctttttgggccgggcactaagctcatggcccggcactttcaaaattttgacctctaaaaagtatccaaatatctcaatcaatcataaaataataaaatatgaataaaataaaattattagataatcttatagttcttacctgtgtcaagtactataagtgataaatcgctgtttatgttgccctcaatagaagcaattcctccataaaggttgttttcaattggcgcagtattgataagtggttggaattcggctgaatttacccgttgaagcacgtagacaagaggctaaatatagacaaacatagactaattattagtaataatactttcaaaaaacctaggataaaaattgacaccaaaaaagaaattttaaggacgacaccaaaacagcgaaaaaaaaacaattatcattgctcttttcggtgatattcagacgtttttgttaattcaaatgtatttatcctttaaaaatttaccagataaattgaatttgcgcggttcgaatgaagggcattggtcggcattttggcacgatcgatttggcatttgttcaactcgcgcaactgaaaaat

SEQ ID NO: 31090 - DNA, 1378 bp, Heterodera glycines
atgtcaccgccgttttggatgcaatgttacgcatcaaattgtccgttgtgcccggcccgttgctcagcgtgttcgtgcaaaacattgccaagctgtacaccttccaactgtgcaaattggaggcagacgacgattgggacggaattgaatcgttggacaatttgctcacctccaaattgcccgagtaccaatacactgaccatttggaggcgcaagagcgggtcagcaacaataattaatcggtgcaccccaaaaactccgccgggcaaaaaaatttcaaacttagaaatttttcaagaaaaaaatcaccgacagcgcctaccggcaccgggatttgaatccaacccagagaatcaaatccctattatatccggatcacattcccggaaaattttggctgggtcccggtcccgtaaggcttctaaaaacaggaaaatgtaaattctcaaaaatttgtaaataagcaattggattttaggcttcaactaatttttagaatcgtaatttccatgtttttgaataacagtttttacaacacaacaggaagatgaggtggacccattccaattggcagaacgcttcaaatccgctgggtttgaatcaaacggacgacaccaccagcaacagcaggagggcatcaaagaagaagccgaatttgtcaatatgaataaaaacaacaacaactggcaactctccgccacactgtcgtccgcggtgcgtccgctctcgcatttccgcgcattgttccgcttgcttccttctttacggcgcgggcatccgtttttggcacacctttccgcgcttgcgcccgactcagtttttccacccgcttcatctcccattcatcgcttttccgcttcaacttgtactttgcgtgttgacaaagtttgtgcacaatgatttacaatataccaaaagttatgaacaagtttgtttttccttttaagttgctcttttttttcatcctgtgttcttgttttactactgtctcttctgccgatttcaacttccgtgtatgtagggagttttaaacgggtgcatttcttttccattaccccttgcatattcacagaaatttattggcaattttttaaagattttttatataaaaaaaatttttttttttttgtaaattctatgttagtaaattttaaaaaattctcaagaggaaacgaagcgggcgcaaatgagctgctccctttttaaaacttcacaataaaaatgtcttttctttgctcaggaaattgcgttggaaaacaaaatcaaggctgatctatatggagtgaatttatcttttacgtatgcccttggcggattgactgtcgcactcacgacaattatcattggaattatctgcggcctttacaatattctccac

SEQ ID NO: 31091 - DNA, 1051 bp, Heterodera glycines
  misc_feature (1004)..(1004): n is a, c, g, or t
tttttatttttgacattttttatgagttttgttttataatttcgtgggaagagaatgaaataggtgagtgggggtgagaaggtcgcccaaaatcactttaaatttgcaaataccttgcgctttttgggactcgtccaccgtaatctcgcggataccgtacaacgcacgagcagcagccaaatttgatcggtttttaccaaatgcttaaaatgaaaagtgaagaatttgtgtccgtttttaatatgtttttatttttcgcacccagtcccaagtaggccaacgacacttcgatttccaccaaaaaattggcgtcgaacatgttggactcaaagttggtgaagctccatttgctgttgtcctcccttttgcgcaacattttctgcctcagtcggctgttctccacaaaagcgtcggccaacattcgcactttttcaacggcagtcgaagaaaaactctaaaaaagtgaaggaaaataattattatttattatttcaacaaatgatggaggacaccttaacaattaaaacgggttcagtgtcagtgtcgtcaacttcgatcgaaatctaaatcagaaaattcaacaaatgtgccaaagtgaaataaaataaatcattcagaggaggacgcattatttacattttctgcactttcaattttacatttggcacactctccagcagtgactgaaatgccccattttgtgatgcgtttttgaaataggcgagcaaatcggcgggaaaagtgacgcacagcgatttggcagaagcgcagtgggaacagaaggagggagggacgggcacgggttggttgtcgggatagaaggcggagggcacctttgaacacaaaagaaaaccaaatttgggtgaggatcggaccaaaaattataatcaaacagaaattcaaaatcaatgggttatgtggcatctaatataaataggaaaaaaactcaaatttagtttttttttttatagttttttgtctggggaagggataagaataggganacctatatggtcttgattgtgagcatcaaggtccaacaaattaattt

SEQ ID NO: 31092 - DNA, 1867 bp, Heterodera glycines
  misc_feature (1845)..(1845): n is a, c, g, or t
  misc_feature (1857)..(1858): n is a, c, g, or t
tctatatttttgccatttttgtgcaaaaatctattaaatacaataaatttttaaaatttgcctaggcggtgcctatcggcataatggaataaaaattggaagtttcagcataaaaatagtctaattaatattttagtaggatagggcacccggggactcttcccccgaccacaaataaattaaaaacgctagatccaaataaaccaaaatgtttaatgctaatttggaaggattaaaatacgtcatgcaaaataagtttcttttcaaaaaaatccttatcctcagatgcagctagtctacatccaatatattcatcaagatgaacatggatgcgataaaaatgctaattaaaagtaaaaaaataactttaaaaagaaactaattgttattaaaagaattacttgctgagggtttttattagtttttatcttttttttaaaaaaaaagtttgtaaatttgagatgttaagaaataattaaaaataaagtgaagaaaaattagaaagaaaattaaatttattaaaaaatgctaacgttaattgtgatgcagttttactgtgttcgagaattgctagagtaaaccaaaatcccttttacttacttccaatcagcaggaaggaagtgatctagtgatttgatcactctggttttcataattttttttcttctaacttttccaatttttgtgcttttttaatatttgttggacaggtatgcttagcaaaaaaaaaatacgtaaatttttgttaccattaaaatctcttttttgttatcatcaataactacttgattaacatctttttgatttgattacataacttgaaaattttctctcaagaagcaatagaaaataaaaaaatgtgcgacttaattcagcaaacccagtgccattcggccatttaatttcccaggaatttttttttttgaaaaatatcgtactgcaaaagaaagtgccaaaaaatcaataaactattatagtttttatcaaattttaagatagaaaacttacaaaaaatccgctttttggatcatatcttctgaatttcaaggacgtttgtactaacattaataactgattttccgattttccctcttttaatggtcactttttgcactatcgttcattaaaaaagagaaaattggtgaaccaattcaaattctcatgtcatttactttgcccatattctctgttctcctctctcccactttttgggtcatcattttgccgtacatttatttatttatttgtgtcgaccctataaatattggcaatcaatcagcagtaagccattcaaaatgcacacccatcatattaatacgcttacataaaaaaaattattttacaaataaaatttttatcattttagaaattttttgaaaaaaaataaatgtcaacttttaccaatttgtcaagcagcagcattttcacaccagcagaacagggtaaaaaaaagattaattggcaaagaatgggtgaacaaaatatactaattaggctaaggatttatcgttataaaaattcacagagtttgaacaagtttgatatagtaagtgtcgaaaatttttggaattttgcaggcacttagtccttatgccaaaatattttccttaaatttaatgccattctgaaacgatgaacaaagatacaatatcttaaattcatgagatttttgtaacgttaaatccgtcctcatatatcattgtaatacgtttgtgtgaaataataactagagctgtaattaaagtcatttctttaaaaaattagaataaagaaaaagttttccggcttttgcttggattttcataaaagttgtccgataagtgggaaattactttttacttcctnaagacctgcagnngccatgcaa

SEQ ID NO: 31093 - DNA, 1120 bp, Heterodera glycines
  misc_feature (1059)..(1060): n is a, c, g, or t
aaaaagactttacaaaataatacccctgggagaagggagtgggaaacatgatttcaaaatttttaattttttctagtctaatctactcaaaacggttcagaattcaataaaaataacattcgcggtgcgaaaaatggggtttaacaagtttattgggggaaaaaagactttacaaaataatacccctgggagaagggagtgggaaacatgatttcaaaattttcaattttttctagtttaatctactcaaaacggttcagaattcaataaaaataccattcgcggtgcgaaaaatggggtttgaaaagtttattttgaaaaaaacactatacaaaataatacccctgggagaagggagtgggaaacatgatttcaaaattttcaattttttctagtgtaatctactcaaaacggttcagaattcaataaaaataacattcacggtgcgaaaaatggggtttgacaagtttattggggaaaaaaagactttacaaaataatacccctgggagaagggagtgggaaccatgatttcaaaattttcaattttttgtagtctaatttactcaaaccggttcagaattcaataaaaataccattcacggtgcgaaaaatggggtttgaaaagtttattttgaaaaaaacactttacaaaataatacccccgggagaagggagtgggaaacatgatttcaaaatttcccccccccaaaaatatcatttgctcaaaacggttcagaaaaaaaaatcgtgccccttccccgtgccgtgcgtggggtttctcccgttttctgcggcctttctcgccttttccccctcttccccctggggggggggggtgggtgccccgctttccctcttttcttctttttcttttgctttgtgttccggccgcgtttcggcttcggttggtgtttccttcccggtccgcgcccccggggtcttgctgcttttttgggggggtgcgaagattctcccgctttttccctctggggttcgggcgtgggggctcccgttttctctctttttgttcttctctttgaagggctctgtccggccnncggggggggggcggtggccctcaacgaggccgcgaagaggccgagtgagtaccttcggtg

SEQ ID NO: 31094 - DNA, 1217 bp, Heterodera glycines
ttgcggtcaatccccccaagagaaaaaagagatagccatttttcgcaaagaatttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggaaaatgttggtaccaagtttgcggtcaaatccccaagagaaaaaagagacagccattttttcggcaagaatttttttcgttagcatttcaaatatcgtgtgagtgtttggtagagccagactagagaaggaaaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgtttgcatttcaaatatcgtgtgagtgtttagtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggaaaatgttggtaccaagtttgcggtcaaatccccaagagaaaaaagagacagccattttttcggcaagaatttttttcgttagcatttcaaatatcgtgtgagtgtttgttagagccagactagagaaggcaaatgttggtaccaagtttgcggtcaaatccccaagagaaaaaagagatagccattttttgggcaagaatttttttcgttagtatttcatatatcgtgtgagtgtttggtagagccagactagaaaaggaaaatgttggtaccaagtttgcggtcaaatccccaagagaaaaaagagatacccctttttttggcaa

SEQ ID NO: 31095 - DNA, 1109 bp, Heterodera glycines
ggaatcatttaactaaatattaaaattaaattaaaaacccgctatttctcgcctaaattttctcattttttgtcggccaaaatttttccttttttagtcccttcactttttgggactttttgcaacagcggcgccgctggctgcagggcatttaccttaccgtacactccaaattcattccgttacggtgcaaaattttgttggccagctcactgtacgcgtgggtgaccatgccgttgaccacgctccaggtggaggaggagggcaaaaaataaatatttgttattttttaaaatagcaaaaatttagctttattcatttaggatttttggtgaaaatttcacaaaaaaataatttttataaaattattatcaatttaggaatttttttttggttaaattttatttttttttttttttttaaacaaatcaaatttcaatattttcgacacaaataatcgtactattctattttttaaattggtttttaaaccaattttgagaatgattgaaaaaaaatttctttttcaaggctaacaaaattcatggaatgtgaaaatggttccgagatagaaaatatgtttttaaataattattttggcattttgttttattttttttgcagatttttctcagcccctttttcccactgccgcgctcctttctgttcgactttcttgttgtttttgttggggcggtcaacctttacatgtacatatttggttggtggaaaaaaagattttcaaaaaaaaaaatttttttttttaaatttttccattttcatccaggtgtgatcaaatcattttctcacaaatacaggtgtggcatattgtgaaaaattaaacaatatatacctatatattaaaaataaataaatatttagaaacgaaaaaataaattacaaatttttctttaccattttttaaaggttttttctagaaaaaaatagaaaatgtctataaaaacgacaaattatgtttctttaatgtttcttaattcaaatttttcaagaaaattttattttgaaatttgcaaaaatataatatttttattatttctaaggccgaaaatgtttctagcccccccccccctaaaaattcttcctttttt

SEQ ID NO: 31096 - DNA, 1277 bp, Heterodera glycines
gggttgttgttgtttccttaccaccgtttccttaccaccgtttccttaccaccgtttccttaccaaccgtttccttaccaaccgtttccttaccaccgtttccttaccaccgtttccttaccaatttatttggttcatttccttaccaaaaaattttcgaaaaatttccgtaaaaattgataagttttttcatccctaaaaatcagttccctagtagtaaatattgagcttaaaacatttaaataaaaaaacactttttatcagtttcaaatcatggtatcatctcataattgcgagaaattccggacaaaaaagcaatgataaattgatggttaaaaggctgatgaagtggaaaagtattggggtctccgttgttaagtggtaaataattttgaaccatcgtgagaattcggcggtctgctttgcgatatttctttgccttttgcggtggttcttgtccagttgaacacttcgcgaagtcatcatcggataacttttgatcctttcgcagaaggtcaatgaaacgccaaatcgatggatgtgaacaggcaaatgcacattgcaggcgtctgttcgcggcttctgaatggttattcgtccggtcatcgctttgcagtgttcgagtgtaaacactccaaatgttcgggtcaaatcgcgggcgtgttcggcttccatcatgcttaagacgacccgtgtagttcatgatgaacctaatgaataattaaagaacaataaatagtaaacaatttctgagattgtcaatttaccagtcaaggacgggagtaagttcgtcgggaagagccatgtccagagcaatgattccaggggtcaaatctccaattgggagaaacgctagcgatgtgacacatcgtgccatttctgcgaatgtcgggtcattttgatagcgctaaaattttcgaaaattcgacttttttttgtcatgaattcaacctgtttcagcccaaattcagaaatttttttgtgaaaattttggacgaggtggaacagacatccgcgcacttcagtgaatgggaagactacattcagcgcagtgattgccgctgtctcgtatttggggggggcgctgtccgggttgaagtctggtcacacagcaacgagaatactaaacatacgctcgtatgtagcgtgcgtcttgttggaaagcatgcagtagcacactgggatgacccagcgagtccaacataaataaaaagataatacttgatagatgtttatgtcataccgcaccacagttgcgtaccctagtggaaaaggca

SEQ ID NO: 31097 - DNA, 1615 bp, Heterodera glycines
  misc_feature (48)..(48): n is a, c, g, or t
  misc_feature (50)..(50): n is a, c, g, or t
  misc_feature (52)..(56): n is a, c, g, or t
  misc_feature (59)..(59): n is a, c, g, or t
  misc_feature (62)..(62): n is a, c, g, or t
  misc_feature (64)..(64): n is a, c, g, or t
  misc_feature (103)..(104): n is a, c, g, or t
  misc_feature (108)..(108): n is a, c, g, or t
  misc_feature (113)..(115): n is a, c, g, or t
  misc_feature (117)..(118): n is a, c, g, or t
  misc_feature (136)..(136): n is a, c, g, or t
  misc_feature (142)..(142): n is a, c, g, or t
  misc_feature (144)..(144): n is a, c, g, or t
  misc_feature (177)..(179): n is a, c, g, or t
  misc_feature (201)..(202): n is a, c, g, or t
  misc_feature (204)..(205): n is a, c, g, or t
  misc_feature (211)..(211): n is a, c, g, or t
  misc_feature (217)..(217): n is a, c, g, or t
  misc_feature (248)..(248): n is a, c, g, or t
  misc_feature (287)..(288): n is a, c, g, or t
  misc_feature (290)..(290): n is a, c, g, or t
  misc_feature (292)..(292): n is a, c, g, or t
ctttttgtttttcattcgcaattcgtttgccttatatctctttaaggngngnnnnnagnggncncaaaaaaggccaaacaaaccttacaggcgccaaagcaanngganagcannnanncaaaagaagccaaaagangagccnancgaaaaggaggagaatcagcaaaaggcgagcannnccgacaagaaaaaacaacgccnnannaacggngagccnccagcgcgccgagaacgagcgcgagaacccncacacgccccagcgaaagcggacggaagcgacccgaaanncngncaacaaaagtcagccgatgacaccgctgaatccagcaacgaaatcaggtcattggtggcggaaccacggaaggacaccacggacaataacacgacaaacgcagcatttaccgactcggaggaggagggggaagacagttcgtgcggcgttgggtttatgagttgcgcttctttggccaccccttcttcggctgaatgcgcttcggcaccgaaacggcgacgagtgattttgtcatctgacgacgaagaagagaaaatgatgggaaatggacagagaaaagaccaaaagggggacgaaacggagaatgaaccccaaagacaggcgacgaagcgaaagcgaagggacgcggcgaaagaagcgaaggaaaggacgcctccttccgttgcccgtgtcccacgggacgaaatacagacgacgccttcggcaaaatgtgcacattcattcatcaattcatttgtatgccatctataattaagaattaatatcttttttatcctttttccaattcattacagagcatcgactcaccaaacgcttcttccgtgcagttgcccttttcatcgcttcagattcaaccaaaaaacttgaaaaaccgcaacaaaaatgaccaaatcgcagagagcgcaaacgacggtgatgaggaagccgaacgtttccctcacttggactttgactttcttcgcactgaaaaaatcaaagacgccaaaggacgaaagcccaatcacccggaatttgatgaacgcactttgtttgtgccggaacattttttgaagagccaaacgccgggtaaaaggaaaagccgcttttgagaagtcaaatggtatttagggcacagacaatggtggaagctcaaatctgaacattttgatacgattattttcttcaaaggttaaaacaatattttttctttcaaaatattttaattatttagtggggaaattctacgaactgtaccatatggatgcggtaaaatgatgcttttcaatttatttcactggacacacttcctaattaggtcgtcgctgtcgagaatcttggtttggtttatatgcgggttcgttttccgattggactcacttttttggtttatatggtgacgttttactatcttttcagggcaaatacgcacactgtggatttcctgaggtagggaataaaagtgctaacccttgttcatttgcctaattcattcgtcagattggttatggcaaattccccgatcagttggtcaaccggggcttcaaagtggcacgggtggaacaatcggagactccagcagcaattggcttcatgacggaacaaagtgacggcgagtcaggagaa

SEQ ID NO: 31098 - DNA, 1481 bp, Heterodera glycines
  misc_feature (165)..(165): n is a, c, g, or t
  misc_feature (180)..(180): n is a, c, g, or t
  misc_feature (229)..(229): n is a, c, g, or t
gtttcgtcgtccagacgaaattcgacccattccattttgcgcccgcgcgagtgacccagcacatacgccctgttgccacgccacgtgccatggggccgaagttttgtttttgtcctaaatttggagggaaaactgtttagatattgaattgcaatgcatttttcnccaccttgcggatgntactcagtgcgcaacggcaatttcgtagtgcgaagcgccggccaaaacnggtggcataactctaaattggaaaagcaaagtgttatttcgatcactgctcccccctcccatccaatttctctccaatcacttatttacctttctgttggtcgtttgcatttcggtcactgtcagccgcgtccccgtcggaatgcgcaagagacaggctcggtgccgaagtgctaacgaattgttgagacggagcacggcatcggtcgagatgaaagaacggtccaattgggtgtagcagtcgacggcgataaaagagacctcagcggacgagcccgaatgtgaagcaatgggccactcgaacagctaaaaaggggatttttgattgtttttaatatgctaattaggcgtttaattactcgcaaatcgattttcggataattctttcggtcgaacggcgcggcggcactgtcagagccggtacaaacagttgacgggagaagcacaacggaaaggaacggcatcagaaggacaaagagagatgagaagcgatggaagagaggggccattttttgaattcgaaagaaaatttgagggaaaattggaaaagttttttttttgctgaagaaatgaagctttattagtatcagaaaagccatgagaaaagagatgagaacgcagcatcgaaagaatgaaagagcggatgactaagccgaaaaagccattttcagaggcggggattcactcacagcgactaaattaacaaagtgccatttgtccatggcatatttgttggctaatttttggaaatttttccggtgaaaattgtttatttgaaaaggattaagcccaaatgacagttggatgctgtcatctgctgaatcgagactgcaattgggacggctatttatgcggttcagatggggcgggacaaaatttgtttttgcaccgtctgatgtccaaaaaagtttggacacggatggccattggacggcgcagaaaatggggcgggaaaataaattaatccgccaattaaagccgagagtctcgactcccctccgcctcccatcggccaaagaatgaatcagctcctccaaatttagcctaacaaatggtcgcaaattggcacgtccccctgaaaaaggcatgtgaatgcaactttttgcaaatgttgccatatcgggaagacattagccaaagcaaatggaaaaaataattaatgtgaggagagaatattttggtgatggaaaaaaagaaacagtaaatactgtaatgatgatgaaagaaaaccaccaattcttaatcaattcagc

SEQ ID NO: 31099 - DNA, 979 bp, Heterodera glycines
ggaattcctattactgctgagcagaagaagagataatagccaattttccaaatttttcccaaacaaccgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaatgagatagccaattttccaaatttttcccaaacaaacgcgccgagaaacaaattccagaacaattagtatcggcgtaattattctgagaatgcagttggaattcctattactgttgagcagaaaaagagatagccaattttccaaatttttcacaaacaaacgcgccgagaaacaaattccagaacaattagtatcggcgtaattattctgagaatgcagttggaattcctattactgttgagcagaaaaagagatagccaattttccaaatttttcacaaacaaacgcgcagagaaacaaattccagaacaattagtatcggcgtaattattctgagaatgcggttggaattcctattactgttgagcagaaaaagagataatagccaattttccaaatttttcttatagcaaacgcgccgagaaacaaattccagaacaattagta

SEQ ID NO: 31100 - DNA, 1491 bp, Heterodera glycines
aatttcagatcattgaacgagccgattggacagcgatgaatttttgtggccaattgtttacggactgtccaccaaactcggatgaaatgcagcaaattttgtcttcctttgagttagccaacaaattgaatggaagagcggcgaagagagacgaagaaaacggaggaggaaatgatggcggaggaggaggagggaccggcaatttattggaatgaccaattaattagaaaaaaactaacaaaaggcatcaacgccaatgtgtattttgctttatttaaatgcaattttcctctgtgtcacaaagcataaataatttgaaaccaacaaccatttggaatttatggcaatcatcaagaattggtgtcccgacgaaaaaaaatgttaaaattttgcaggtattttttctaggcttgaaaaatgcgcagatcacgaatctgagctcagattttgaaaatcattgatttttatctaagatttttcttcgactacttgattttttccaaaattttaagaaatttagtcgggcgtaaaaactcatgcgcagatgttgtagagactaaaaagagctttcgaatgagctattgaatatataaagaagtcacgttttaaattttttacgattttttcaaatccaattattaatccctaggggtcagatgagaaggagaccttgggttcgagtccgtttggctgcggtttattttttcatgacacttgatgaaaaatcatagacaaaatgaaggttcatgcataatcagagctcagattcgtgatcagaatattttttaacccaaaattcattgctaaaaaatttttaaaaataatttaaaaaatcgaaaaaaatcaagtagtcgacgaaaaatcttagataaaaatcaatggcaataaacctgcttaattatgctataaaatgttaaaattgtccccgaaaaaacaatttttgtcctaacaagggaaaatggaattttcattcattttttgcgcggcaatttttggcgcaaattttggtgtttttgatgtcaaaaaatatgtacctccaatctctaaagaccatagtttggattcatttcagtttagaaaaaattccacaaaattgatcctcagagaagaaattttagccagtctgtagcaattctcatccttttgtcttaaaagtttttcatttatactattatactgtattttgaacacaaatagaagcattttggagtcagttcattataaaccgaaaatacaagcacatttaattaaagaatggagggagattaaatgaaattggggctttaaaatgggtcggggtcactttggcgcgggccattttggcgccgcgaactttaaagtgttataacttttttcttatccaaccaaataaaaataattttgataccattaaataggcctaagtgttccttattaaactagcacatagtatgaaaaataaattctggttcacaaaatatatatcgcgcggtgtccaaatgtgcagaaaaa

SEQ ID NO: 31101 - DNA, 1040 bp, Heterodera glycines
aaaaagttatgtcgtcgatcgtttgaatatcccatttttcagtttgtcgtttgtctctgtcgtgtgaattgtctccaatcacaattaacataatctaccgtaaatttgtcgtttgtcaccaaaataaagttgtttttggctttgaacaaataaagatcgattgcaaaatatttttgagtaagggggcggagaataaccaaatgataaacaaacttatgctcatatgaaagcatttaatcatccaaaaagtacttttgccaatttttgtcacataatgtcttctcgtggaaccaatttgggtgccgatgaaatgttggcttttgcaaaggtagttagatccaaaaaatttatcccagcgaatattaaggccgttgaaaaaagacacgaaactcttttcaatacgacaagtgggccggcatttcggaaaatgatcgacaatttgtgtacggaaattgtatttcttttttaactttgtgagttaaaaagacaattgatctgatcacaaatcattgaaacgacgaaaggcttcgatctgtaaattgattcgatttttttgcgcatttatatcagcattttcagctagaggaggagcgcgtttttgcgaatgaactaaaaaatttgttgaaaaaaagatgcgtggtatcattaactcataaaataatttttcgagctcattcacgcagccttccttcattgaaataaggtaatccgttccaacatatgccgaatcagcaagtaaaacagaccccggaaatggacgccaaccggcctcgaaacgcagtccaagcgttttccgaaatacgcgctggtcatgaacggcaccgggaaattttgcactaacaaagagaaattttttgccttaaggcaaaaaattaaaaatggcacttcagtcgttaggttcgcacctccatcggaaacagccaatacattgagtgccgtccgtcgataacggccaatgaaatggcactaaagtggtcggacgattggcacccgtcggtgaaaatcagtctaaaaaccctattttctaccataatttgcaa

SEQ ID NO: 31102 - DNA, 1218 bp, Heterodera glycines
  misc_feature (101)..(101): n is a, c, g, or t
  misc_feature (1135)..(1135): n is a, c, g, or t
  misc_feature (1189)..(1189): n is a, c, g, or t
aatttatctatatccaaagaaaaatgactatctcttattttgagaaattttacgcgttacaaaagcgctcgagcgtgagagggagggcggtgcgcaatcgnccatttatttctcagagaatttttaaatttatcttatatccaagaaaaatgactatctcttcttttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttcacagagaatttttaaatttatcttatatccaagaaaaatgactatctcttattttgagaaattttatacgttacaaatgctctcgagcatgataggaagtgcggtgcgcaatcgccatttaatttctaagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagaggaagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttanatttatcttatatccaagaaaaatgactatctctttatttgagaaatttatacngtacaaatgctctcgagcatgataggaag

SEQ ID NO: 31103 - DNA, 1183 bp, Heterodera glycines
gtaatcttttattaccttttgtcgtaaatcacaaatgggaccacaattcccatgcaaaccaattgctggagttcggcaaaagtgcaaggattgcaataaaatgttcttcaataatgattgctagcagtatcatctttcttccaacttttgtcaaatgagcaaagagtgcaaatactgtggcgtcgtatgggacatgcgtaaaaattgcgataatgggagagaggtttcttttaaaaatttaataatagtttaatattgtaatagggtcacaaatgcaatgaacgctggtgtgaaaattgtcaaatcttccacgaatttgagcggggatgttttattcgcccattggagccgaacaagaagaaagaaacaaatgggtggcgccttgtcaccttcgacgttgaaacaatgcagcatgagcctgcggacccgcatttccctaaacgaaagaagcatcaagtgaattttgtcactgcaaaagtggcatgtccggattgcatttcgaccggaaaatggaaagaaagccttcttggaaaattctgcaaaatctgcggctatcatcggacaataacattcagtcaaatgccgttccgtgagacaacggtcgacagacaaacaattgaccgccaccctcttgttgcattcgttaaatggcttctctacaaacttccaaagcaatacgaaacaattgcctattcccatttcgggggacgtttcgacatggtcttggtctttcgggaacttttcatggagggactgaacccctcaatgatcagaaagggaaaccgtctgttcgagatgagggtataattttccatgtgtttatttaatcattttcccatctcaggtgaaaagcagaaagaacttaaacccgaatgtgacatttcgtgattcttggaatttgattcctggaccgctcgcctcaatggtgcccatgttcggcttggacgtgcaggacaagcccttctttccacacatggccaacaaacctgacaattatggatgccaaatttttccgtcgaaagcagattacctggccgacggaatgaaccagagaaacggaacaatttgatcaatggtaccagcaaaacaaaaatatttcgtttctgctggatgagtcattggcaaggtgattatgaataaatcaattttgataaaataataaaaaattaagctattgcaaaaa

SEQ ID NO: 31104 - DNA, 1654 bp, Heterodera glycines
  misc_feature (64)..(64): n is a, c, g, or t
  misc_feature (68)..(69): n is a, c, g, or t
  misc_feature (1479)..(1479): n is a, c, g, or t
  misc_feature (1616)..(1616): n is a, c, g, or t
accagaaccgaaactatctgtatggatggatgacaaattctttacatttccattgcccgaccgnccgnngcccagcaaaattttctttaagaaccttcggatgtggtaattaaaaatcagagctatgacaataaaagcattcattccattttcagttacattgatcactccgtcatcgcttttcttcgttcaaatcaccaaattttcgacaaaagaggcacctatttatatttgtggattccatcaccacacaacacggatggccaactaatttgggacatttttggtcgtgaaatttggccaattttttctgaaaacattcgccacttgggctttaacgatggtgttgatttggacaatttgcttcgtcgcacttcgccgacaattctcaccgatctcaaccaattgacttcaatcgattcctgtgatttgtcgcccgaggcgattggtggtgattttgatgggccaaatgcaacaatttctgctggccaagcattgtccaaatggttgcactctccgagaaaagatggacaacccaaacgattgcgttgcgatgattacaacgaacaaacggacttagattggattaacaatttcaaggaggtgtggccataatctcgaaaaatcactgatttttgttttcaaattgtttagcattttctccgtgccaatgccatttcttccgtcagttaccaaattcattttgctgttcatgcgctgtcaatacaaattgtgccatttgaattggtgaacgaatggacaaaggaaaagctgacattggccaaagcaaagggatgggacaaccgatggataatgaaacgatgcaaaattattggggagacggcagcggtcaattgggaagacggaaattgggacaacaattgtaacagtgtcttcgtttggctttttcgtactgattgcatcgggtgagcaattaaaaaaggcatttaattttgtttaaataattaaaattttgcctaatttaggccattgtctccgccaccagcagaagaagccggacaaaacatcacaaaagggccgtcatctgaactgacaatgagtgatggacaaacgaacaaaaacagtgatcagccgcagaaggaatgaatgaattgagaatgatcgaccgagcataattcaaatcagtgatcaaatgtatcttataagaaaaaacctctcaaatatgtatatgtaaataaatcggatgcataaaaatggcaaaaaatatacgaaacctaaaaacaaaaaaaaaatgaacaaaaaaaacaacttgttttttgtgcgttttaacccggcaacttaatttgaattgctagctaaatatgctggataaaattcgggatcattggtcccataaaaaaggtcaaaaatgctcgttttgagcgatactgcaaatttgaaaacttggaattttcgtaaaaggttcgaatggcatttattttggtctagtacttttccatttaaggcccacatatttanatttcaaaaaagtcaataaagagttcgctaaatatccaaaaacagcgctgcagctattcgtgaggcataaatgcaataatttaggccaaaaatcatcgaatggagtccgtttgggattttttcagtgttcacgctanatgaattcgcacaaataaaaaccccacatttgacgaaa

SEQ ID NO: 31105 - DNA, 1253 bp, Heterodera glycines
  misc_feature (43)..(43): n is a, c, g, or t
  misc_feature (139)..(139): n is a, c, g, or t
  misc_feature (1211)..(1211): n is a, c, g, or t
aatgtttatgcgttttcagaatatttggaaatgtttctttacngacattccagaatttttgttttatatgttttcagaatgtattattgttttcatagtttgtgcgttttcagaatgttttggttaaagtttctccctntatcacaatgtttgtaatgttattcttttatgggttttcagaatgtttggaaatgtttctctttagactttcccgataataatgttttcagaatgaattattaattctaatggaattattaattccaatgtttatgcgttttcagaatgcttgtaaatgtttcattaacgacattccagaatatttgttaattaaaatgtttatatgttttcagaatgtattattgttttcattgtttgtgcgttttcagaatgttttagtaaagtttctccctttatcacatactcttttatgggttttcagaatgtttgaaaatgtttttctttaaagattttcccgattattaatgttttcagaatgaattattaattccaattttatgcgttttcagaatgtttgtaaatgtttctttaacgacattccagaattttttgttttatatgttttcagaatgtattattgttttcatagtttgtgcgttttcagaatgttttggttaaagtttctccctttatcacaatgtttgtaatgttattcttttatgggttttcagaatgtttggaaatgtttctctttagactttcccgataataatgttttcagaatgaattattaattctaatggaattattaattctaatgtttatgcgttttcagaatgtttgtaaatgtttctttaatgacattccagaattttttgttttatatgttttcagaatgtattattgttttcatagtttgtgcgttttcagaatgttttggttaaagtttctccctttatcacaatgtttgtaatgttattcttttatgggttttcagaatgtttgaaaatgtttttctttaaagattttcccgattattaatgttttcagaatgaattattaattccaattttatgcgttttcagaatgtttgtaaatgtttctttaacgacattccagaattttttgttttatatgttttcagaatgtattattgttttcatagtttgtgcgttttcagaatgttttggttaaagtttctccctttatcacaatgtttgtaatgttattcttttatgggttttcagaantgtttggaaatgtttctctttagactttcccgacttctagag

SEQ ID NO: 31106 - DNA, 1215 bp, Heterodera glycines
cttatgctgttactaaggctacttttagcggcacatctcttttttgtgcaacccttattatcagtgagattaaacacaggattagagaaatgccaacctagcaaacgaagcatagcatagctgaagcccctgtggaaatcgctgttttgcaatttggattggtgacaacctttgtagatatttttatccgtttacactaatatagcctttcttggcaaattctaaatgctgtgggtattgcaatacctagaagcatgaactcaatgttgccaaactagatcggaggaagcctcgcaatcttctgaaaatagttgatttctacattttctagtatgtcatcgtaacaaattgaaatactgatgcattgtagacgcattcgatgccaaaattcagcccatctacgtgtgcagaaagtcaagcttcctttctgtaccatgtttttgtttcgaaaatatttccaattttgtttatgatgaaatagacaatttacaaaattatagaaatatattagcaccactacagtaccacaaaattctttcgtaaaacaccagatcaactgaaaagtctgatcgctagaatatgtagctttctgccatatgagagaaatatgaaataatggtaggagggatgttccaataacatgcttatgctgttactaaggctacttttagcggcacatctgtaatttgtgcaacccttattatcagtgagattaaacacaggattagagaaatgccaacctagcaaacgaagcatagcatagctgaagcccctgtggaaatcgctgttttgcaatttggattggtgacaacctttgtagatatttttatccgtttacactaatatagcctttcttggcaaattctaaatgctgtgggtattgcaatacctagaagcatgaactcaatgttgccaaactagaaattcgtaattgaaactctaaatgtttaataaacataaaaaaatatacttaggatcattcaatagcccttaaaattttcaatttatatcaagtttccaaaaatttcatagcattatcgatgtaataagtagggagtccaattatatgcacatgcatatttttttcctggactgtgggaggcctgaaacgcacgaaaaacatgtttttagcttggtttgaagcttataggacgtatttccatatgcatattttgcatatttgtgcatattttgagatttatgtgcatatttgca

SEQ ID NO: 31107 - DNA, 1007 bp, Heterodera glycines
tttcccagcaaaaaataaaaaattaaatatttttattcgacatttcttcccatttctgtcaaaagtgtcacttcttttatttttgtttcagtcggccaactcaaaaaaacccatgggaataaattttcagcagttttgagcagcagtcgcccctttcgtccgcatttgttacttttttgggaacggaataaaagttactgtacaaagagtaagtggcaaaaactgtaggggatacggtatttcatttaaaaacagaattttctttgagtgtttcttaccgccgggaacatcgaaagaataaatgggcaacaatagaaagagaatcgacaacagcaaaagtggccaaactgtgccgacgattggccaatgccaacccattcttggcattttgttcgcttatctctccgcccgttcaaaaacacttcgctttcgtcccattggtcaaaacatagaaaaaatatgcgaaaaaataaaaaaaaatagaatatgttgcagtaaatgatgccaaaaagtaatgaaaaatgtgcgcaataagcggaaaaattatgcacaaaaaaaagttattcgaatgggcgagaaaattcaaaaaaagaggagggaggggggaggggggaggagtaaaattttggaaggggtgccaatggcatggaaaaggcattcattggcactttgccgctcaatagggcggacgaaaagcattccccggggaataatttgggagaaaatgatggaaggagaggaaaagaaggcggaaacaatgggcgatgggaaggagagaagggggcggggggaagtgaagtgtttaacggccggacgaagaatgaatgaatgggagggaagaatgatggcggaagaaagttcgagaggggggggggggagggagaggattgatcaacggaacggagatggatcgaaatttttaaaaaacattcaagacacaccgtaagagagagagagaacgaaaggagtgatcagatgggggtgatcagtgatcaaagaggaatgat

SEQ ID NO: 31108 - DNA, 1306 bp, Heterodera glycines
ttgcatcaggtatacaatttccccatccccccccccaaatcattttggctcacaggttttgccgcccgcccaataccagcagatatctgaaacatgtctctatccttggccgattcaagcattttccgtttgatcagatccaacttttttctcggcccgtagcacaccatgttcgggatattggcatgttaatgcctaaacacctcaaatcctttttttatataactattgactaaatttttaaaaaatcgggatgtgaacataaaaatagccatggataatttgcttactgatttttggctcataaagtaagtgaattcattagagcccgccggcggggagaaatcggaaaaatacaaaaacatttttaatcccatggatttcgttcgccctctcatcgatggagattttgtttttgttttggtgttaatttacttagtttattattattgttattattattttaattatattttgtttgtctgtctttcactctcctctttttgaattgtctctcgtcgatcccgcccccgagagtctcgaggcgacacaaaattcattcgttgtttattgatccgtggagaatgaattttttgtgtgatcgagaagcatttgcattttatgacccatttttagcggcttaacaattccagcgcccaatttatttattacatttgaatttgccattttatctgggctcagtgtttccggaacatacattatggaaattagtttcaaggacgtccttccgttagcattcaaggacaaagctgagcctttttttataatattcatttttgtttatttttaattctaattttattgtaataaaattcattaatttgctcaaaaattaattgctttaagttttggtaaatgccatcatttaaatattattttggcaaaattgtgccaaaagctaataggatgcttatttgatgctgctatgattcacccaacagaaaaaaaattttttatttttttggcaatttgcacatgattttaattctaattttaaataattttttctttttgaaaaatgcccatttttccacctaaattattccttcgcttttttggaatcgatccggaattttttttttttttgcaaaatttgtcatttcatagagtagaagactgaagaagcgaatgctaattaattggatttcgaattttgttgccaaatttttactttttcaaaatggaaatggaaattgttaaaatgaatgaatcacaatttacaatggaaaaccgaagaaaatgaacagaaaaacattttaaagaagagaaattaaagccctgaaag

SEQ ID NO: 31109 - DNA, 1865 bp, Heterodera glycines
aaatgccaaatggttataccccttgcttcggccgatttcagtgtgaatttggttgagcgttgaaatttgcgttttgatgcttcgctgcgtgtatttggagacaaaggtccagaaattactaacatttatttatttgttaaaagtcatttccccaaagtgggcataaatttcaatttatccctcgatttacccgataaattatctttgagacacaattccaattctccattttgttgctggggatggccgattcgagtgccgtgaacccttgagaaaaaaagcgtctctgagtccatgtatgaaagcatcttcgatggcagtgcgcaatacttgtgacagttcactggtaacattcgattatgcccatatattatttgattcaaacaatacataggaaggcgatgataccaaaatcgtctgtggatagacaaacttgatcctataagcatcgccttctccttatggggtcacctttttacgctttgccattgtaatagcattgtaagggtcgatgcacttcactctcgagccggcgacggacgcgataaagccacaaaagtcggagacaggggcgtaaatttctgcaaattaaatgacgcttaaaaagaaaaaacaaaattcggttataacaagggatgggatttttaggcaaaagcctattttttctgagctccccgtggcctgaaacgcacgaaaaacattaagcatttatccagaaaatcggttctcagttttaacattttttgtttttaagtcccaaattaagttttataatgaacattttaaattattacctgggttgttttgtcggttgtttccacgtctgtacatgctcaatattccctgagcaaaataaacattgctcggcagatggccagtcaatagtgccgcaccagaatcaccatacaaagaatttgaatattagttttggaattttgtctattttaggaagagtgtcacgggacagggaatttttgccaaaaccgggtccgggacttgccgggacctgagaagccgggaccgggaaatttccaagtaaaaatttttttgaaaaattgaaaaatccaaaaaatttttgtatttaaatcgctcttaaccatgcaaagaatttgaatattagttttgtaattttgtctatttttgaattcggcattttcatgagtaaaatggcggaaaaacgacaaaattaaaaaagaattaaaaattacgttgacttacaattaaagcgcctgcgtttgcagagccagaacagagttttgcattggcaccccattttcttaaaattgaaatttcaaaaaatcataaaattattagattaacagtttgcatatggcgctgggtgataagttgacgacagcatggcgcagtttttggtcccattctgcgtcggcacgctaaaaattgatgaaaaatgtaacaatttattattatattttttatatgttatcatttatttttacatgtagcccatagccgactaaattcccccaagagtccttaaagcggtccagacgtgaagccaaacagacgggttcggcagaaacggtggaactgctctgaataaaattgcttgtgaaaaaaggccacaattttggcaaatgccttgatcagtgcgaaatcgtacgcgtaattttggaacgtgttgtcattttcttcgtaccgtggatcgacccaaaattcgtcgacgtggtacgtctcaccacgcgaacttagtgccaatttgtctgtttcaagtggcacccagtttggcctcttttgtcgtctagggtttacgtggcacaaataaaaatttgtgtacagacaatgggccgatgtcgcaaaataattctcccctaaaagaaattaaacatggcagcacccataca

SEQ ID NO: 31110 - DNA, 1196 bp, Heterodera glycines
  misc_feature (103)..(104): n is a, c, g, or t
tttttcagaatgtggtcatagaataggtgggttgaaattatttgtattttttatgagtattatgtaaggatatttcgaccaaaacataaccatttcgagttcnnatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttcaagacgccaattttacatattagccatttttttttatttgtgaccgcaaatttttacatactagccattttttattttattgtgaccaagcatatctttcctcgtatttctgggatttttttcagaatgtggtcatagaataggtgggttgaattatttgtattttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaattttacatattagccattttttattttatttgtgaccgcaaatttttacatactagccattttttattttattgtgaccaagcatatctttcctcgtatttctgggatttttttcagaatgtggtcatagaataggtgggttgaattatttgtattttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctagacgccaattttacatattagccattttttttttatttgtgaccgcaaatttttacatactatccatttttt

SEQ ID NO: 31111 - DNA, 1934 bp, Heterodera glycines
  misc_feature (314)..(314): n is a, c, g, or t
  misc_feature (322)..(322): n is a, c, g, or t
aaaaaaaccttcgtattatgccaaatcgccgaatgattgcgccaacacacaccgtattattcaccatttgcgaattgtcactgtgaaatttaactaaaatcctgtgactttcttccgcgctgaatttggggatggcccattgttcggcggtttcagtgccaatctgtgaaaatttgagggcaagacataatgccaagaaaataataagaatattttaattaggatttgtgcttttcagccatataaagtccatttttctctttttaatttctctgaaattgtgatttcaaataattttgtcattcaaaattcanagccgatntaaatgaaaagacaaacaaaaaaattctctccctcactctttatctctcgcactctttcgctgactctttctctctatctctctctctctttcttctctcaagtctcatgttattttcacattatctctcttctttcttctctcaagtctcatgttattttcacattatctctcttctttctcctctcaatctcatgttattttcacgttatctctctctctctgttcctctcattattattcctttttctctctgtctctctctccctctttccctattattcatttctctatatcttctctcacttccctcctctgttttttacccatttttccatgtattcctctctgtatgcgttccaatctgcgctgttttcaatcaacgttttgttgttggcgatgtgttcaaggaaacggaacactctgatcagcattgacttgttcacaaactccgccctctgctgctgatccgtcatccctcgctgatcaaattcaaaattgtcattcatttccctgtgatgctccttcaattttgccacttctttttcaaaatccgaccctttcggcgccattcgctccataactttcagtgttttgtgcgcaatgccattcaaataccaaatggagcagtaatactcgaacttgaggatgattagcaattagtaaataaataaataaaatcaaaaaattatttcttttaatcaaaaagtacaaattggcaatttaaaaataaattttttttttcaattgctcaccaatgtaaataaaatgctcatttggcctgactcatttaaatcgcttttcagatattcaattaaaaggcgtttcaacaacgcaagcaataactctaaagacagtttaaaattaaaaagaaaacaatgaaattaccttcgggaatttctttttcgtctttttttcttatttgttcaattgacaaagattttgctggacacgaaacatgctaaatgagaatatatttttttgttttttaggcaaattataaaaacaacaaaagtttggccaagacaaggaattttccctggatccagctcaaagttaaggcaattttctgtgtccaagtttttcaagaaaaaattggattttgtggataaatttttcaaatttcttattgttcttatttcagcttaaaatagcttaatggataaaaaaagaatagttatcgtcaattaaagtttaacagaattttttatatctttaattactttttaaaacaatttcaaaaacccaggcccacttactttttgcttttgctcaatgccttccttttccagtgtaaattcatcatcctcatctccaattattctccaatggaatttattcgcattttcccaattttcctccctttttccctccctttgttcatcatccgctactttttcctgttcttcctttttttgatcattctctgtttcctctttttccttttcttccttttgcttgttcaattctcctccattttggcgcaattttaaaattaatttcggtttatttccttttaccatttcaaaagtgttcaatttgtttaaaatattcgttgcagcattttcattaacaaaatcgagcaaattttcgcgaacctttttaggtccat

SEQ ID NO: 31112 - DNA, 920 bp, Heterodera glycines
tttgcgattttgagcaaattttgcttgtaattaaggcttcttacggtccggcggtgccgataggcgccgccgagggaacttttaaggattttgaccatatttttagcatattttcattaaaaaattctttaaattgccaaacattatgccgatttatcaaaatttaaatgaggattttccccaaaagcctcaaaaatcctcaaaatttctcaaaaagccacaaaaatcctcaaatcctcattttccaaaaaaatcctcattgacctatcaaaaagccacaaaatgaggataaatcctcagatctggcaaccctggcgaaaatatatagaaaaggagaaaaaagaaaacggagatataaagaatagaggaaaaaatgataaaaagagcaagcaaaggagagagagaaaggggaagggtgattgaatgagtgagaaaagatagagaggatcaagctcagtatagggactgtgttatataacccgtttgatcaaaaaaaaacgagagatgaaccaataaatagagagtgcgaagaaaaaaaatatctttttggcttactatttctttgtctctgttaatagagaaatacagaatttacttctctcaataaaactttttctatcaacacaatgacaataaattttgcaaaccaattgataaaaaattacgaacataacctagaaggatttgcttacaaaagggatctcctcatcattagctttaccaagattgtccaatttcgctgggaaaaatcttcaaaaaatttaataaataaaaaatctgcatgttgcgcaacggacttgaagctccgccctttgtccctttatctatcaattcagccaaaaaccgacattttgcggcccaagccaaaattgaatttttgagacctatgaaacgccacatatttttttcatttaattata

SEQ ID NO: 31113 - DNA, 842 bp, Heterodera glycines
ttagctcccgttgacaaaccgaagggtacattgggggcaatggatgttgggctaccgtatcagttattaaaatttttgtttttcaaaaaggatactaaaactgggataaccccattcagagactagtcaaaaaaaataataataggcttggactactatactaattagaaattttagaatgtgtctgttaaatgcaaaactgttgtgaaaaattgttataactcctttcagagaagagatagaaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttggcaaaccgaagggtacattggggcaatggatgttgggctaccgtatcagttattaaaatttttgtttttcaaaaaggatactaaaactgggataaccccattcagagactagtcaaaaaaaataataataggcttggactaccatactaattagaatttttagaatgtgtctgttaaatgcaaaactgttgtgaaaaattgttataactccattcagagaagagatagaaaaaaaaaataaaaataggtttagagagcccgtgaacgagctgaatcggatgcgagtaccgccgttgctgtacgcctaacggttggtgagcgaatgacggaaaattgcttaaaaaagaaaccaaacaaactcatcaattgtttgctcccgttgacaaaccgaagggtacattggggcggatggatgttgggctaccgtatcagttattaaaattgttgttt

SEQ ID NO: 31114 - DNA, 1818 bp, Heterodera glycines
tttcctaaaatttcttaaggacttgcgaaattttaatttcgggagcgtgcgcacaagaggttgggttgggttaagattttccaaatgaaaaatatttgtattataaaatgggaaaattttggaaataccgtttaattaatttctttaaaattctcaaaattttcccagcggcgccgatctgcaaggctggaacctcgtcctttagaaatttttcctaaaaaatgtgcgttgacaaaaaataagaaaataaatgagccgaagagtaaaaaaaaaaaaagtctcttgctcgggggggggaagggtgggttaaagctccccgaagccaatggtatggctaagagctcttttaattatgcaaaaaaggtttatattttagtgataatctgttgtaaaaatttaaaaaaatggacccgcctcaccgggcgggttcgaacccacggctccgctaattgtaaatgagaaacatttacactgaaccaacaaactgattaaagaaggaacgatcgattgaaaattttgcactaaaagtttcccagattacctgatcagaatatatttgaagccgacaatttgacggggaagcggagtgtccgctgttggcttcaatttgccattctttcgtatttgcatgccatttccattcctttgccccgcgcgacaaatttcgatggcacccaatgaccatatggcacccttttaaagatcaatattaatttattttgattgctcttactgaagtcttttttctatttttaataaaaatacccaaaaataatgttcttccattgtttgcttttttttcttttatattttgtttagtccttagcttaatttagtggcttttgaggtgaaaatgaggctgaattttttaagatgaggctaattctgtgtctttcagagatgaaagttttagtggcttttggaagaattttttcaagtaattgttaaaataatattttatgttaaaatctgtcaattaaacagacgaaaatagattttacgagattttccctgcggcacagaacgaaccaccggcccactaattgaactcaaagatagagctatttattgcggagaataaaaatgtggcacttttgctgtttagggtccctgaaaaaattaaaaagtgggcccttttgtaggaaccccctaaaactcccataaacaagtaacttttcacgacttatgaaaaaaattgcaaaacaaatggtccatttggaatttttttttcaggagccctaaacagccgtgccgaaaatttaagagattttcaagtcgacatctaacggaccacctgcacattaattgtttttcgggggaattaaacagcaaaaatgcaaaaaattgtcgggtctttccctgcggtactaaacggacaaccgataatttacatctgagagccctttgcataataagaaattttagcacttgctccaataagttaatttaagtttttcggaaaactaattaatttcctagcaaaatattacttgaaaatatctgtccactaatgcgttgaagcggcaattacacaatgccatgccaaggccaagcgaactgtgcccaacaaatgggaacacattataccaaacgtcattgcacacatttcttaaatgccaatttttaatggaatgtgccaacttttggaaaccaaaattaaattcatttaactcattatcattttcaattgctaattacccaatttggtttcaaaaaaaataataaattcattaaaatatttaataataattacaatgctttcaagtgtctcacagcttcccgaggatgatccgacatgttttggtgtgtcgataagtt

SEQ ID NO: 31115 - DNA, 1225 bp, Heterodera glycines
ggggctggggggaagggtggggagccccgcatgttgtggtacacgcatcgattatggaagccgcgcatgcactagcaacgaagtcctttgcgcgaagcgctcatgtaatgcatattcttttcatctctcacaagtaaactgtctacaccgtgcaatcactgtgcaaagcatactgtctacaccgagcaattactgtgcaaagcatactgtctacaccgagcaattactgcgccacaacacgctagtttagatataactaaagaaacagatgaactcattgctaaaacaaaaatctcgggaaccgctggcgggggggactcgggatttcgaccttgggggcaacttttgacggcgcatccaggaaaactataggcattccggtccgagggccaactgagcgccagcggcgctgaaacggcttttttaaatttttttttgttgtttttgggattcaaaaattttttaaagtcttaaatgaaaaatcggcctcgataggaaatcaagttgggaggtttggcacatctttttgctcttcaccgacctcgtagggcctaccagtttttccgaaaaactgcgcaaaaattgcatacttttttggccatttcagcgccggccgaataactcgccggggtttgaccggaggaggtcggtgtaagcggcttttttgtagagctcgacgagctctatccaaccatgtttttagatttcagaaattttcagaaattttcgaactaggccccctcgaaaattttccgtttttgaattttattattttttacagatttttccagcgaaaacggagaccactttcaagcaaccgtttttcatgctctatcgattggtgtcattttcagaaaaatttttcaaaaatttttttggaaatagaaaatttttggttactaggcctcaatttcagttctggcgcaataactcgtcaggagttgattttatcaaaaaatcgtctaagagcttttttgtagagaattttaagcccaatctaatgtgctttatctcatgtttataccatgagtttaaaaaaagttataaaattaattgtgattttgaaactcaaaaccataggggggaccccatggttttgcatttcatgaaaatttttttgctcctaaattagccaaaatgcatttttatggcataatttgaggtgctgaatacgtatatacgctttattttgcgtttcagacttttggaaggtggtaaaaatttt

SEQ ID NO: 31116 - DNA, 1120 bp, Heterodera glycines
  misc_feature (1098)..(1098): n is a, c, g, or t
ttaattcctagggtgtaacttaagtttccgcacactttttttaaagaatttttttaagaatataaatttaaaaaaccacaatcatgatccgaaatatctgacattattattgagaatgagtttgctatttatcgggcaagggataaatcccattagaaaagtatttaaggagttagagttgataatgtaaaaatggtcattttcgaggtatgtatttttgatggctgatttaaagaaaatgaaaagagatacagaggcagagaaaacgtgagtaaatagagcaaagttaggactataaaaattataagaaaaaaattttattacttcaaaaatgaattattggagggccgagtctagaccatcaaataacaaaatgttttaaaagtggttttggaaattccgaatttaattaagctaagtaaattgaccacgctgagtccgaatatggctttagatttggtctctgggttctcaacaaacctgtacagctccaacttcatgcatggagttggagcagtacaagctcagggttaaaagataggtcagatttaaggccatattcggattctactggtctaatttgtacagaaaaccttcttttttgttatatcaggttacttttttgaccataaaaaattcgagaaaaattagtgggccaattttcaatttttgcatggtcgggaaaaaatactaaaaaaattgaataagcaaataaaaaatgaaacaatggcatgaaatgaaagaagactttctgacgaacaaaataaaaaaaagaattattaaaataactgcagaaattacggagttatgaatttttgaatttgtcaaaaaaaatagagttgagcgggaacttatgttacatcctaagtaatttacagaaaccccaaaaattggcatgcatttgcctgttccgctccatctccgccccattgtccgctttctgctgccccttcgccttcccccgctgttgcgttgcccggtgcgtcctccgctgctgttgaacaacaacgcgtcgttccgcttgcctcctcctcttccgccaccgtgtcattttcactgtccctcggttgcattttcgtggtcaaaaaggtggagcanaagtttggccgaacaccaacaa

SEQ ID NO: 31117 - DNA, 1842 bp, Heterodera glycines
  misc_feature (79)..(79): n is a, c, g, or t
  misc_feature (84)..(84): n is a, c, g, or t
  misc_feature (93)..(94): n is a, c, g, or t
  misc_feature (1659)..(1659): n is a, c, g, or t
  misc_feature (1672)..(1672): n is a, c, g, or t
taattaaaaaatgttaatatttacgaattgtggcataaaaaatgctgtgattatttatgattctcccgccagaaatttntaaanaatgtgatnntatatttctctaaatgcagggaatttgtgtgttttaatcacaaatcaacgcaaaattgatgtgccgccaatgcatggcacaaatgttgtgccgaattctttgaggaaatgtggcatcaatggttctacaggcatagcatttacacgaaaagtgatagccaattggaaccgcatgaagacgataaaaaaccgccaaattttaatgtgatgccaactgagcaaatgctaattgacattttcgaggcgttaattaatgaacgcaattggggccaattaaagagacaaaaattagcgatcatttacaaaattggcaacgtgttggagcgagctttgcatgatgatccgatcaaaacattgaaatgcatgcataattgtgaaggttatggaccaaaaatgatggaaatggtcaaagatttttgtgaaaaagattataaccgaaaatggacaggagaacaccaaaagtaatgaatgtgacttataaagtgcaaataaaattttgttttatttatttaaaattcaaacaaattgatctttggcatgctggcaaaaattggcacaaaaaaaatccgcgaattgacattaaataggcacaaaaatcatacaattttttatttatgccatttagtagcaaaacacgtaaaacttaatcaaagcacttaattttggttaaatttcaaatttcaatgaaattattaaatattttagagttttttcagatagggacaaatttttaaagcaaaaattttttatcaagaaaacaaaataaataaataaattttggcgatcaatttttaaaaagtcaattctcagggatgtgtattctgaaattttttcgggccatttttgtttttcgtgcatatctgagcgtatcaagtgtttagaattagaaattcgatccttaaagttttgggactaattgctgcctgccgagatttgtgaacaaaatttttgaaattttccgtttctgaatttagaataactgaatttttagcaatttttttttagcgtatggcgcctaatttgcgacgtttttatatgggaaaattggctgtttaattacccaatgctcacagagaaagatttgaaaatgtttcatgataaaatcttaaaattggttggtcgcctggagaaaaaagtggagaaaaatactagttggattgagatgaatgtggtggacaaatctgtcctaaatattatcggccaaattctggtggcaagagtcagttcattaaatgagaaatttaattaattaaaaaaaataatattcaaatttaatcaaaaacaaattttttaaatcaaaaaaaaaattggatgaaacctaaggatgcctttacatttttagatcggaataaattccatatttcatatatatatcaattaattatttaattttatcaatgtataatatttaggtgctaattgatcatagtagcaaaacattcatcagttttgttaattacaatcagtcgacaatttgcaatttttgtgccaatcggacatcacaattttctggatgggagcacatttgtgtgtacaacatgtggctatttgtggtgggagcattgngcaatggacaggngcgcctaattatcatatcccttttctcaaaaattgatcgccagaatctaattattttataaaaaatttcatgcctttttttcgggattttcatcccttttttttcaattttttgccgcctattattgtgccttttttcgagattttgtgataactgcttaatcaatctct

SEQ ID NO: 31118 - DNA, 1210 bp, Heterodera glycines
  misc_feature (22)..(22): n is a, c, g, or t
ttgcttagaattgataataaantttgttataaaaaatcctctttctttaatattcaagatttgtatttattaaaccaatttttatcaaaaaatttaaaaaatacttatacgtatacggatccgtattttttctggatacggatttttacggactacggattttccgtatttttagtccgtaagtacttaatccgtatcggtgtcaggtacgtaatactgatacttatccgtattttcgcaaaattccgatctctagtatatagtatagtattatagttaatgaacaaatgaaaatagaattaaaactagaaaaactaatcataaaccattgcaataccaaaaaatcaacattctgcacaacaaaagtgaatttaaaaaattacaatttttggttttttgaactaatttgggtccggtgtttgaaattggcctaaatgaaacttaggaatgcaaacttttaaaagaataatcttatatatgtatgtgtgccaaaaaaaccaccaaaataattgctaataaacttctaaaaactccaaaatatatgccaattaaaacaaaaggtgcttaataaatatgtgagtttctcaaaaaaaaaaaaaatcattttcatttcgctagcacaatgctaatcgaaagaattttaggacatatttttttacttggttaatgcttacattcttggagtatcaaacgaaatcttaaagtcccggaaaattccgaacccaatttcgaacaaaaaatcgaaaatccaaatgtttgtttttcagtttcgcctatttttatcaattcaaaaaatgtcgcacaatccgaagaaagcggaataagaaatggaaaaagcaatttaaaacaattattctaaatttcaaatatcttgctaatccttttccgttttcagcttcatttctgccgactgttggctcgaagtgttcgatttgcttccgccctttggccttggcattgcgatgatttctgaccgatttgaccgcagagtggacgaacatttcaaaacgcgtggcttttttgacgccaatgttgaaaaatctccaaaaatttttaattttgtctttctttgtgcataattataagccattttctttcaaagtaccatgctaatacaattgctagcaatgctacagaattttgatgcctaattttaacttttatattttggttcaaagttactattcacagggttttcgagggtgttgat

SEQ ID NO: 31119 - DNA, 479 bp, Heterodera glycines
  misc_feature (11)..(12): n is a, c, g, or t
tctagagtcannagtttattgtgggaaaaaaagactttttacaaaataataccttttggagaagggagtgggaaacatgatttcgaaattttaaattttttgtagtctaagctactcaaaccggttcagaattcaataaaaataacattcacggtgcgaaaaatggggtatgaaaagtttattgtggaaaaaaagactttttacaatattatacccctggtatatgggagtggtttatatgtttttcattttttgtattttttgtattttaatttgcttatttattttttaaattgtattagtagtagttttgttcttgttttttttgtttttttatttttgtttctttttttttttttttttttttttttttttttttttcttttttttttttttttttttttttttttttttttttttttttttttttttttttttttttttttttttttttttattgttttttttttttttttttt

SEQ ID NO: 31120 - DNA, 1133 bp, Heterodera glycines
tagagtagagcgggaccgggaattttgggcaaaaccgggaccgggacttgccgggacctgagaagccgggaccgggacctcgatttttcttcgggaccgggaccgggaaccgggaccaaccgggaaattttaaaaattcaaaaaattcaaattttaatttatttcaagtgaaaataatacaaaattaaattattattttttatttaataaaatccgaaagttaaagctaaattaaattaaagaaaattttcaaatcaaaatttcgtcaattattttaagcaattaatcatttgggctaaatggtcgaatattatttgaaatttagatttacttatcacaccacttttttcggcgcgctttttccagaaaacttttgggaagaaaggggttcggcggtgccgataggcgccgccgggggaaattttgaaaatttaagtgcgatttgatacagattttcaacaaaaatggcttcttttttgggattattaggctcaatttgtatggattttctttaaaaaaatgataaacatgtgtcctttaaaagaaaaatataatgaatcatatttctcgataggaaaccaatgaatatacaaaaagaaaattcaaaaacccccgccccacggggctcgaaccctaatttaaatatgcaaagtacaaaagcgcctcttttgtccacaactcaaattacacctaaggtaagggaggtcattaccactgaagcaccaccaattacaacaacgcaaacagtaaaaattgagctcactacgaagccgcgtaaaattgagccaaaggttaaagtggaaactccaaaatccttctccaaaggcattcaatttaaaagagtaataaatgaacaacaaatttacaaaattatgggaattaggaaaggcacaatcctgactactacaattccatttataagtacaactcaagcaccaaaaattacaaagccgaccacagtaagttcagtaacggtaccaaccaaatcaagtcaaaatgtaaaaacgactatgaaaccaagggttgatacaaaattaccgtttataaaaactacggtaaaaccaacggtaatagtcacgacaaaaaagacttctaaaacaatgccagtaaccttggcaccaaaaacgagaaaa

SEQ ID NO: 31121 - DNA, 1458 bp, Heterodera glycines
ggcagccgaagagaaagggcgtgtccgaagggagggaaagaggggagaggcgaacagagacggcgaaatgaagccgaattgctggataatgtgggaagatgacgccaagggtagaaacgaaatcatgccgatttgcaggaggaaaagcattgccaaaaaagggaattaattgctaaaaaaagcattttgtttatcggaagtattcaaaaccaactttaattttcataggaattttacaaaattttgactttgtaaaaagtgatgtgggaggattcttggccaacggggctgctccatcggtccaaccgccgctgccgaagagagtgacccgcccaaagtcccaaataaatgcattcggtggtaggaggggagaggggggcggggagacgaattgcctctcatccgtcctcttgtctgcttgccgggcaataatccctcgggacgaccgaaatgggatggatgagacggggagccgaatcaatgtgagcgggtgcccttcaccgttgtcaaattcgtcaatttgggagaaaagtcttccctttgctgtagcggcatgacttaccgaccgaccccaaatttgaaaggagggacgtcggcacggcatggaaaaagggtttatgagcaaaaagaaaatggggacgttcaacacgtgtatcagcgatgagctatttcaaaaaaccaaaattcatttcaatcacttgagcatttttcgagactaagcaataaaaagaagtgatgttcgagaaaaaataaataaaaataataggtgggggggggtcactcattttacaacccgcgaaagaaacagcgaaaggttggacgaacgaatgggtcctttgctaaatatgcacacaaaataacaactcggcacttcccttccctgccaatggccttccgcttggccgagaacagctcaacccgcacttttggctgtctttttcacgccgttattgacctaatgtgtgagtggtgtcaaaatgaaactgggcggaaaataataaaaaagaaatttgaaaaaccaacagaaacagagaaatcttagtgattcgagtgaattaatggaggatttattggtccaatggacaaaaatggacgggcgaatgactaaaatggaacgaatcgcgcaaatgtaaactcactgtggcaacggaaggggcaaaacccaacagagagacgagggggggcattgtctcgagaatttcgagaacaatggggcagaggggcagcaggggagggatttgggagtacagcgagcataatttgtgagtcgaaagaatggcacgactttgagcaaaccaaaactattagggataaacgagtgaaagtgcgaaaaataaaacggggagagagggggaataacttgtaataactgacgatcggataaaaggaacgaaaaaatgtaaaattgaaaacttgtgcattattttcgagtcccaattcaatgatacatggcctgtt

SEQ ID NO: 31122 - DNA, 1265 bp, Heterodera glycines
ttttcctaaaaagttgaataaaaaatataaaacgaagagggtagtagccaaaaatttagaccaattagagaaatcccgtgggtttaagagtgggggatctacgggaggctcgacaacgggggcagtaacccccaggggagactctgattcagagtgctcgggctcctctgccgggaataagatttccctgaactcgttaggccacccagtctctgattgccttagccaatcgggccccgaatgccataggctaaggttaagaagctcctgcggagatgcccccctagtgccaaggtcggcggggttgtccgatgacctcacgtacttaaaagtggcttctttctctttccttatttcggaaagacgattggcgatgaaaacgggctgaggggaattattagccaaccaggagagtacaatttgagagtcgacccaaaaataaattgtttcaaaaggccgaccaaaatttgaaagcacgaaattttttacgcgaactgcagttaaaagacctaataattccagccggggtattgtcaacccatcatttttaaatttcttgggcctcaggcgagatttagcaaaaacaagtgtgaccgccgcgcatccattaatctctgagcgcaggtaagcagcggcggaaaagcagttagggcccgcgtcagaaaaaacatgaagttgtagtgtggccctaccgcagggggttgggcgtgaaaaagcgagaggtgggccagcccattcagccgcgatcgctgcccaagccctttcgagcgtttccccaatcggggcatcccatcccgtgtttaaatcccacaaagattggaaaaagaccttggccttaacgaggcacgggctacatagccctaaggggtcaaagagggaggcaattgagctcaggactcctctccgagtcgggggaaaattaatcgctttaggaaactcaaaaatcagtttatcccttgacaaatcccatgaaatgcccaagaccctttggacatcacccaccagcacttcttcggaagggagaccccgtaaaacggctcgatttgcagatacgaactcatggaggcgcatcccggcccgggccatcacttctcgtgccttatgtacagattcggcggcttcttcggcagtttcactgcaaataagcaaattatccacgtaaaagttgctcattagccccaatggatcccccaaagaggccaaatggtagcgcaggacagatcacagaaggaacggagaagaactcacgccaaacgcaatccttt

SEQ ID NO: 31123 - DNA, 1108 bp, Heterodera glycines
tagggttgcgtccccgacgtcggggtttgaaaattcggggttcggggttgtcggggttggaagtgtcggggttcggggtcggggttgccaaatcgttcggggtttggggtcggggtcggggtttttcaatttttgccttatgccaaatagtcaaaaaactttataaatttttacttaaaaatatttaaatttcataataatacttttatgtgctttttattattttttttatcataaatattttgtatagaattaatgaaaaacacatacctaaagcatttaaaatggccaattttcagcgaaatctgtataaatctttttttggtcttttttttgcggcgctctttttctaaagacgtttaggagaaatgggttcggcggtgccgataggcgccggcgtgaaaaattttgaaaatttggatgggcctgttaacagattttgtccaaaaaatgatagattttttcgattttgggccaatttttttaagaaaaaataggtttttttgtggcgccggcgatgccgataggcagcgccgggtgaattttgaaatttaaggtctattttgtaacatattttcaccaaaaatttatgaatttctggtaaatttttattttttttctttttttttggaaattttcatgatttagtcaaaaaattgaatttttattcaaagaaaaaaaattgggttcaatacgtctataaattatgccaaggatgattgattttaatgggtatttttggtttaaaaaatcttattaatcatataaaaataaattaaaaaggaaaaacagccaaccggtctcgaactaataataaaagtgctatcagtgttgaagcaacaaccactaaaccacaaaaacataagaaagcatatgcaaaatttactatatttcataaaaatttgtcaagatggttaaaaaaaatcaatttttgtataaatgttttgccttttcccccacaaaaatgccattctttggggtgtatatttaaccccgactcggggtcggggttcgtcggggttgggagcgtcggggtcggggttaaccccgaaaaatggccaaaaaagtcggggttcgaggtcggggcggggtcggggacgcaacccta

SEQ ID NO: 31124 - DNA, 1220 bp, Heterodera glycines
gtttttgattaatctaaaaataaaatggacttttaagttccggcggtgcgggtcggcgccgccgaagaaatttttcttgaaatttggccatgtttcttaaaagatttacaccaaaattgccaattttgtatctttttggaccaaaaatttaaatacattaaatcaattgcaagtaaaaaaattttgaaaattttcgttcgtttttaacagatttagttcaaaaaatgacaaaattttaattttaaaaattaggagaaagacaactacttggaggcgaactgacccaaagcaaaaacaagaaaagaacaaagaacacaaccaagttggccacgaatgtttgaagccgaagccgtcgtttcgcccgtccctgctcgagacaaacactattctccgaaagattatatttttagctaattgtatcaaaaataaattgttattgattgtatttaaatatatgatttgctagaaaagtctaagtaattttcaataataaatgattttctagatttttaagtgtattaaaaagttctgtaaaataccggttatctctagtctcttctggtcaagtctaactcgtataatgaatagagaccgactaaaaagtcatctaaaatcgcgaaaaaggcactataaaaggcacgaaaaaattgaaaaaaagtatgaaaaggcacgaaaatcccgaaaaaggcatgaaaaaaggcatttaaaatttttttattaatgatttttagggagcaaaaacacgcaaaagttaaccaaaaaattaattttggtcatttaaatcattattaattattttataatgtttttcgaagaaggaaaatttttaaacctaaaatttttatcaagtaaaaaatgaaattttagcgatcatttttttaggaaaatttttcaattcttaggggtttattttttgaacaattttcagttcatttcttagggggtgtattttctgaaaaattttaaatcctttcttggggtgtattttcccaattttattaaatttttaatggaatttttcggaaaaaatgccaaaaaaggcaccaaaagggaaaaatgccaaaaaggcagttaaggcacgaaaatcccgaaaaaggcataataaaagtcaacgtagaagcctcaaaccaagtgacaaatgtgttatttattcttaatatatcgaaacaagtgcgcagaagaataggcatatgcctcaaaagtcggtctctaataatgaa

SEQ ID NO: 31125 - DNA, 800 bp, Heterodera glycines
  misc_feature (783)..(783): n is a, c, g, or t
gtggaacgttcgcgcattttcaagccgatgccgtcgccggatgagtactgcaagaacactcatttcccatcaaatactattgttgacccaacattgatcagcaacactgatcaaaatgataaagtgtagggctggcaaaattatacggaaatccgagattttttttttgttggatttttgaagaatgaaacgcacaaaaactgtttttaacttggcttgaagctgctaggttgtattattctatatccaacttttccagcttttgcaaattatatcccatttttccatattttttcattggcattttggccatgttttgccatttgatatcaagaaaattttggcagcctaattgtcaactaaaaattatataaaacaaatttgtataaataaatacgaataattttctttaaatttttggtcaaatgttaatcaaatttcccattttaattaaaagatgttgtcattttaaatgtattttaaaaagatttagcatttaatgtcattaaattatgacacaatattttctgtttgaaaaggtttaaaaaattgtgagatatcaaatgggatctgaactagggtatgtcggggccgggaattttcgggttgaaaacccaggattttctagctgggaaaaccgggaatttcccggtcccggtcaaaactggccaaaaccgggacttcggtattcagttgtactcagttgtccgtgttttggtcacaggtcccgaccaaccctaattttttcaatagtcgaaaaattttagcgctcttctttcccanaattaattaaaaaatat

SEQ ID NO: 31126 - DNA, 698 bp, Heterodera glycines
ccaagacccctgcccctgtaaccttgaggtacaattgcactttttaaaaaggcgggggtccgggacccctgcccccgtggcctaaaaaaacattttttttttttttttacattaactaagcaaaaaccaaagacccttgccccggtgaattatcgtccatcagaattgattctccgccgcgatgattgatccaaggattccccctcttccccgggcgagttgttatttgaagtgaggctaattacagttgaaaaagagagatggatgagaaataaggaattataaaaataaaatattttaacattaaaataacaaaattccatcaaaactaattaaatgtttatagtaaaaaggaattaaaaaacagttattatattaaaatcagacggggggggggaaaatgagtgtcgggatgaagggaataaatgttacacccagagggtgaatgggaaagaatggaaaacaaaagaaaacggaaaacgtaaaatttcaaataataatttaaagaaaaaacttattaaatactttttttggttttaggaggtttaacgagacccttttttaaaaatgaatttgtttgaagtgatggaggactggtaattactctcacttttatatgacggccgggaagggatagggcggggataattatgacgtaaagaggagctttggtgcctaattctggaaattttgatttg

SEQ ID NO: 31127 - DNA, 1211 bp, Heterodera glycines
taaaatgttattttaagcctatttaggtcattttggcccttcttttactcctttctactaattttttgtcccaaaaaattcatacaattttttaaatttaatatacccatttcatgtacttagtattttcgggaattcattttggcttggtgtttaggtaaaatttaaatatttggttggacaacgcactgggtccacgatttacctaaaaacatagaaaaacctctaaaatgagcgcccgtagcaccgtcggttagagcattgcacagttggaaaggctgtgggttcgagtcccaccgggcgagtcaccttttatgcttttttaaacaaataaatatttttaaaatactttcaaagaattggcaattttggtgcccaaattttgtgcgccattttggcttacaaattagtttaacacaacaccgagggaaaagaaaagtaaattagttttataaattaaattttctttttttagaaaatataacttggcaaaaaacgattttattagcaaaaatctgattgaaattgatatgaatcttttcattcgtccaatgtcaacaccaaacacaaatgtcgaagttggcacgagttcaaatagcagcgggtgaaaagagaattttgaattttttaattttttaaaaataattaaattaataaaaaaaatatttttgcgaatcttccagaatttttggcaattttaaattaatttaaataccaaaaataaattatcaacgaaattttaatttttggcaagccaaaatgcacataaaaaatgaatcctaaaatgacaattttcccagtttttcttggctaattttgcgaattttgattggaattggaaaaattttgcttcaattttttttcaattttaattctaaaaagcatagcatggaaattaaaaaaaaattatttttatgaccaaattataaaactcaaaaatacaaaattattaaattcaaaattattaaattcgaataccattcgtccaatgttaagaccaaataccaatgtcgaagttggcacgagttcaaatagcagcgggtgaaaagagaattttgaattttttaattttttaaaaataattaaattaataaaaaaaatatttttgcgaatcttccagaatttttggcaattttaaattaatttaaataccaaaaataaattatcaacgaaattttaatttttggcaagcaaaatgcacacaaaaaatg

SEQ ID NO: 31128 - DNA, 1695 bp, Heterodera glycines
  misc_feature (76)..(76): n is a, c, g, or t
tttcaaggacgtccttgccatcaaaggacggatcccatccctgctattaccacataaaatttatataaattaatgnaatatcattagctttcaattgatgtcgtctttttccgttttttaattaccatgacaacaagcactattcaaccattcacattccattcatcattctcaacaacacttacttttacccatttattttccattttgccactgatttggtgttaaagaaatgtttgagccggcttgtgaattccctgtcaaaacgggtgcctcttttctgtccaagaatttgtccgtttttcataacaaggcaaaggggcacacattcgctgcgtatttgggcaaggattcggtgggtcaaagaaaacaattggagaaaaacctcgaaatatttaatagtacaaatcagggtttgccaattcgaaattgattttttgatggtgtttaataagcccggacgggacttttggtactgagaccggctttttctctaacaaaaatttctcaattaaaattttggaaaactttcaaaaaatccacaacattttccgctactggccttataatttaatttgaatgaaaacgccgactggcaatggcattcaaaaatgcccgtttgtgccatttttagaacgggcttttcgttataactttctttaaacgaatcgggtattaatcaaattatcaagcattaatgttaatagcagagatatttttgagaattttttcaaaattcccgtccgggctctagtgtttattaatgtaaaaattagcacaaattccaataaattgatatttttctgtgcaaagtgttaacaattgcattaatatttcactaaaagcgatggtacccaaaaacccgggtccataaaaacagttgggatgatccggtctcataatcacaatctggacctgtggattcattcacattagggtttgtcctgataaaacagttttttaaagaaaaataggaaatttttccaatgaatgggttttgtccattttggcgcagattcaaatgatgagctggaatgagtcattggagcagaacaattgcgagctgattaatttggatgagattttaaagaatgcgggaccaagcggagagaagccggtgtctttgatgcaggtgtacggtaggtaattaaccatacggcttggcccgaagtcctcgaggtcatttattccactcaataattgctaaaaatacccacacagtgttacatagtgtataaaaagcaaaaaaaaaaaaaatgacatgattatgcgaattcataattacatagaaataatctaattaaaattgaactgctataatgcttttccgtttttaagtgtgccttccttcgagccgaaatggtcctgttttggtcctcctggcgaccacttttgtgtcggtacgagttattttcatgtgtttattaagaaaacactagaacaataatcgttcaaaaacagctcattgacttcaaaacgcgcaagcacattctgacacatccgatgacggacattcttttgcaagcggtcgctgggagcaaacggacgctaaaagcaacgccatttaccagaggtgtaaaaccaaaaatgagggcccagattttttagtttttcagtttatttaaaattataaaaagttaataacaaagaagaaaggtttgcaatttaaaaaaaataaaaataattttaatattc

SEQ ID NO: 31129 - DNA, 942 bp, Heterodera glycines
  misc_feature (935)..(936): n is a, c, g, or t
attaaatatttaataatttttttctcgaataaggaaaatttttaaacctaaaattttttatcaaaaaaaaattatatattttggcgatcaatttttgagaaaatttttaaattcttaggggtctattttctgaaattttttctgtcattttatttatgcttaataatcggaactaatgcgcagaaaaaagcatatgcctcaaaatatgttctttattgaagatttcctcattagaaaaaaagacttttaaacatctttgtgtttgggatggttttttaacaaattttgaaattatttttttaatttaaatttaatttacatcattttctgtaaaatcccagcaaaggtataagctcaaacatttctcttaaatgcccaaaaatttttcatcagtgcttggatttaaaaaaattttttctaagctctccatcgcctccaaatttaaccgtaaatataaaattattttttcgggttacaaaacaatatgaacagtacatcagtttatagatagatgatttaatttgtttcgaaattgttgaagattaataattgatggctttcaaaattcttctaattgatatacaccattagaaataatttttatttcgttacattttttagtgttgttttattttttattatttatattagagctcaccattttgacaaaaagcctgaatctggatctggatttcatgttggacatggaccttagtctggattccctgttggacctagacctactggagcctgaattttcttgacaaaaatccttgaaaatccaggcttttcatggcctgaacctggcagtggacgccataatgattgtatatttaaaaaaatcgaaattcttgaatttctgaacctcttttttgaaacttaacaatttagagaagataaaagggcgccagttaaaaagtttttagaggtgaccnntgcagg

SEQ ID NO: 31130 - DNA, 1203 bp, Heterodera glycines
  misc_feature (16)..(16): n is a, c, g, or t
  misc_feature (31)..(31): n is a, c, g, or t
  misc_feature (63)..(64): n is a, c, g, or t
  misc_feature (1193)..(1193): n is a, c, g, or t
ttagtcgtggaaagcntaaaaaattaatatntaaatgggttattcaaaaaacctcatcttccnntgattaagcatgccttattggcgataagctgattctcaagtgcattctgtaattttcgagttacaatatttggatacatacaaaaattttatatttattagacaatgttgggaatttcatttaaatatatatataatatatattttttctggattcgacatgctctaaaaagtaagaaactactttcttatgaaaatacaaaaaattaaaaaaaaattataacataaaaatttttttttcaaaagaaaatgtcaaaaaatccacctttaaaatatctaaaaaaattatattttaagtttatatttgtgaatttaatccccagccctatccattagccatcaatttttactttaactaaattatttgtttattttttaaaacatattgactcttttgcataccaaattttccatgttttttgcgtcctttttaaagcctttgtcattctccaaaaagttcaacttgaccaatatatttagatggtctctgatcgcctcaactgcgttttaaataaattttaaattaaaaaataacaaatgtttttgtaatagaattttcagaatgaatttaccattcttcattttcagaaaaaattattaataattcacgctattaataaaagaaatcaaaaaaaaaattacatggtatgatgaagatgaaaattaattgcattaaaatgctgatttgtgtatgaaatttcgtatgcatcagtatttcagcccgagtcccattatgtatctgcccaaatcccgaccagaattttttagccatcatggcacgaatcccgttcccaatttttcgcgccccaaaatctgcgtcgtgacccgaaagattttgatccatcccaaccctaatcccggtccctatgttttccaagtcccgcggcaacccgtttgtgtgtgtgtactcaaatctatgtaactttgcgagagtaagccaaaatattttctaaaattttttaacccattttggaaaaaaataaagggaataaattgagttacaaaaatcgatctaactcatattcatttaaatattaaaatctcatccctaatgatatgcctttttaatatatttaccgtataatggtcgtatttcttcaatcactttctgaataaattctttgtccaangggtgtcttt

SEQ ID NO: 31131 - DNA, 1091 bp, Heterodera glycines
gtggtcactgatcagctagctttttcccacttacaaatggtcgactttggccattgtttggccatttctgtccatgtggtcgcttccctcgggtacgcttcgtctttttctgcttcttcaatatttttgcgcttttcattcttctcctcagtaaatgccgtgctaattaatccgccggttgaattttgccgatttgtgccgtcgtttccgttccctttccatggattatcattggccatattgccgaaacaatcaaaagaaatttaaaatttttatttaatttgttgccaatttacaaatttaaaaaatattccctcaaaaagaaggataattttaaaagattattaagatattttaaaatgatttcctaaaaaatacagtaaaattacttttaataaatcgttgaaatgtttaaacatttggtggtgagaatgattaatctttctgtcaaactttttttggtgtaaaatttgagcaaaaactaaaaaatgactttgggtttggctgaggggggggggggagggggcgatgactttccccccttttccccctttttcctccttttttccccctttttccccaaatatttgtcatgccgtcgtcccccgccgcccttctcccgccgatctttcgtttggtcctttctcccctttgcccttatcgtccgtccgtcaaattttgttttattttatttttattttcgctgataaatggcaatttttgtatggcctttaaattggccgaattaaaaggaattaacaaaaattttgttttatctctgtaaaaaataagccgaataaattgcagaaatgactaaataaatgttttatgttttatgaatgacaaatcaaatgcacagaatgatttatggcccaattcggcgcattctccgccgttttccgtccgttccgtcgcccaccgatcatttgttttggctgctcttcacaatcgaatgttgataaaaatggcaaaataaaaaataagaaaattgaaaaaattaacggaaaaaataaaataaacaaaagatgaaaaaattaatacataattccaaagaggaaattaaattaaatgaaataaaatgaacctaagaa

SEQ ID NO: 31132 - DNA, 1110 bp, Heterodera glycines
tttcaaaattttcaattttttttattttatttcaaaattttcaattttttttttaaattctcaaaacggttcagaattcaataaaaataacattcacggtgcgaaaaatggggtttgaaaagtttattggggaaaaaaagactttacaaaaataatacccctgggagaagggagtgggaaacatgatttcaaaattttcaattttttctagtctaatctactcaaaacggttaagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataatattcacggtgcgaaaaatggggtatgacaagtttattggggaaaaaagactttacaaaataatacccctgggagaagggagtgggaaacatgatttcaaaattttcaattttttctagtctaatctactcaaacggttcagaatacaataaaaataacattcacgggcgaaaaatgggagggtttgacgaagtttattggggaaaaaagcctttacaa

SEQ ID NO: 31133 - DNA, 1055 bp, Heterodera glycines
ttgtggaaaaagtcctgaaccaagatgattcaatttttgaaattttaaatttcgactgcaaaaaatagctgattatttttacaatactgggcctttcatacatcgcaaaataatttcatttagagatcgacctgtacctggatccaggcctgtatttttcctggatccaggtacaggtacaggcaaatttttgacaacctgtattatttttgaaattttgcttaaaaattcgaaaaaatcttataatttttacattttagcttagagttatctcaagccatgtaaatcgaccttttttgcttttcaaaaccctttttacaacacattttttcaatgagatttggcgtacaggggggtccggcaataatgaatcgtccaatgatgatcaaataataaacattcatatattttgccagtgtcatcagtgccgcagcaattatcgccaatatattgttgtacagaagtgatttacggcgccctaatctgtccgcaacagtgccaaccataatgccaccaaacattccgccaatggcaaaaatgccgaccgcaaatgccctggacaattaattaataaattaatggaatgaatttattgaataataatgataatttttcaaagaattagtacagttcattaaaaaaattatgccacaaacattcgccaacggcaaaaatgccgacggcaaaagccctgagcaattgatataccctattcagaaattcgaaaaaaaaattggtttaaaaaaaatatttaaataatcaaaaaatttcaagtggaaaacccccaaacagaaattttagcgccaaataattttctggaaaatattaaattaaataataaaaattcaccatgtcgattccatctcttccactgatatcggaacccctttcatgtgcttgtacgaattcagtgaaccattctttgattaagtcggctggaaaatttaaaaaatattataaaactgggtgaaaaattcccggtttttcctaaaattaaaaaaaaaaaaaattttagtaaaaatttcccgacaagggtaaaaaaaaaaaaaaaaaaa

SEQ ID NO: 31134 - DNA, 1128 bp, Heterodera glycines
cccgatgctaatctgttccgcagagcctcttcaaaattttttccattaccgcaagagctgcgggaaattgggaataattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctcgttttaggacaattttctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctcgttttaggacaatattctatctcgtaaccccgatgctaatctgttccgcagagcctcttcaaaattttttccattaccgcaagagctgcggaaattgtgaattaattctcagaaaaaaggctatctctttttaggacaat

SEQ ID NO: 31135 - DNA, 989 bp, Heterodera glycines
tcatttgagtgttgagcagaaaaagagatagacgtttttcaaaattttcagagccaacttcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctactattccgaaaatgtggttggaattcatttgagtgttgagcagaaaaagagatagacgttttttcaaaattttcagagccaaactcgcccagaaagaaaatccagaaaaattagggtcgtcgctactattccgaaaatgtggttggaattcatttgagtgttgagcagaaaaagagatagacgttttttcaaaattttcagagccaaactcgcccagaaagaaaatccagaaaaattagggtcgtcgctactattccgaaaatgtggttggaattcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaattttcagagccaaactcgcccagaaagaaaatccagaaaaattagggtcgtcgctactattccgaaaatgt

SEQ ID NO: 31136 - DNA, 1836 bp, Heterodera glycines
aataaaataaattaaattaaataaattaaaataagataaaataaaataaattaaattaaattaaattaaattaaaaaaattaaattaaatatatataaataaaataaaataaaattaaattaaataaaataaaattaaattaaattaaattaaattaataaaataaaataaaattaaattaaattaaattaaattaaattaaattaaattaaattaaattaaattaaattaaattaatttaatttaattaaattaaattaaattaaattaaattacataaattaaattaaattaaattacataaattaaattaaattaaattaaattaaattaaattacattaaataaaaataaggaaaaataaattaaattaaattaaattacataaataaattaaattaaattaaattacattaaataaaaataaggaaaaataaattaaattaaattaaattaaggaaaaataaattaaattaaattaaattaaataaaaataagaaaaaataaattaaattaaattaaattacataaattaaattaaattaaattacataaattaaattacattaaataaaaatacggaaaaataaattaaattaaattaaattacataaattaaattaaattaaattaaattaaattacattacattaaataaaaatacggaaaaataaattaaattaaattaaattacataaattaaattaaattaaattacattaaataaaaataaggaaaaataaattaaattaaattaaggaaaaataaattaaattaaattaaatcaaataaaaataaataaaaattagcagttttgcacgacaaggggcgggcgcgaagcgaaaattttttgtttgtagttaacatgagatataattaataaaatgaaacaaatttaaaaagaccaaaaacacaattataatagtgaataatcgctcaaataaaaaattaaataatatacaacattgtcttaatgaaaataaaaaactaaattataaaaagaattttgaaaatataaaattattaattgaaattaagtgattaacatatttttaaatttactattattcaattatactaaaaatataattaattgaaactggattttgatgtttcaagccttattcagtgcctctaaaaaatgaaaatttttatatgtttggagtgtttttataatttccaggaaattgtaattcaacaataaaaggtttatttttatgaagaaaaaaaaattaaaaagcaaaattaagaaaaattaaagaaataatcataaattaatctttaattaattagaataaataagcattcatttttgttttttaaattaaatatttaaaaatcaaacaattataactattataatatagaaaataaattcgaaactttataaaattaaatgaagttaactatgattattcataaaaataaactcttaaaacattgacaaaaattatcatacacaagaactaactgctcatattgtcaatttaattttatgaaacatataagtattagtagtataaggcccaatatccggccccaaaatttggccccatcccctccacgcttccacatcctttcttctgtttttcaatattccatttcccatcctttctttgcatagttgcaaacggagtcagttgctgctgccccctaatttcacaaaacattccgcgcagtaattgacagccctccctcaccatctcccttcgttcgcccgcttcactcttcttgtcccccttggtcgtactcctaccaaaccaattgctcacaaatagatccgcagcttactttacaagttccttaaattggggagataatgagccgcttacattt

SEQ ID NO: 31137 - DNA, 1120 bp, Heterodera glycines
aaaattttccataaattgtaatggcatccggggccgccaaatttccgtaaatcgaaatctggtgacacaaatttccataaatggttcattggaatccggaggccccaaaaatttccgtaaatctaaatcctgttccaataattttccataaattgatcattggaatcgcaggcccccaaatttccgtaaatcgaaatcctgttccaaaaattttccataaattgatcattggaatccgaggccccaaaatttccataaatcgaaatccggtgccaaaaagtttccataaattgttaattggaatccgaagtccccaaaatttccgtaaatcgaaatccgatgccaaaaagtttccataaattgatcattggaatccgaggccccgaaatttccgtaaatcgaaatccggtgccaaaaagtttccataaattgatcattggaatccgaggcccccaaatttccgtatcctgtgccaaaaattttccataaattgatcattggaatccgaggccccgaaatttccgtaaatcgaaatccgatgccaaaaattttccataaattgttaattggaatccgaagtccccaaaatttccgtaaatcgaaatccgatggcaaaaattttccataaattgatcattggaatccgaagtccccaaatttccgtaaatcgaaatccgatgccaaaaattttccataaattgtaattggaatccgaggcccccaaatttccgtaaatcgaaatctggtgccaaaaattttccataaattgatcattggaatccgaggccccgaaatttccgtaaatcgaaatccggtgccaaaaagtttccataaattgttaattggaatccgaagtccccaaaatttccgtaaatcgaaatccgatgccaaaaattttccataaattgatcattggaatccgaggccccgaaatttccgtaaatcgaaatccgatgccaaaaattttccataaattgatcattggaatccgaagtccccaaatttccgtaaatcgaaatccgatgccaaaaattttccataaattgatcattggaatcccgaagtccccaaatttcccgtaatcgaaatccgatgccaaaaattttccataaattgatca

SEQ ID NO: 31138 - DNA, 1854 bp, Heterodera glycines
tttttccaatttttatttttgtttccccccctcattaagcaaatggccggtgactccgaccgcgacccgggcaggcatcatcaccacaggcatcatcgacatcgtcattcagcgcgcacgtttttgagaaatttgggctaccaatcaccgcacaaactgggcagtggacaatacagcaaagtctacaaaggtggttcacaattccatgtgcttttccagcaccatttcccttcccttttcagtgtttgatgccgaacgacctgccgggcgtggatgcagcaactgaccaacggagtgtcctatttgcacgaaaatcgaatcgcgcatcgggacttgaagccggagaatattttgctcttcgaacgtggcgttctcaaaatcaccgactacggcttcgcgaaacaggtaatgaatgccacgcttcaacacaaacgttcaatttcctttttcagtgcgatgatggcgacatgtcttcaaccttttgcagaactaagctttacaaggccccggaactgctgcagaaacatgaatatgacccgttcaaagcggacgtttggtctgttttgttcgtttccattcactgcttttttcatcttcccttttcatttcaggtcacttggcgtcatttgctttgttatgcggaccaacacaatgccgttcagcagaggcgtgagccgaacacacatggtggaggaacagcgaaacagtcaataccgattcccttctcacttggtcatcagtttgcagtgtcgcggcgccattgacacgattttgacgtttgatccggagcagcgtccggtgagcactttttgtgttttttgaattttcaatttcaattccttttttcagagtgtcttcgatgtgtcaagtttgccgtggttttccgaagatgtctctgaacgttctgggagttcttctgatgtgagtgccaccagtgatacaccgctccttaatgtatttacttgcctctgtttgtatatttctgtgtatttgtgatacaccgctccttaatgtatttacttgcctctgtttgtatatttctgtgtatttgtgatacaccgctccttaatgtatttacttgcctctgtttgtatatttctgtgtatttgtgatacaccgctccttaatgtatttacttgcctctgtttgtatatttctgtgtatttgtgataacaccgctccttaatgtatttacttgcctctgtttgtatatttctgtgtatttgaataaatttcatttaatttgttttgactaatacgtccatgcgtgatgaaatttggccaaatttattgacatttccttccccattcaaacaccgaaaagtccttgccaaatgatttgcaactagaggcgaatgaccttttgaaggcgggggccttaaatatcaataaggctatacgccttatgacaagcgagatttctgccagcactgatgcttggaagtcatcgcacgtgcgaaagaggccattgatttgccggaagacatcactttgtggtaaattttggaagtgcggcaaaagtggggccgacttttaatgattcattttggtttccaaaatccattggtatttccaattactatcagttttcatttttggcacttttggaagtacggcaaaagtggggccgacttttaatgattcattttgggttccaaaatccattggtatttccaattactatacatatttagtaacctttcggacatcagtcaagattgggccctcagcgcccgtctgaggccgcgaagcggcctaaaaattccagataatcttttaaaaattccaaatctcttcacaacgcaatagcatatgtaggtagcgaagctccctaaagcgcgaagccctttttcc

SEQ ID NO: 31139 - DNA, 959 bp, Heterodera glycines
tttacctataaattggctaattttcagtgaataactgtttataaatgatcaaaatttccaatttttttccccagcggcgcctatcggcaccgccgcgcccccaaaactcctattttttcttagaaatggcccaaaatcgcaaaatttggtaatttgatgaaaaactgttctcagcggcgcgccaaaactcttatttctcattagaaaaatgatacaaaaatcacaaaatttgatgattttttggtgaaaatctgtcaacaaattttaatcaaattttcccggcggcgcctgccccctcttcccaaaaagtttttttggaaaaagcgcgcctcaaaaaagcgttttattgatttttaaagttggaataaaattttaaaaaatgctttttgctttatgattttaactattaaaaagttgtagaaaaaatttcgcatttcgcatattttggcttttcgcatttcgctttttttttcatttcgcatttttcagtttcgcaaatttcgctttttatttttcaatttggcccatccctggtggggagtcagtcattaacccatagcgacaagtttgaagcaaaagtctgggaaaaattgccgaatatggtatcggctcaaaatcgcacaaaaacacttttataggttttcttaggtactgggaacgatagaaaagcttaaaattgggcgcggaaaagcatttaaactggtttttgaaccggtttaaaactcgaaaatttgaatgaaaaagagggctcctgaccttttaaaacggtcaaattcggacaaatttggtatcattcgaaagctcttgatgagctaagtctaaaaaacaaggtatcaactcgaaccaatgccatctaagcactgggacaactgagtcccagagaaaatggacacttcagtaccaaaataaataaccatttaaaaggaaaaatttcgcaaaaggtagcatgcaaagacgga

SEQ ID NO: 31140 - DNA, 1150 bp, Heterodera glycines
aaaaaatggtgtctgccttttttcaatttagctggcgcacccgtaaaaggaaatacgaaatattaccgggatacaaaattaaagtaacgggactttttagaacagaacgaaaggatttatttggttaaggataattgttggaaatcgccatagatttggaccatatgcgaaaaattcgcggtgaacgtaataaagaaaccaaccagcattgacttgtgcaatccgactcgttaaaataaaatgatctttaaaataattgcataaatttatagggacagtatatataatgtctttacttgtaagtttggggtcagatgcgttcagaactgacggcacactacatagtttaatataaaaaatgttgtctgccttttttcaaatttagctggcgtaattgtaaaaagaaaaatacgaaatattaccgggatacaaaattaaagtaacgggactttttagaacagaacgaaaggatttatttggttaaggataattgttggaaatcgccatagatttggaccatatgcgaaaaattcgcggtgaacgtaataaagaaaccaaccagcattgacttgtgcaatccgactcgttaaaataaaatgagctttaaaataattgcataaatttatggggacagtatatataatgtctttacttgtaagtttggggtcagatgcgttcagaactgacggctgtaaaatgaaatacgaaatattaccgggatacaaaattaaagcaacgggactttttaaaaaaaaccaaccagcattgacttgtgcaatccgactcgttaaaataaaatgagctttaaaataattgaataaatttatggggacagtatatataatgtctttacttgtaagtttggggtcagatgcgttcagaactgacggcacactacatagtttaatataaaaaatgttgtctgccttttttcaaatttagctggcgtaattgtaaaaagaaaaatacgaaatattaccgggatacaaaattaaagtaacgggactttttagaacagaacgaaaggatttatttggttaaggataattgttggaaatcgccataaatttggaccatatgcgaaaaattcgcggtgaacgtaataaaaaaaaccaaccagcattgacttgtgcaatcacgactcgttaaa

SEQ ID NO: 31141 - DNA, 850 bp, Heterodera glycines
  misc_feature (801)..(801): n is a, c, g, or t
aaacgtctggaattattcttgtgctgatcaaaaatagttaaaaatagaacatatcataatagattctattgaaaattttattgaataaagtggttaatttttgttaaatttttaaatgagtaatttggggccgcaaaagtcgggccgcaaatgtcgggccgcaaatgtcggggctccgtgataataccggtggaaaaatttatacaattgcaaatgaaaaaatttggtcattttaaaacactagaaaaaaatttttttttgttttaatttttttaaagaaaacgacgggcggagaggagggagattaagtggttttcaaaaaaaaaaagttacccatggcaaagtcgggcactgccagcacatcgcacttgggcaacggcatcggaaagtcgaaccaatcggtgagaaagtcaactgcttcggtgaccaacttcaacgcgagcttggcctgctccgttttgccgggcaaagtgtacacacggcagacacagcccgtcttggacacggcctgcaaaaaataaatggacaaattgtggacggacagcaaaatgccaagtcaaacaaacaaatgccggaagagattggggaacaacaaccaatcaaaccccaaaaagttttcgtttttttttctttgaaagttaaaatatagcccaaggaatgaatccaggtcgttccccagagaatcctatatttaacaattgtaagagcaaaaaaggtctccggattgcccatccaaaacttgttttttctggttacgagccggttgcactacgcttccacaccgtatcgttacactcccanaaaatttttttgaaaattttccaagttgaaataatttcgaggggggggg

SEQ ID NO: 31142 - DNA, 1535 bp, Heterodera glycines
gattataaattgcaattttttttatgcggttcctaccccaccgcttttgacaccccccccccccccaattttcctgcgcctaagattttttttaatttgtaagaatagcttagtcaaaaagaataactttacaatttacagtttgattgataaatatgtaaattgaagcccaaacccgaaaaaagcttacaaatttgttatgaaaagctcaaaaattgattaattttaattggttttaagtgaacaagaaaattttattaaaaaactctcgggtcttcggtcccgtgtcacaattttttttttttgtttgcaattattgtcaattaaatttagtccgctttatctattgctgaccatcaaattggcactgaacatggagaagcatcaagccataaagatgaggacaatttggcaactgagaaaagtggcttattttttttttatcatttaaaatataatcataaaataattaattttatttatatttttccattttttagttgaaaatggatttaatttgtcattatttatttctctctttgttaaagcaaacaaatttttaaaatattgcacgataaaattggctaaccaattgacatgaaaattggtttctccggaagctatttatcatttttgttcatgacccgatttttaagtgcagtcgactataatatttttccccaaatggggctttagttataaaatcaatttaaaaatatcagaccattttcccataaattttgtaaattttaattaaaattaaaaattaattcattttcaagtgattgccgaatcggcaacggctgccatgcaatgttcggtggacagcttggaaatgatgaaaaatgagcaacaccaacaacagcagcgcgtgatgatggaaacttcggtggactcgttggaatttggcacaaaaatgacaacggcacaacaaaaggacgaagcagaaatagaagcattgttgctggtcgaacgagactcgttgagcagtgcacaaagtcagcaacaggacgacaacgagttggagcagtacagcagcagtcgaacagggacgacaatcacgacgacaacgaccacaatgacggaaaatgagcggaaagcggaagagcaccgtaagaaaacccctgaccgggacaccgtaatggagttaaacgatttttcggttttgtgcctatgtgaagatagacaatctaaaaataaaaaactatttgaatttttcatatttttattggattggaagaagtttttttgaaatagcatggaaaaattttcaagtaatgagctgatttgattttataatttttttcccaattttttaaattttaattatttatttttagcaacatcatcttcattcccattgcctttgccaactgctgctggaggcaatgggtaacatttaccactaaatactttttttttttttaattattttaaatttatttttgtctgagattctcacgcattctctatacatatacattaagcaatggttcacgcggtggacatcggctcaattgctcaaagttctgcaa

SEQ ID NO: 31143 - DNA, 476 bp, Heterodera glycines
cgcgctaaaaaaatgatttttttcaaatgattttttattgaagcgattagattttttggcgacatgtttatgaatttcaaaaattttctactaaataaatctgtcggaaaataatccacccgtctccatttatcccttcgtatcttctaatccctcccattctgaggaggttaaaaaataatctccccggtgggataattagagaaaatagtaggttcttttataacattgttacttattcactgtttttaataattttcaacaaaaaccaccattttataattttatttatatattttcggtacaatatttttttttgtacacgtttcttgcatacaattaattgttgggttcatttggacatttgcaaaacgacaaattcaccgcgtggccatgaaaatgaaccaacggtaaggaaattttaaactttcaaatcctaatatctatgtaattatcccgcatttcagttggatttg

SEQ ID NO: 31144 - DNA, 1092 bp, Heterodera glycines
ttaatacctcttcctatttttcgataattaaatttaattagaaagaaacagaaaaaaaatttttttagcttttttaaataaaagcgtttactattaaattagaaagaaagtgaaaaagaaaaaaattgttagccaatgaaaaaaaaggaaagatgagaaaaattggcagataaacttttctggtttcataaagaaaataatgcaaaatggtcataataatttctctattttgaattaattaaaaaataaaaattaatcttaaaaataaaataatactcacaaaaataaattaaataatgcatgaaaacatcaggaatcggtgggacccgaaccatcgagccacaaaagcacaggaagacgcactaaccacttgaccaccgagtcgcttgcctccttcccatttaattcccttttccttttccttcttttttggaaaagatcccgatcaaaagtgcttgaaatcctttttagagcatttcccggacccggacccacaaacaaccctgctatcattcgaaagccaagagtttgtatgcgaaattgtttcattttttgatttgaccacttttaaggcatgcaaaaagcgttcaaaaataggacaaccaaaaaaactgcaaattttgactcgttttccgaacgcagttcgaacagttctgaacgttttagaaaacccgtatttttcccttataggcaggccaaaaccctattgaatgacaccactcccgccccgtaactctcaaaaagacacgagattttcatttttatgcttggatcatgggtagaaacttcttatatagggaatttttgaattttttaaattttgaaaatttttcatttggccctcgggaatttgggctattacctattttgaaattcataactcattttaaagtggttcaatttaattagaataaagctttaaaaatagaaaatttgattttagaatttgggaccaaaggggggagggaccacatggtttttgagtgggaaaaattttttcacttaaattagctgaaaatatttttaacgggtattttagcgtgctaataaacaatctttaatcagaaatcgctttcgaaatcgttaaagccc

SEQ ID NO: 31145 - DNA, 1186 bp, Heterodera glycines
ccccttttctgaggaggttgaaaaataatcccccatgcggctataattagagcataaacggtaactgtttcaaccagaaattttttgtgataaaactgattaaaacttttatataatttttttacgatttcttggttcgaacaattctaaaaaaatttcctattttttttttacaattattaaggcatcacgcagtgtttcggcaacacattgtcaattccttggccacaatctgtcccggtgccgtcactgtggagccattgctgtcttcatcctcatcatcgtccacgccggcaccgctgctaacaaatttggaattgaattggaaactgttgcgacggttcgccaacaacatgtgggtgctgcgaagtgacgacgtcaaaagcggtggcggcgaaaacagcagcagccgaagtgccaccgcaaatgccgaagacggcggcgacgcatcggcgacgacgacgacaacaacaacagcgacaacggcatcggcaccatcagcagagcagcagcaacaataaaacgaaacaaaaagtgccaacaaaacaatgattgattgattgaccagcagaatgggtgtgattaatactaggagtgatcagaatgggtgtgatcaaccaaaaaatatatgaatatatatgttgccgacgtccatacattttactcacccaattcgttttatccgtcaatgttttgtattgtttgtagagctgaaaattctcgaggccaagattccgaaaatctcgacacctcatttttactcgaggcccgagagaggctcttgaacagctctaattggaagagaccgactagtgtgttttttgttgttggaaatatagcatcgattgaacccaaaaaaactgacgaattcggtctcttatatttcttcccgttccacataaatcatttttaatgcttgcttatattagaaaggaaaagattaaaatttaatactataattatataatttgttatataatatagtaattgatatgtgtttgtttactgtagtgtgcattttttttttttgcatttgtaatagcgaccctcacattaccaaattgctttttaaatttaaaaataaaaaacatataaattattctgtctgttttatttggtccgttctgagcagaaaaaacacaattaaggtaattatagccacatttttaacgactgattgacaata

SEQ ID NO: 31146 - DNA, 1315 bp, Heterodera glycines
attgtggaaaagtgggggtccacgtggcaaacatgttcctacctagttgttatattcctaataagaatcaaccgttccccataaaaaatcaaaaaatgggaggagaaaggcagcagcagcattaagatggagaacatgagcacaatgatcgaatggtaggcacaaatgctgctaatacatgttatttgtttgataaaatttccagcagtggtgtggtcaacggcgaaattgatgacatgaatgatcagcaggacgatgatgatgctccaacgtcaactgtttatctgaatttgggcaaagacgagcgcaccgcggaaaattattaaaggcctaaatagactgttagacaaatttaacacaccaaatgtttgaaacatttattcttcatcatgattatgttagagaaaaatagtaatagttagaataaacatattaatcggtcttttgctcttctgaaacaacatggagtaattcaattggaaaattgtcctggtgactgttgccaccaaattgtacaacacatggtaattggggatatttcagcataatgcgatgacgcacatataaatgttgttgaacagttattcccatgaatccacggtaggcaaacatcatgttggctccatgtcgggacagcgcatctgcggaaacagctacattccttttcaggtgatgggtggctaatgacagtttgttcaagaatttcacattttcttccttccttttctgaagcattttgtgaagccaagttggcgaacatcggttgaatcggcagagcactctcaccaagtcgcgtcgttctctttgtcgtcgtcgctgttgcttgcgctgtgcagatccaactcgtccactgctagctggtaataactgctgctgctgctcgctcgtccgcaacgtgagagacattccggcgagtcgcccggacaaatcatcagatccttcagttccacatacagaggttcgctcctgaatgtaaattttatttatgttttttttttggtatatgttttaatttaccacactacgccctctgtcttcctcttgggaaagcatgttgtgtaaagctcgagtccctcgacaagatcaagtgacccttccacgtacactggttggtttctgtgctcagtgtttgcaatatgcacacagtcgactgcacgcaacggattcggaaacaatgactggccgtctcctgttggactattttttatctcctccttaaggtaagcgtagagctcgtcaatgttgctcagtccgtaactgtcagtcaaatagcggattgcacgctgcatacaaagcgcacagcgagcagataaat

SEQ ID NO: 31147 - DNA, 1574 bp, Heterodera glycines
  misc_feature (1537)..(1537): n is a, c, g, or t
  misc_feature (1540)..(1541): n is a, c, g, or t
  misc_feature (1561)..(1561): n is a, c, g, or t
ttaccatcaaaaaacccaccccccgttccactgttgactccgccgccgccatagtcgagcaaatcggacggaaaagtcgggaaattcggcgggaaaaccgaggcggcattttgctgctgcgtttgttgttggcgcgcaagcaaataattgtaattcaaccacaaagtgttatactgacaatgggaatattttttaggcaattattattatttatttttcttcggtaattaatattatttttaaattgcaaagagatcaatcgtcgtggattatttgccctccccctttcctctccattttttggcaactgattgttttctaagtttcacttttttgaactcattaaattttcaccgattgttgtttggagagggaaatgttaaaacaataatttttcattgtacttaaaagcccacttggtttctcagaagttcgttgtcctccaattggctcctcagtttttgctgaatttctttgcgcttcgctctttccatgtgatagaggcggttcaaattcctgcagagaaaaaaggcaaagaaatttaaaaaattataaaaatttataagaattatataaataatttaaacatgaaatcctcttcgtcattttgagcaatttttataaaatctcaccaaatttcccagtccgcgccgctgtcttcgtccggcgaaaagtttttgcgcgtttgacgctccgtcagttgaggtggcacatttttgtagcgggaagaggcggaggaaacgacggacaaatggtgccgattcgcgtcaaaaggataaaaatcggcgacggataaacggcgggaagacactgcgggggaaagggaagaaatatttcttgaaatttttaaaaattttttgaaaatggaacatcccaatctgtgagtgtccaaatcactttaaaccccgattgtttattctaaattctcggcctttttggctccggtgcaaaaagtggtcgattaattgatatataagcatatattatgtaatttatgcaattttccatcttttattttaatgatcatttgccataggttcgggtccgctcgaagtgttgtatccccgggtttaaggcttcaagccatttcaaattaccattttaagagagagcaatttatttaaggaaaaagcattgacaaataattatatgttaaaaccgggaatattttgggtcaacaacaacctaagagcattttgggtgggttagtgcaattggttatttgggaaaggattgccaaaggcaaggaacggcacagactgacccaccgcaatctcgcagccctcgagggggaaattgagtggacttatatactggcacaattggtatggactttggataggatgaggggtatgacggcataaacacaaaggaataagagagaaagggatggcatatgcaacagaggtgatgggatagaaatggcacgataacattggaaatgagaggggcaggattggcttgggatgtgatgaacagagggacaagtttatgacgggattgagtcggggaaagtagggaaatttacattatgcancannatatgaattttgaatgctgncgatacagcataa

SEQ ID NO: 31148 - DNA, 1265 bp, Heterodera glycines
ccatttccaggcaattattgttgctaggagcggccttccaacgacggcaataaaagtgggtaatttatcggcgacggtacaacggaagaagaggaaaagaggacggatgtgcccctccctctcttcacccccttttgctgttttccgtcatcaaaacatttttcaccgtcgccgaccgttggcgaaaccatcatcagttttatttttgttgtccattttgcgactatttaacaccgtcgaggccaattctcgaaacgccgcgcatactcacatttcggaaagcgaagaatatcaggcgagtgacaaaaaattaattattcgatcgaatttgaaaattgttttctctcggaaaaaacattaacttaaaattcagtttacaaatgtcaatccgaagtgcgagcgcatccgaattgaaatgtgcaacgacattcaggtagaaagaaaagggagagtgaaatcggaattttttaaatggaaaggataaaagcaaacccaaaaagtagggaaatgtgcggaattgggacattgggtacgcacattttgtcagttaaactgtttgttttagtacaacatgaccatctatcccaacttgctgaagcatgccaaacaggaggaggccgagatggacatcaaacagttcgcttttgccttcgtttgcccttttcatttgccctgcctttttcagatacgaaatgctggtgaaggtgcagtgcagtgccgacttcaagttcttcctgtgcactttgttcacgcccgtctgcaccattctcaacgaacccattccgccgtgtcgccacctttgcctttccgcgaagaacggctgcgaaacactgatgcgcaaatttggctaccaatggccagagatattcgactgtgacaaaatgccggagagtcgggacggaatgtgtgtgggggagagcaaaacggaggaaacggacggcggagcatcggcggacggaaagggcgcggaagagccgacggaaaggggcggaaaatgggccatggaatgtccgcacacaatgaaagtgctcagcaaacgaaggtaagcctaaattgggggctgaagtgggttttgtaatgcaaattcacttaggaaatttttattcgatattttttatatgggattttattgtttttttctctcttaattaaataaatccgagtcgatgttacagaaatttgatgccgaaaatttttcgaattcgttctctaattttccctcttggtaggcttgcgaatcatgctaaatgtcgacctgccaggcc

SEQ ID NO: 31149 - DNA, 1211 bp, Heterodera glycines
  misc_feature (46)..(46): n is a, c, g, or t
cgggaatgggttcttgtacaggtaagacctgtgaaaaactattaancaatgaaacggtgaatgagttagccgagtcgaacggctacccgggcaattcctactgtttggacagcgggtcattttggtttaacggttgtggtggcacaaattctgcctgtctatttaccgcaattacgccgtaccaacccgacccggaaataaattcacatatgagatgtttcgttgtcctacgtgggatttccggatcatgaccgggataaaaatcaatttgcatggtgagacaatccgaaatgaagaggccatccttttctccggtcacacctttcgcctccaatcagcgaatttgtcgatcaccccggccgtctttgggagtccagcagcacccgcattgtccggaaaattcattggcggttcgaatggaggtgcattgatcccttctctcgatccagcactgcattgtgctgacgaggattggacatcgaacgattactcggggaaccctccactaaactccccctctcgatcggcccattagtcttaaactaccgtaacccacgtgaagtttgggtcgactcggactttgtaccaattcagatggtcttgagaatggaaggattacgcctagcaatacgccaccaaatggcaacatgtaagataagaccacagggtttaaaaggttgctataaatgccgaatcggcagccgtttttcctatacctgtacggccagctatggttcacctttggctgaaattgtatgtgaaaatggagcaaattgggcaattccgtgctccgctcagccaacgcagcacaatacctctttgtctttcgacacagccaaaattaagacaaattgtaaggtgacgtgccctgggggtgacactttattcgaaatggaaggcactctggcctatattttttcgatcagccgatcctggcgtttgactggagacaaagccgaaaatcaaccaggagggtttagcctacctgaaatcggtgaccttttccacgtcttgaaatggatcttcagcggcacccagctgatcatcattttgggagtgtttttcgtgggaatttgtgctctttacattttcctcaaatttaacccaattttttggggttatcgaattttggctaggaaaatttggattaccatttttctgctcagtaatctgtcatgggctaatgccgaaaataaaatgaacatgtcaac

SEQ ID NO: 31150 - DNA, 1323 bp, Heterodera glycines
ctattatttttttttatctggcttatataaaatttttctaacagagccacaaaaaatagtctagcaataggtagataaattaacagcaaataaaaactgatgaagaaatatgcgtttccaggacttctcgcaaattttgccatttcttttagttagaagaagcagtaatttgccggaaattttggcttttagggtttatagaacttgtaactaggaactagcccagcacctcttggttttttttaatttttcaactttcccggacaaattttttcagcgaatttttgtccccgataagtgtgatatttttgcggagcaggacaaaactccgccgccgaaactccgccggccgaaactccgccgaaacataactccgccggggaaaaaattttctaacttagaaatttttcatgaaaaaaatcttagaaaaattttttcttagaaaatacgaatataaaaatattttctaagaattttccagcgatttttttttcaaaattttttgagtttttcatcattaagtcttgaaaaaatcgctggaaattttttagaaattttttttcttccaaatttctaagaaaaaatttctctttgaaaaattaaaaaaaaaattgttttggcagagtttcggccggcggagttatgtctcggcggagtttcggcggcggagttttgtcctgctccgtggcatttgccgtagcaaaaaatgaaaagctcgtcccccccagaaaatttttttaaatttcttaacctaaaatttttaaaccagcaaattttgggaaaaattttggcaaaaatttagtaactcatcataaaataatgaaaaaattgctgaaaagttttcctttttttcttgaatttcttattaaaaaattcagtaattcagttttttttttgaaaattttctagtttatagaaattttttgcgggggaaacggcgggtgggcagaatatttttttgggtatttttttttgttgccaaatttagtaattctcttaaattttgaaaaatgctaatttttcttgaaatttcttctaagatttcgttcttttatttttataaaaattattgggagtactaaaaattttgttttttgccattttatatgtttttttgcaggtggaacggtcgttgaagaagatggagaatcggctgaccaacaccggactgttccaattcagcgccgactgtcgccggggctcccttctgttgccctctttgctgtccaactttgggcccacttatgtgtgcaaaatcacgagaataggctgaaaacatcatttgttagcatcaccatttttatttttgtcacttttattaaa

SEQ ID NO: 31151 - DNA, 688 bp, Heterodera glycines
atacatgagatttttctggctttttgagagaaaagtcacttcccggcccagttttttttaaaaccccgagctctaaggcaatctataaaaaatgattttaaattacaaggagaggagcaccttaccaagttgttgtgttcgactgttttgtcgggatgaattgagattttttgtgtgtgttttaggatgaagggatacataggcttggggaggggaggagggcggggggagagagagttggggtgggggtgaagggtgaatgagagatggaaagacaaaacgggaaaaggggaactcttccaactcttccccttcctccccccgctcttctatcatcatcagcagcagaaggaggagtaaaggaggagaagggggacttccccttccacattctcaatcaattgcatttagtggtggggggtttgagaaataaggggaattggaagggatggaaaaaagcgacaaaagagcaaagcaaaatgccctctttcactgctggtcgagtgaacgcgaaaactgtggatataatatgtaggacatttggccacaaaagtacaggctgatcactggcggctctgggctaatgagtgtgtgatcaaaaggcgggtcaaagtggagacaatttacggaaagtaatacataggaggaatgcgagagaagtcaatgatgagaaactgaatggagaaag

SEQ ID NO: 31152 - DNA, 999 bp, Heterodera glycines
  misc_feature (995)..(995): n is a, c, g, or t
aaaaaatttttttttttgttttgggggcagtccccccgaaccgatgcccccaattttatggggagaccgaatcctttggggaatagcttccctatagtctgtactttaattctgcgttggatttttgctccccataaatgtttgagtaccccaaacggacactaaaaaaaatcgttttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaaggcatgcgcacccgtccgatccgccaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaaggcccaccacgaggccgcgaagaggccgagtgagtaccttcggtgcaggaaaattattaaattttaaaattttttaattgctttttaaatatgccaaaaaatgtaggcttaacttatgtagtgaaaattcgatcactcatattttttgctaactgagcagaagcgtaccaaactttgcagggatactccccgngtaa

SEQ ID NO: 31153 - DNA, 970 bp, Heterodera glycines
tggtttggcaaatgatttcacaatttgaccacatgatgcgaaagacgggcaaatggcattgaatgaacaatggcatatgcttccgttgcaccacggaagttcatcttggcatattgagccggctcatcaattccaattttattgccggactcttctttgcactcgacataacaatgtcctggccctttgaaagggtacttgagtgcgtatttaatatttgctttgttaccatatgcaaacagtacattatggtgtactcggtaacgcagcagaatataaggattatacggcacgacatgtgagttgtcgtatattaagccgtttacctctaattgggcaccaccatcagatggtgaaggccggaaatacatcgcgggcctgtccgggcgcaaaatcgtacattttgagtaaggggctgggaaccccttcttgcaccgcccgtaaattgggtcgctaggaccacaccaactgtcactgcatctgtgcagttgcatatgcattgtttcgcggatttcgcgatgcatttttgcaatgggcgtgtcgtcatctttatcaggcaaagatggaatgtgcgcccatatgtattcctgaatgacatatggaactgcgtccaggtctgtttgcgccacaatgtgggcatgtgggcctcctcggccttggaactccattgattcaccgtaaccaaggattgttccgaagaactttttgtcataaagttcttctcggaactcagcgattttgctgctccagacacgcatccacatgtcaaaacggtcagtaaatacttgaccgtttttgtgtaaattctctttgaactcaggccattccctgttgttcgtgaaagtaatgaagagacgcgcctttttcgcgtcatggcaccgtgcaaaaacggtgttgcaatcttcatacattttcttccatatattggagagaatttacgttgtgttcggaaagccgaacaacactgcca

SEQ ID NO: 31154 - DNA, 1238 bp, Heterodera glycines
gaacacaatcgtttcaaaaaaatttaatataaattcttattttgtcccgaatcccgcccaaaatcatcgggttgggattcgggacgagaaaaatattgggtttcgagtgacccgaaacaattctggtacgcataaacaaattttttgaaatatttttttaaatacgccacctgccctcggaaatgttcaaattcacagcgggcaatgttggatcgtcctccgatgacatgaacacaaatttattgcaccgttttgcccaagtcgccttcacgtgaatggcccgcttttggtggttctgtttgccggtcaaaatccaacagaaaatgcgaacgcgtcgagcaatttcgttggccaaagtgacaacactcattcctggggaaagcaaaaaataataattaaaatggaaattcaattgaaagttgtggataaaaaactcatgagaagaaagcccaaaataaggtaaccccacaaccaaaatgtcaaaatatttttaaattttcatcatccggagatttcggcccaaacctattattaaaaaatttgtagtcgaattgagttttcaataatttcatagacaaaaaagagtcaagtttgttttcaataacatataaatttttcgtaataatctaaaacaatttttttaaatttttgcaaggatttttttgaaaaatttttgatttttttagcaattttttggaaaaactgaaatgttaattcatcataatattttgaaaaagcgcaatgatttgtcaaaatggaggatttatcaaaataaacaaaatataaaggcctgtctatttgcccacctttctgctgcactgtgtggaaaaatacgggtgccgtagcaaattgttcaaccgagccctgcaacattgaaaaaaaaaattcaaatagattcgctagaaaataggcaaatcttcttaaaaaattctgtcttttctggaaaatttaaaatttttcaaaataagtcaggtataatcctaaaaattcgtaaaatacttattcatttttacgtgctatatttatatgaacagtcgaacttctcgctgttttcattcctacataaatataatacaaaaaacgaatcgagacaaaaataaaaaagactcgtaaggattttgcgggatctagtatgttacgggcgggattcatctcgcgagatcccattcccaaaaattttgagtaatcttgatgtaattagaaagcttttcaaatactctattactttacaaaaaaac

SEQ ID NO: 31155 - DNA, 1573 bp, Heterodera glycines
ttcataaaaatttatatgcattttttgtttattctaaaaaataattaaaaatctatgcttatattcgtatttattaaaaaaatcgtatatttcgcgatgaaagtgaattattttatttgctacgtgagaaaagtgaattattttatttgcctatgaaccaaaaataaaattaaatattttctatagtaataatttaattatattaaaatatgaaaacttaaattcatattttatatgattcttaaaaaatatttaatttaataaaaataattcaacatcgctttttgtatataatttccgtttaacagttaaagaagactattaattattacctattgaggtttatacaagcgaatatacttatcaactctcataaaaaaaattaaattagaaaaaattaaatggaaaatccgtttttaaatcagccaaatttattcaattgaaataaaaaaaacaaatttattaccttagttctttaataaaaggttgctacgtcagatagttgatattattattaacatttaatattaaataaaaattttaaaaagattaaacaaatgaattggaaataaaaaaataatatttctagatttattttttaaataatattttattagaaaagttttaaatagagtgccacgggaccgggacctggtagaggacaattgagtacagctgagtaccaaggtcccggttttgaccgggatctggactagtcccggttttttcccggttttcccagccaaaaattcccggtttttcaacccgaaaaggtcccggtcccgggcttgcccaaaattcacggtcccgtggcactctacttttaaaacattgatttaaattaaataatatttgaaaaaagatgaaagaatggatttaaaaaggtgatgcgacatttgcgccgcgccatttgcgccttacagcaaaaatggacatttgcgccgctcagcaaagtcgacacttgcgccggtcatatgcccgcagacagttgcgccgcggatatttgcgccgctccatttgcgccgtgacatttgcaccgcctagcaaaaatggacatttgcgcggcgcagtcaaaaataatattttcattctaatatcaataagatttacactaaaaaccaacaataaaaataacaaattaaaaatttcttctacgcagttgaaaacggcgttagttgctgccccctgccccaaattttgatcgtcaatgccgagcagtccgccctattcacttacagcaaacaaccccccccccgacgaatatcctatgaaaccacaagattttctccttgaaaagaatcgaaaatttcagaagtacaccattaagacttgaaatttttttcaaaaattgatcaccaaattttgatctttttgattgaaaaaaaattttccttattcgaaaaagctataaatattttaataaacatttaaatacccaaatttgaattttttacttacgttttaagtctcttcataaaatttaaatgcctttttttttgcgatttttttttggtgctttttttcgagaccataaatacttatgataaataatttatgtaattaaatttaaaat

SEQ ID NO: 31156 - DNA, 1266 bp, Heterodera glycines
tcgttgtatatcagatcgcctggtatgccatcttacaagtccactatctctccgagaagatgcatctactgttctcggtctgggaggcggttctgcatgaggcggaggacttgatggaggataatgagcgggagttggaggaatgggtggggatacgagaacgtctcccaggcggcggtggtggtggaggaggagcgggaggactaggtccacgtcgaggacgtctcccaggcggaggaggaggtggtggcggggcgggaggtcggggtggtgtgtctacacctctcaatcttcatcttcgccgcctttccttagcagtacacttattcctttcgtcagctcaactttggctggcctatcttcaagttccctcctcattttcaagtatcgcctaagctgttgattgtaatggacattttttgtactgggatgtgttcgctcgaccctggcacggtctaaatcatgtcgaacagcatccagatttaggtctcccgtgttggacatggaggtgagaccacgataaatttcttgcgggacaagtaaaaatttatttgccatctctgttaaatgaataaaattcaacaatgatgagaggtatttatgcgtttttgttcacaaaggattttgccacttccattagaacgggtgtcaatagggcagcgaacaatccgccaaatcctgcgcctttctggacaagcactcgcttggcaccccgttcacttctcgctctgctgattcggcgtacagtatccacataaggcattagtcgcttcttctgtctggttgtcaaatggaagcgcgaagcgacgagattcaaacaaatttcaaccagcgatagtagttgttcagtgtttgcttttcgtataagtttcctgcatttttttccggatttcgtcttggccaaagcacacaaccagtcgcgattctgttttatcagctctccaatctttacttgttgctgcttatgccgctccatttttgggaatgaatacaactgttccttcgtcttcaccctcctgctcatccttaaatatgttggttcgcagccgtaacgacggatctgatgcagcgtgcatatcaatcagcaaatagccataggggacgggcggtcgctttgcgataagcatcaaggaaaaagtcgatctgacgcggaaagagttggacgccaatgttgcgaatggacaacagggaattaagggcccgcatcaacacccagtactgagcggacaggcgggccactttggattttacgttcaaacaaatttt

SEQ ID NO: 31157 - DNA, 1112 bp, Heterodera glycines
  misc_feature (1105)..(1105): n is a, c, g, or t
aaaaatatatttttttgttttcggggcagtccccccgaaccgatgcgcccagatttatggggagaccgtatctttcgggaatagcttccctatagtctgtactttaattgtgcgttggatttttgctccccataaatgtttgagtaccacaaacgcacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctcccccataattgtttgagtaccccaaacggacacttgaaaaaatcgatttttttgtttcataaatatttttttcagaaagtcgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccaaaggaatggatttaattaaattctctccttcggggatttttttccattaggtcgtccgttagcgttcaattgctctagtcaatttttaaaaatttttgttgaaatatttgtcgtgctctgaagggcgggnggggggg

SEQ ID NO: 31158 - DNA, 1188 bp, Heterodera glycines
tagccaacagcaatagaaattatataaaatctactcctccccgttatcatataaatttaatgcattacagaatttactaaaatgtttgggaccaaagattgacgaacggaggatagatcggaagggacaaaggggtaggtaacattttttttttgttgaaaaaactgtaataactatcatttttaaaagcaataagagaccaatggaaggcataaaataaaataatttactttatttaatgtgtaacgggtttaattcaattattttggtttatttgttaacagtgttgaaaattattatcaacatcgcaattcccaaccgataatccactggcaaattgacaaacagcccatcagaagggcaacatgtcgacaatgctgaacagaaagtcgggcccgaaatttgcctggacggagtcattcatgtccacgagagtacaacacgcatacatgtgaaacgattcggcttgcaaaaattggcttgcttaagaatgaaacaattcgaatttgttttgtcttttgaatccattcatttacttacaaattttgtggccattcaatgtgaaaaaaatgccccggttgtttgcgtccattccgcatccgacaacatcaccgggaccaaactgtgcgaatccgtcaagcacatccggcacatatggcaatttgctgtggatagacccgtcgctccacaacgcaatgcttgcctcaaaatgcccgaccaattcatgcatcctcatgtgctctggggcaagtccaactccaacatcccttaatataatcaaacttatttgaaaacattttaaattcacgattgcatctgcataatggtaatttcaaagtaaaacaatccaaaggcactgttggccggcataaccgagcgcaccgacacaaaatcttaaaaaaaattaaatatttatttattttattaatattattacagttatttttcgacaaatgctcgaccaacaaaaaatcataaacgtaaattccctcgttgcaatgattaatgtcccagctgtttaattgctgggccgcgagaatggactgaaggcaaattttgatggtttcaacagttcgggccagattattctgaaaaaagtgaacagggtgaataagtaacaatataagaaaaaatgtcattttttattcaattaaatttattgtctcaaaatcatggccaaattttctt

SEQ ID NO: 31159 - DNA, 1190 bp, Heterodera glycines
ccgtggcattggcctcgccattgctcacaattaatccctttgaggcaattaaaatggacaattacctaagtcacaaagcaattgcaaaattcacaggtcaacaccacccaaccgccttcggacagttattttgcggggaattcggaatggaaccttataaatgtgagagagtcttttgctaatttaagtacaaaatcaaaaattcggttcaggtttctgttcggaacatgcattacctcgaagaaggcgaataccgtgccgaagtgagaatgatttggaaaatttattggcactctctctgaaaattgccgcccaatgctctgatcactacttaaccctttcctctctgatcaggtccatttcgtattcaatttgcgccgtcgtcccattttttacatcactgtgatcgtcgtgcccatctttctgatctccgctctttctattctcggtattttcacgcccggctcaaacgaagggccgcgcagtgagaaggtactcattttcatttaattgcttttattccatttctcctctttccctccccttcgatcactaccattttcccttatcctctgatcactcccctttcccatccccagctccctccaaacacggcattttcttctcaggtgtcccttggccttggttctcttcttgccatgaccgttctgctgggcattgtcgccggtgcgatgccaaagagcaattccattccgcttcttggctattacattctgtccgttattcttctttgtgccattgccgtcgccgtttcgatggcaataattcgaaaatttaattgaaaatgccaaatcttcattcattttaaaggcatttatgacatcatcaaaacgttatgttgacaatgcccgaataccaagcaaattcacttacaggtgaaaaagcgaagccacggcaaaaagcaaaagcaaattgggaggggagaattggatttatcattccctaaagaaaacctttgtacttcttggtaatggtaaatataccgtaaaaggatgtcactcgtacggccccaaatgtacacagtacgaagagcagaaaaaatggaaagaatggcacaacaaaaggggcaaatacagcggaccaagtcgatatcacatcaaattctgggggtccgcttctcagaggcttacaaaggcaagtggggaaaatggaaaagggaagggcatttt

SEQ ID NO: 31160 - DNA, 1045 bp, Heterodera glycines
aaaaaggaaaaaccctttttttgggaaattttttttttttggggaaaccatttttcaaccccccttttttggggccccacccccaaaagttaagcgtttttggggaaacccccccatgtccacgggggtgaaaaaaaggaaaaaccctttttttggaaaatttttttttttggggaaaccaattttcaacccgcccttttgtagggccccaccgcagatagtaatgcgtttttggggaaaccccacatgtccaacggtgtagaaaaaaagagatagccatttttctgagaatatttattcttctgagacagcaattttcaaaccgaccttttgtagggctcaaccgcagatagtaatgcgtttttggggaaaacccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccatttttctgagaatatctattcttctgagacagcaattttcaacccgaccttttgtagggctcaaccgcagatagtaatgcgtttttggggaaaacccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccatttttctgagaatatctattcttctgagacagcaattttcaaacctaccttttgtagggctcaaccgcagatagtaatgcgtttttggggaaaccccacatgtacaacggtgtagaaaaaaagagatagccatttttctgagaatatctattcttctgagaaagcaattttcaacccgacattttgtagggctcaaccgcagatagtaatgcgtttttggggaaaccccacatgtacaac

SEQ ID NO: 31161 - DNA, 1853 bp, Heterodera glycines
caaaattgtacgaaatgcatatcttagatttttccaaatttcgagagtgttgaaaagcagggaaataaaaactctaacagcagcctataaaacttttgtacgacctcaattagaatatgctactgaagtttggaaccctaatcttaaaaaagacatagataaaattgaacgtgttcaaaaaatttttacaagaaaagcacttagaaaatgtggttttgtgtacaaaaaatatggggaaagactaaaaatcacgggtttacacaaattggaagaaagaagaaaaatcaatgatttaacaacagcttttaaaataatcaaagggttcaccagcctcgatgctggaaaaagtttctttttctcagaaaggctcaggaggcctttacttttacgggtaaagcgccacacggccaaaactcaaaataattttttcaatagaatagtaaaaaactggaataatcttccagtggtagcggtgcaaattaataaggcaaaggaattcaggggtttactaaaagcaatgagttctgagtaggattttccatgttgccatatttacactatatttttatcacctgtgaatttttaacatttgattgatttatttttattcattttttattacggtattcattttgtattttttatttgaccaactttatttgttgttttctttttggcaccatataagagcactcatgtgcctttggtttgctcgataaattaaattaaattaaacaattgccttatttggccttatgtcttcgtcatgtctaaatttgtgtaactataaagttaaattcatttttccattttctcgatcccttcattaattttaaattatgtatgttttcgtttccccacacggaaaaataaaaaaaacattctcacacctataaatttgtaaaaaaaaaccttaggaaattttttatcagaaaattcaagaaaaaaaatttttagaaaattttttcagcgattttttcaaagttttatgatgaattaataatttttcttaaaaaattttctaaaattcgctgaagaaattttttaaaatttttccttgaaaattttatcaaaaatttctcaagattttttttcttgaaaattttctagatttgagaattttttaatttttttccgggcagaaacgatgcgggggaactgattggagaaacggtggggggaggaacgtagagcaccgtggcgctcacttggccagtgcatatgaaaaatttgtgaggtgagacacctcataagacgcgaaattctacgaatttcaaaaagcatcattttccctaagaaattttaaaaatatcaaaacttttaaattcgaaataaatcttagacgtttttcgagaatttggatgaacattcgctgaaaattttggatcggccccttcgtcaggtcaccgagtttataaagcaaagagagtcagatgaaggaagaccaatgcgccagatttggataaatacttacaaaaataggcgttcagcggcagacattattgtcattactagagatcggtattttgaaaaaagcctggacctggacctggattccatgttggacctggatttcctgggcaaaaatccaggtccaggaaaaatccaggctcctcgagacctggatccaggcctggacctggattttttgaaatttgttttaaaaagcaaacaaatgcttgaaaaaatcaattatttgctagaagcatctaaaaatatctaattaataataataatgtgtttttaaatttatttaatctgtttttgaaaacttgaaaaaacatcggtcacttgaaaaaataaattctaaaatttcgtccaggaaaatccaggttttttcctgttttgcctgg

SEQ ID NO: 31162 - DNA, 1384 bp, Heterodera glycines
  misc_feature (1296)..(1296): n is a, c, g, or t
  misc_feature (1351)..(1351): n is a, c, g, or t
tttatatttcagaaagaaagacataatgttgattaattccgtttttatgattcctttttttattagtatttttcaacaatttttaattacattttcaattgcaaattcatcggtgagttaattataattttactaatttatttcattaattaggttgaggacaatatgctaattgcatttttgaaaggacagaaagaaattcaattcagtgagtattcaagacaaaaatatgaagcacaccttggaaaattgtggagaaaaatttgaagaatatttaaaggaaatgttcaaaaaatcggaagaaaaggcaaaaaaagataaacaatggaaagccaatgaaataaataatggcaaacatttaataattaagcattcgaaatttgatgatcaagggacatgggtgaggagacttaacaatcaatgaaagttatataaatccaaattttagactgcagatgctctattttcggaatttgtcaaaggtttagcgacaaaatcagagaaattttttaaaatggcggaagaatattcaaattatttaagtcgaagtaaagagaaagttttatttgatgaacaagcaccaataattgttgggttatgcgaatttgtggaaatgaaaaagcatttggccagaaaatatgaggcccatcttggccttgtgtatttgatgcgagcgaattggcaatgttcctattttttcaattttattcattgctggggacaatgccaaaaatttcgcaaatatttggacattttgtacgaatatttatttcgactttatgttgaaggttttatttttaaattaatgatttttaaatattataatgcatatttaaggcaaaagcaatgaattgacctataaattaccagcagtgaagccaatatttatgaatcattataagaactcaatgcaattaatttcagtcgtcagggctctaaatgaaattgcgatattattttggtcaaacgacaaaaacaaatttgaggataatgattattggaagatggttttggtaaatgatgtcgaattgaattatgagattaaagaggagaaaaatttgtttaatgaatttaaacaaaatattttgaaaaagtttaacgcaccaaaaaatatgcaaaaaaatggaaagaaaattttaaatttatcaaatgaaattgaaaacaatcttcggcaagaatttgatcaaaaaatggaaaaaatatatgaaaatacgaaagaaaatgccaaagaagaaaaggcaaaattggaaaaagcaattgaaaatgcgacaaatagtgaagaaaagaaagttctgngagttgaatacattgacaaatttggcactttcaattcatcgccatttatttacgnaatttgacaaatttggcactttcatttcgtcgc

SEQ ID NO: 31163 - DNA, 1309 bp, Heterodera glycines
  misc_feature (1267)..(1267): n is a, c, g, or t
atttgacctgtttgttcagcaatgtcctgaacatcaccctacacggcaacgattggttgtccaccctcataatgcccagctgttcatccaccgcttttccctcatttgacacgggcccaggaaggctaacgaaaagcgaagccaaatcagtggacggcttcatctcgagtagaaaggaaccagaacgccatgactcatttccattcgacaaacaattctccataaatcgttttaaaaatattttgctaaatttattcgtggacagaaagaaatttaagtaagagtgccgaataagtaacaaaataaaagtctggatggagtaaaatttaaaatttatatcaaaaatgataaaatttgaaacaaaacaaaacaaataaattaaatttaacaaaaaaacaacaataaaataaactaacaaggacttcaattgttgagcaaattaaaaacagatcaaagaaaaccaaatatcaattcctttgattttttgggtataatgcaccaggaatttgaccacgaacaatgtgccactggagaggatagtgagggtcaatgccattccaataatcctcgacaggcgcatgtgaaaggattggcttcattttgataaaatgtttgatccattccaagtcgtatacagggccaacagagggggcatttctggagaaaatcaaattaaatttgccaacaaaatgcgaattcaaatgctcacctttcaccgctttcctcctcgtcctcctgaatacaaagacccatctcttcgccctcattatcggaatattccatcttttttgcttttccggtattcctttcccgcactaatcgaagcgtctcgtcgtcataaatcagcaaatactcgccttcattttgttctttgagcccatcgaggagtgaagataaacgctgaattctcgtagaaagtcttaaattgaatttagaagttaaagttatggtcgttaaattatttgctaaactatacaatttgcggttctcttggtcaagttttgaccagtcagaagccgcctttctgtcaatttgcatcagatgaagttgacgcatccgttcatcaaagtgcacgcggaaagttaagtgctcttcggagcctttcaatgtcgcagtgaccaaatccatgagaatttcttcagttgacattttctaaaaatttccatgtatttaaaatgtacaaaaatgaattttatatatgggtctttccgttcatttaagaataaaaaataagttacctccgcggcgatttcaggcaaaaattcangccgaacgctcagtgaaacagcgcgcgaattttcaatcccat

SEQ ID NO: 31164 - DNA, 1921 bp, Heterodera glycines
taatttatatcgattagatcattttggaattcacatgctctccttgatttgttaattttccttatatttctgtttttggctttatttaatctatttaatcttcactatggtcatttagttcccttttattgcgttttttaataataatttttagataacgaaataccattgcaaatatttttttcacactaaattgattaataaagattctcattttctaaatttttcgtttcttttttggaatattttaattaatctattcgattttccatatttatattgggaaaaaaatttttcattttaaaattttatatgtcattttttaataagatatttttaagataattgcatgcaaaatttcttttcatgattatttaattttttattttatttttattatttttttaaaattattttcaaaatatcttgtattttatttaaatatctacttcaaaatagagagttttttgaaaaagattgaattttcagaatttctttattacatgaccgaaagatttaaatttaaaactttatcaaaaaagaaatgatgaaatcaaaattgaagtacccatatctcagcgggtataagtcctagagacttgcggtcttttgcatactgtagaccattttgtcctttttctgatgaacctaacggttttttccagaaaattttcccaccccctaggattttttttgaaaatttccccgatttccaatgtattttggggtgtctagatcaccatgaaggagtgatcggatcaacttgttgttaaatacttttttgatcagcatcaaaacttatgttagcatgaattatttcagatttttctgtgctctcaaatttgagattcaaaaactggtgttaaacatatgcaccactgaaaatggggtatggtacacaaagtcaactgtaattcgggtttgaaccgatattttgcttaatgattggtatcatttgaaagccattaaaaattatacaaaaaatgtcaaaacatttggtcatcaccaatatttaactttttatgaagccaaatttctcgaaaaggctagtggtgttagacttatgctcctaactgtatgcactgtgaaagtgatacaataaatttttaatttttaactttgttcacaaaatttattcacactcatacataatataatatgcaatgaagttttgtatggaaatgtcaccgtttttgactgcctcaacttgacctcaaatttgcactgatttttccacgtttcgatacgcgctggtgtacaaacatttctatgacataacttaattgacaatttggagagcaatttgcaattcgcaaaggcaatggaatgccgaaatcatttttcgagggcaaatcttatggattcatacttggaaaaaaaaattttccttgtgcacaggttttcttaaaatttttgcataggctagactatttttgaatcttttctactaaattttattttttagaaatttgttttctaacattgtctcctgcatttttacaagggcatttttttaattagaggtcgtttttggctggcatttcactctagtaattgttttctttgtcatcatcgcgtgttttttgtttatttttaaagttctgtgctttatcaaaatgcaaacatatggatgggcggagcgagtgagtaattgaaggctaattaatattgctgttcgagattctcggggtcaagtctcgttctcggaaatttttctgtagcgttactaattaaccgtaggtttgggtaaaactgcagaattgcagctcgcgccaattaaaaaaaatgcgaataaggcaatacgagatgcactactctgaattatgcattttattttaattctgcgcataaataaatttttggcattatgattcatccattacattagcataaaatagcggtaggggtcaactgcgtctga

SEQ ID NO: 31165 - DNA, 1629 bp, Heterodera glycines
  misc_feature (45)..(45): n is a, c, g, or t
  misc_feature (1465)..(1465): n is a, c, g, or t
  misc_feature (1498)..(1498): n is a, c, g, or t
  misc_feature (1614)..(1614): n is a, c, g, or t
aaaaaaccttttttttagctttatctcgatttgcttaattcagcnaattttgttctaagaaactatttcatcttacatctgatcaatatgattccacaattttggttcgtatttcaaatttataatataatgaactattcaaattaaaattgcaacgatagcccgtttttttaggcaaaatgtgccgctatgaccatggcccgttgtcaaccgctgaacgcgttagcaatgttgggcggggcccgactgtgccaccacacgccaccaaactgcacggacgccattcgtccgcttggtccgaaaagcaatgtgccgagttttaaggttttcttccctaaactgataaaaaaaataatatttgaatcacatttaagggccaggcaattgtgaacgcggaaatgaagaccatttcgtacgacgactacaagggcaaatggttgatcttcttcttctacccactcgactttacggtactttgcgaaatattttctcgggaatttcttgtcgtaatttatctgaacttgacaaaatttcagaaatttgactgatttatagagaaaactcaggaaatttgagagatagagaatgtttaggctcttgtttctggtttcctaaatttggtgccatacaatttttacgtgctataatcaattaaagggtcccctttttggttttagtaaaatttccactgtaagtagcgccatcaattgagctgtttttgtgcaaccccgaagttgaactttacttttagttttgctttttaagttccattcttttccccgacccttcagtttgtgtgccccaccgaaatcattgcgttcagtgaccgcgtcgccgagttcaagcagcttggctgtgaggtgatcgcctgctcatgtgactcgcagttctcgcatttggtccttatttgttccattttctgttgatttaatacgatccgccgtatgtttttaggcttgggtgaacacaccgcgcaatgatggcgggcttggcaagatggaaattcccgtgctcagtgacttcagcaagaaaattgcggctgactttggcgtgctggacaaggagaccggactgtcctatcggttcgtttttctcggccaaattctaatcggtaattgaaaaaagtctaaacttttcccctcatttcagcggtctttttctgattgaccccaatggcactgttcgccattgtttggtcaacgatttgccggtgggccgaagtgttgacgaggcattgcgcattctgaaggccttccaattctttgagaaacatggcgaaggtccgtcatttattttttttttaaattttggcataataaatcgaaaactgactcaaattttgcgaaacgcacttatttacaaaagttttgctttagaaatttaaatttttctgctcccctcggattacacgggctttgggtccggtgcaccccaaaacgtcgtcggaagactttttgaaccatanactttgttcgctgtcaatcaaattaagaaattngttggtgttgttcgatagctctatgtgtttattattaatttgcaaatctcaaaaattttcgttaagttttaaaaaaagtatggccagaaggactcaaacccagtaatcgaactttnttgctcagatttttt

SEQ ID NO: 31166 - DNA, 1263 bp, Heterodera glycines
aaaaaagcttggcttgagaatcaagactttcgcagcactcaccactaatcaccaatgttttactcgcacacctcttcattgtgcttttcatttcaaattttgaaaattaatttaatcaaataaaaataaataaaaattaaagatttttaaatggatgagcgggttgcctttcgtttttatttgttttaattgacaaacaacaataacaacaacggcacgtgtcttctcgtctgctagctatccctattatacaaatcgctgctttttccatcgatcgttcgttgatttgctcgcctaattgattatgatggccatttccgagccgtgccatgacattggaggcacaacagccggtggcactggtgcaggcagtggtggccatgccgccacagcatggtcaaacagtacggccacaacaacaacggcaccagtgccaagcagcggtggcggtggcattggcattcgcttgcaccagcaggcgagcgacgacgaggagaagtgcctgctgacgcccacctcggagcacagctgttgcccctttgacaatgagcaggtttcacagactgtggccatattttgatgggttttttggcgtttattttgtcggtctcgggggctaaggattaaatttttatgaatttttgtataattttgctaaaaatggactctaattgtaagagatttgagtggtgtcaattcgtttgtcataataaatttgttttgcattagaaatgctttggaaatacccattttccgacattttcaaataaaaaaaaaacccagcttaaaaaatcctggaaattttccccaatttttagtccattttcagaaatttcaaagcacccctctactttagtaccccacttttttgcaaataaaaaggctcaaaattacaatatttgtgttgttttatctgcattttgcacaaccgagcgacacaacaaaaacactaagtgctgataaaatgtgaagaaaggggggaggtgaatgaatgataagaaaaaagcaactaatgtgaccgctttggataacccccgcaggaaaaaggggaaaggttcgccgaaggacgattcgccgacagacgattcgccccgacaaaatgtgggaccgaatgtttttaaataaaattgaaataaatcatcaactttctgggaaaccccattaattaacacacactcgcgctgactttatccttgacatatatgtatccatttagagcgtgcttttgtaatgcgatacaaaagttctctaaaaagacatatg

SEQ ID NO: 31167 - DNA, 1725 bp, Heterodera glycines
  misc_feature (1673)..(1673): n is a, c, g, or t
atgggtttaagaactaatttgagtcttcgctaaaaaccttctactcaaaaacttcgatcaattaaagaaattattatatacattaattattcactttcatcaatttggcattgttgctgagatcggcagatatatttgcgtttttcacgaatagttcgccttaaaaaagcattaaaatgagcaaatataaaaaagttaaattaattttttgcctgaaaaaatctgagcaagcttgacatgacggggccccaaaattatagcattgtatagctgatttacagatggcacacggttccgagagaaaaggacgtattcgacggcacgaagaatgattagtgcctggcttttttggcattttctgttaaaataattttttctaatttaaaaatttattttatttacaaaaattttcattaaaaaagtgattgaaagttagaatatttaaaaaaatcaaattagttattgataatattttaattgtacaaactatttatcctcaattttttttttgctatgagaaagtactggttacaactaaaattgttctaataccatgtgcaaaattcattaggaccacaaccgtaatttgtgtataattaattgactgcacaaatcttttccaacaacagcagaagaggtgtttcccccataatcctcgacacattctttctgcttcaataaaatgggatgcagatgattgacaatttgtaaatgggaaaaaaattgagttgtatagcaaaagtagggattaaattgcagggattaagagacaataatttcttgaaatatacaatatatatttatttaatattcaaataaaaatgcataaaatggaatgtaaatgattaatttaaacatagaagtacactccgacaatcggcggggagagaaaagtcggggatcggagatgaaattgcccgcaaagttagcggatcaaaaagtcagggatcggagaggaaattcaaaaaacaaaaattgtagggtatggatggaaaaaattaggaaaaaaatttatttgtcgagtaacaaaatttcataaaaagtcgaaaaaaagataaataattaacttataaattggcatttattcgtataaaactaatcaattaatgtttttgcttttgcattaaaaagttaaaaaataaattttgaaaaattttagaataaagaaaaatgagtgaaaatattcaaaaaattaattatgtaatttagattgaaatattttgtcaaattaatgtttggctgaatgaagaaattatttgatacatttaatagtggtattttatttgtttttatcaattttcttgagttttagataatttatttatttaaatattgtgatatttaattgtttttttatcaacaagaattttcgacagacttaattacctttttaataaccaattgacaatttaaaatattttcatcatttaaattattaaccttaaattattcgaaaacaattttttctgtttgtgcatctgactaatgttaaaactcacaaaaatgttgtccgaaaattgtctatgcactgattttacaagaaaatattttttttaaatggacatttagccacctgtgcaaatgttggggatattttttggccaaaaaggatggatttattaggccaatcattccactttcggtgactcaaaaaatttcgaataatagtccanattaatacaagaagaaaatgtaaaaaattgtaatttaattttaattatttca

SEQ ID NO: 31168 - DNA, 1019 bp, Heterodera glycines
gggtattattttgtaaagtctttttttcaccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttcaccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgcgaatgttatttttattgaattctgaaccgctttgagtagattatactaaaaaaaattgaaaattttgaaatcatgtttcccactcccctttccccgggggattattttgtaaaaactttttttccccaataaaattttcaaaccccattttttgcaccgggaaggttatttttattgaattctgaaccggtttgagaagattatactaaaaaaaattgaaaattttgaaatcatgtttcccactcccttctccccgggggattattttgtaaagtctttttttcccaataaaattttcaaaacccctttttttccccggggatggtattttttttgaattctgaaaccgcttggggagaataaaataaaaaaaattggaaaattttaaaatatggtttccccccccctctccccccggggatattttttgaaaaatttttttttcccaaaaaatttttaaaccccccattttttcgccccggggaatgtttttttttttgaattctcgaccgcttgggaaaaaataaaataaaaaaaattaaaaattttaaaaaactggttccccccccccctcccccggggggatttttttttaaagttttttttttcccaaaaaattttgtcaccccccttttt

SEQ ID NO: 31169 - DNA, 1482 bp, Heterodera glycines
  misc_feature (17)..(17): n is a, c, g, or t
tgatttcatctctgatncatagtttgagagtcaaacccccttagaggccaccattttgccaaataaaaaaaaatttcttgcgaccttttttaaaaattgcggaacaaattcatccattccctctcaaaaaatccaaagttcccccacctctgatcaccaggaagtccctcctccttgtacaccccggaatcagccaataagaattgctcctcactgtcctcactatgcttgtagacctggaaatatggggaaatatcggaaataaaattttaattttcgaatttttttcccccacctggtacgcctttgggatttccaagttgcacaattgattgggaattgggggcgcttcatttatttcatggcgtgctcgttgaatcagctataaacaataataatgaggtctaataaactgtttttttttcatttcgggtacaattcatttcccgctgaaaaacatttttttaattaataatttttcagaaaaacccatagaattttttctcatataaaagggatttttaatttttttttttttttttgttatagttttttgacaagaaaataaatatgggggtgttcggagttgagcaaaactgcaccttttttgtggcacttttgcttggcatcacggacagcaccgcatccggcacgttcatcaattcattggctcgaatggttgccgggtcttcgcccgtgaccagcgcacgcttgcgaatgttgctgacaatgcgcaaccgctccacccgtgccgcacttgatgagcatgtgtgctcgcccagctgacgcaccgggttgttgtgcagatcggtgtgaagacggcctttaaacagcaacaatcacaaacgacgagagacataatgccaaaaaaaaaaaaaattttatttaaaaaatttggcaatggcaaaattttgtggtttctgtaagataaaaaatgcgcttatcacggatctgagagcttagattttgcaaattacatgagtctatgattttcatcaagtaatttatttttcccataaattgttaattttctaagaattttttgtttgtaaattccgtgttctgaatggtatagaaacaaatgctttagaataagctattaaatgtatgaggaaattaaattttaatttattattgctcctttaggggtcttatgaggcaaggtctctagggtttaatcccgtttgactgcgggttgttttccgcaatttaaatcaacatgaaatttttctgtcaatatgctaaactgccaaacttctggatcaatgagttcagattcgtgatcagcactttttttcgttttcacagaaacacatcattttaccattgccaaaaatttgaaaaaacggaaaattaatttttgttggaccccggcacttgacgatgcgtgaattgaagaactcgcaacgccaaatttgatctctttgctggtactgagtttgtgccgaacatagagcataccgtcctgcaacaatttgggtt

SEQ ID NO: 31170 - DNA, 1735 bp, Heterodera glycines
  misc_feature (26)..(26): n is a, c, g, or t
  misc_feature (1581)..(1582): n is a, c, g, or t
  misc_feature (1719)..(1719): n is a, c, g, or t
agtcaacgactgtcgatcaaatgcanccggcagcacttgtcactgtgcgaattggcaccaccgtttgtcgctgctggtacaactgacgccgttccgctaaccgcggcgcccgaggcagccgggggattgccagggtcgccttcgatgatttggttcaattgttggagcagctccttgccgaaaaagtgccaaggaccaacttcgaacttcatttcggtctaaaacgaaaggcattaagtcacagaaatcagtgattcaagagcttattgttagtctaaaaatggtctattttccaattgtaaattttcctttacctgcccaatggtgaccattgcgcgaccctccaaaatcaaaatgaatttgtccgatggctgcttctttacatacagccgcgctttgcgcgggagcgccgtcttcggacagttgaagtcggccaaatgggacacctccacccggtgcacatgcgcccggatgaccttctcgaggatggcctgcgcgattctgtccgtgtgaaacgcacggcggaaagtgccctccaaaaactgaaaggatgggtatagtcattggtaaatcaacgatcagtgataggtgcaagcgaaagtcaaaaacatatccgacgaagatctaacacaaaacgtaatcagaatggtgataagacaagaaaagtgaatgacgcaacataaaattaattaaaagtacaatatcaaactagtttttaagttatttgatagcttatattttacaattaaggtttacaaaaaacgagagaattttacgaggacaataaaacaaatgattttatgaattgaatctaaaaagaacaaaatcccatcttgaccacccctacacacaaagtcagcacatttatttattctcacacgcatacacacctgaatggttacgagttgcatttgcatagaaatctgacaagcttccccgtcgtcgatgaacaattcaaggtcacggtgctttaaattttttcaggggtattttgtgatatctcttccattttcttaacgacacttgttggcggcgcctcttgattttggtgacattgtccgtgacgacgtccgtttcgtcgacgatttccgcttgtaaaatctcctcgacgatgtcctcaagcgtcacaagcccgaccagttcgtatttgctttctttgtcctccgtcgaaggggcaacgacacggtccaccagcgccatgtgataatctggaaattaaagacaagcgaatatttatcgtttttatcagtaagagttaatacttaccgccttttttaaactcctcgagcattgttcgtagcggggtattttccggtacatgacgcactggatgctggtagtactcacacacagtcttaacctgaattatttttttagataaaaatgaaaaatcaagatattagcccacaaataaattgggcgtcgggatccaacagaatcaagtccttgacaaaaagcagagagaccacattgccgcgcgagccgtcgaatatcggtatgcgtgtgtagcccgagcgcacaatttcggcgatgttttttgcgttgagaattgtatcctgcggctgcatgaagacgtcctannaacaaataaagtacacaaaaagtacaaacaaattctcacctttattcccgtcatgacgtccttcacaattttgtcgttcatctcgaaggcgccaatcgcaatcttcagctcctccgcttgcgccgcattcttcatgntcagtttgatgagctc

SEQ ID NO: 31171 - DNA, 836 bp, Heterodera glycines
atcaaaattagaatagagaatatttataaaagtttatctttccgtattttaaaacaatttaaaattgggcatattttgcgttacaataacaatttttatggtatttaataaattatctcaaaaattctccaaaattgaattttttggtcatatctgttaatcaattcgtaaaatcttcaaaatttcccaccggcgcaaaaaatattagtagcaatttatacatttcgctgatccttttcccagtgggaaacgaaaagtcagttggctctccccggacaattcccgagcgactccggagaaggaattcttctccgtccctttttctcgttatcccgagtccctttttcgatcccggataaaattcccctttggttttccttcccactcccatcccaggccgtccctcaggattttcctttttggctatttttcactaaaatacatttggaactcaactccttttcgttctcaccgatgtcacattaaactcataattccgttttaccgatttcatattaaattcgcaattccattctcacatttcaatcacaaccattttccatttttaaataaataaatcgatcgtattaattgaataatggagaagttaaagaaaaggacatggaaatataaagagcggagaattgcttaaagggaattgggcaattaaaagtggaatgggaaattggggaaaattgcaagaatcccggggaatcacaaattcgggaaggacaccctttaattattcgagcctggcgcattccctttctgtataaatgatagtgtaaaaagtaaatgaatttaatgtttctataaatttatattatttttaatta

SEQ ID NO: 31172 - DNA, 1445 bp, Heterodera glycines
cgcctaagggaccagttgatccgctggctcatcatcattagcatcattcaaccggttctggcgcagttctcgacgggtgccttctcccagcgacaaaacgcggcggcgcctttttttttgcggacgttaattacgccaaaatatgacacgtcgtcgcgccgtcccttggcgcaggaaggaaatgtcctcccctcggcgcatcatcagcagcctcggctggctcatctccattggcgtgtcggcattgatcagcactaattgagcagagcaaaagagcaaaggaaggccgcggattgatcactgatcagagccaatcgggactctgatcactaaactttctttcactaagtttctcctgttttttatgaatccaatcgccttccgccccctttcttaagccataattttcgcttccattttttgtctttactaaaaaactaagtgcaaaaaacaacgaatgataaaaaatattttaaaatgaaaagtaacttatttatgataattttggctttttcttgtagcgtttgcaattttgcaatttaacatattttgaaatataatttaagtttaattatattaaactattttattattatccattaattatgtaaatttttcccttttgaatgcatttgttcgagaaatgaccgttttccgtccgttgcctttgccgataatttttctgctgtttttggcacgtgccttctgcgcactgccgccgcttggccctctgaccgatcacttcctcaattggctggtctcaaatgggtacgaaggcgacgcgttcgatcggcctgacattgggccaagcggaagtttcggaggcaaactgaccacggcacaacaggtgagaatttgggggggggggaaacagtcaattaaaatttgaattaattgtttttttagataacgaaagaaccggtcatttttatacatggaacggtgggaatattttaatacgattaaattaataaaatgattaaaatgctcaaaaataaattatgtaaaaaatatttaaaaattcgatgggcagggagacgccgcacttcacacgcaggcgccccaagcgacaggtgacaacaaattagcatgaaactttgcaattatgttaattaatgcaattgctttcttttaggctggagtcggtccatccaatatttcctcgagcaaaatgtacagaaaaatcattaaaaccaaaagttaaattgtaaagcctgattttttcattttgctacttcagtacacaaatgccgaactttacgccacgacttggggcgacacgtgggggacgggaaatattctgggtaaaattgataataaattaagataaatcaaaaacaaaatccatttttaataaagaagagtttcctaaaaaatttaattggcactaattaacagatggctatgccaccatgcacacctgcttcctatttggtcaattttga

SEQ ID NO: 31173 - DNA, 1247 bp, Heterodera glycines
  misc_feature (88)..(88): n is a, c, g, or t
ctaaaaaaggagtttgagtacctttccagccattctaaaacaccgggccgggacgccaaactcagacacagtgaaatctcaagatttngagaaattcctaaggaaatgccaaaattttgaactttgtatatcttgaaaagaacataaagggttttctgatgtgaaacttgtataaaaactgtcaaccaatcaatttgcctctgtacagaatcgcttttaaaaaattcaaaaataaattggattacactagaaaatgcttttgtttggcatacattttacgctgtctaatcacttattatcaaagcttcatggctttatgttacggcttttctcaggtgccttatgtatttgggcattgatccgtctcagcgcaacatcagaaaaatcgctcaaaacaggcacttgtcaaagcagattttggaggacgaggaattgatggcattaattgacgagcgaaatttgcctccggggatgccgggagaggaagagagaatgcgtggcgtagagggagaagagaagggaagggagacgcagcggaatggacgcagcaaacacaacaaaataaaggaagaggcgttgccggaagacgacgaggtgagaatggaggaacacggcacaacggatggaggggaacgaatggggatggcacaaccaatggggcggggatggcacagcaagcttcgggagggcttaatgccccgtttggtcaataaagcttgccgatttagctttcaaaaaagatggctcctttcctaaccaatcctgacatctgcccactcgtgggcaaaaatttggagggcctttgcccggcaatgatttgcaccgccggcgtggacattctccgcgacgagggaattctgtacgcacaacggctccggcaatttggagttgcggtggaatggaaacactacgaatgtgaggcattgccgaggggtggaggatttcgaaatgcgtttctttcagacgcataccacggcattttgaacatgtgcaaaagtcggcagcgtctcagaatccttacggacatcagtgaatatttgcagagaacgctaattgatagctgacttttgctaagggcggcggaaacactcaaaaaacgaaccgtgggcaaaacgccaaaggaatagctacgaattgcgaaatatttaacttttgtttttagtttaaagatagcgaatagacagaatagagaggagggagagagagagagagagatgagagaaaccgagagaggaaaaagtaaggag

SEQ ID NO: 31174 - DNA, 1838 bp, Heterodera glycines
ggtgttgtatttttcttttttattgcatttttgttcactttttttgggcaaaacgccaaaataggtgaaaataagtttttaaaaattttttttagttttttaggcgctaaaaataaaaacctagaaaataggcactaataactcgaaaagtagcttaacaacccctaaaaaacatgtttttcgtgcatttcagaccctagggagctcatgaaaaaaataggtaaaaacctaaaaatattatccctagtaataattggagaaatagaacggttgtgtatggatttccatttttttgtatgtttttgctaagtggcacggcatttttagtcgtatttaggcacttacaaaattcaaataaaacacactaaaatcgaaagatacatcttaaaacgtaattagatatctattaataaatcattccatttttaattaatttattttttacttttaggtataaatcacgtggaaaatacacatccttcaaagggatcatcgcattttgttgtattaaattggcatttttctgttttgtcacttacagtggaagcgcagcccattgggaaaagtggacacaaaatgggcaattaaatttgaatttaaattttgttttcggatcatttagaccggtgatgtgccatctcggtgacccagcccatcagcccgaaactgcttattacactgacatcaatgccttaatttcatattgtgccgaatttgtgtgctatgcgctgatttggctgatcatttggagaagaacagcacaaagtcattcagtttaattaggattagagaaacgattatattaaatttggaattttttaaatttgatttccatttatagaaccctattttgaattagcgaattaattaatctatgaaaaataattaatgcatttttagttacggaacatgtaaaaaagttgacaatttctgtgagtgttctcatgtcaattgggctcttatgctacattttggtcaacacataatattttaaattaaaattaattaaaataatattaataataatttatatcccatttcagaaccttttcattgtgaagggcataattccgctgctcagtttggacccatttgcaattgaattttgtgtctttccgatcagtctttttttccaaacgttggcatacggaagcagcgcaccagtgctttacttttgcaagtgcaaaacacgaaaataaaagtttttcaaaaaagtttggatcagaaattcatgcctacccatggctggacctgttttttcccctgaaaatccaagaaaactcctagccctggctggacctatttttttcctaaaatccaataaaactcctagccctggctggacctaatttttttccctaaatccaataaaactcctacccatggctggacctgttttttctgaatatccaagaaaactcctagccctggctggacctattttttttctgaaaatcaataaaactcctagccctggcttgactgttttttctgaataatccaagaaaactcctaaccccggcctggacctatttttttttatgaaaaaccaaaaaaactcctaaccctggtttgattgtttttttctaaaaaacaaaaaaaaacccaacccctggtgggacttatttttttttttaaaaaacaaaaaaacccccacccctgccttggattgtttttttttaaaaaaaaaaaaaacacccctgccccgggggggattgtttttttgtaaaaaaaaaaaaaacaacccacccccgggtgggatttttttttttttaaaaaaaaaaaaaaaacccacacccccggggggggggtttttttttttttaaaaaaaaaaaaaa

SEQ ID NO: 31175 - DNA, 1125 bp, Heterodera glycines
cggaaccagcacttgtgaaaagcggtttgtgacggaacggtggtgatcacacgcgagcactgcgaagtgaacccgaagaacgagtggatgtacgcgcagtacgcgtaccgcgactttgagaacatttacaagctgaccttcaacgtgataccacgacggatgtccaacacatttaaactgatcagcgaagaatgaatgaccgacccgaaattttgtgtattttcgttgttttttatgaatgaatagtcactgattttacacattattcctatgttctttaaggcttttcttgccatttaatttttgtttatttatatatatatatttttgctaatttgaatattttccattcattccaatggaagcgcctaattcgccgatggcatcggcacagaacaggggccatggcgttgacccgtccactgtcagtgccgatttaaacgacatttgtgggggacaccgacggaatggcaaatgaagaagaggcgggggactctattgtgaaggaaattgtggcggcattgttgtcgggcggaccgttcccagcagcgaaaaactcaaaaatttctcggtcggtttttttcgacgagcaaaccgaaaatcgaaaaaaaccgaaaaaaaccgaccggtccgatctctactatacactatttacgcgacaaactttcacataaaaaataaaaattatttagcaatttaacgcgaatttaaaaaaacagcaaatttattgtattaagtggtgtaatctgcaggaaaaaaattttgatggaaatgggaaaaagcattttgtgccaaggaagcattcctgccacaaatttaggcttcaaaatgaaataacccgattctcgttattaaaaacagaattgtggaaatttataaaaaaaataaataaataaaataatacagatatttttttctgattgaattagtattcattctcgagcaacccaatgattttcaggccaaatttacgggtttcaaaaagtaggaatggaatccaataaatgttattttcttctctactagagaccggcgcgggccgggatcccgcgcggaagtttcgggatttgcgggattagggatcccgtcccgcaaaaagtatggattccaatcccgcagcgggat

SEQ ID NO: 31176 - DNA, 1152 bp, Heterodera glycines
  misc_feature (1115)..(1115): n is a, c, g, or t
aagtcaatggcgcaatgtttcgggattttacctatagaattaagaataaaactgacaacttattaactgaaaattataggtgaatcacaagataattcaacatttgggcttaaaatccggagaaaagtcaattggcgcaatgttttcgggatttacctatagaattaaagaataaaactgacaacttattaactgaaaattataggtgaatcacaagataattcaacatttgggcttaaaatccggagaaaagtcaattggcgcaatgttttcgggatttacctatagaattaaagaataaaactgacaacttattaactgaaaattataggtgaatcacaagataattcaacatttgggcttaaaatccggagaaaagtcaattggcgcaatgttttcgggatttacctatagaattaaagaataaaactgacaacttattaactgaaaattataggtgaatcacaagataattcaacatttgggcttaaaatccggagaaaagtcaattggcgcaatgttttcgggatttacctatagaattaaagaataaaactgacaacttattaactgaaaattataggtgaatcacaagaaaattcaacatttgggcttaaaatccggagaaaagtcaattggcgcaatgttttcgggatttacctatagaattaaagaataaaactgacaacttattaactgaaaattataggtgaatcacaagaaaattcaacatttgggcttaaaatccggagaaaagtcaattggcgcaatgttttcgggatttacctatagaattaaagaataaaactgacaacttattaactgaaaattattggtgaatcacaagataattcaacatttgggcttaaaatccggagaaaagtcaattggcgcaatgttttcgggatttacctatagaattaaagaataaaactgacaacttattaactgaaaattataggtgaatcacaagataattcaacatttgggcttaaaatccggagaaaagtcaattggcgcaatgttttcgggatttacctatagaattaaagaataaaactgacaacttattaactgaaaattataggtgaatcacaagaaaatttcacatttgnggctaaaatccggagaaaagtcaatggcgcaatgttt

SEQ ID NO: 31177 - DNA, 2383 bp, Heterodera glycines
ctcttaaaaaaattattcgcattaaaatattatttttccccccgcttgtaataactaagccagcgaaaaaatatgtaaaatcataaaattcagggctctatttatcatgcaccgataattaggacatagtttccactttgtgaattcctattctcattttagccgaaacagttatcgagtttctataaaagtttgaaacattgtccgcctcaactgctgacattggcaccttcatgggaaccatctcattgggaacctacacgttgttgaaggctgcgttcccgctcggttcgcttgttgccagtgccttgaatattgcaacaaaagtgagtcaatatccccatatatgaaaatacggtatttaaataaatttcagccatcgaaatcccaacatttttatttggtcttttaattaaatgagtttccctgatgcttacatatcatgcgtttgtttttttcttctgacgtgctattgggattgaaaaataattattagacactttttaccagttatttaggtgctaattgggaaacctcgattatttggcagttttcctttattacacttatcgctatttacaaaatatatttcccgtttatacattttgtttttggtttagcctgaatccgaggaatacaaggccttccaacagcttcacaaaaaaatggatgaaaattttgataacatcagaacaacaattggagtagcgaggaaggttatatcgatggaagcacgattgcttgactacaaaaatgtaagcttaaaaataagtttaaattattatatgatttaagtatatttttttcagaaggttcaagttccaatcaatccactccgtgacctgctggacttgttttggaacccggctgttccaaaaaaggcatcggatgtcgacgagtttcgattgctgtgctatcgttctcacgataagacgcccttaacaattcttcatgtgaatatattttttaatattaaataattagtttggtaaatactaatcagaaggaaaattttagagaaaagggattgttttcattttttgcgtaggtattttacattttttgaattagaataaagtcacttgaaaaaaagtctaataaactaaaagatgttattgatttaatgctttaaaattaatatttaaatttaaagtgatttaacaaaatttatggattactttttattgtatttttatttttaaatgaaaacaaaagaacattttaatgttttaaaaaaaaatttttaggccaaggctccgatttattaaactcagggttccgctctcaattcggggtttaatgggtaaataattttttgtctacagtacatacgagagcacacctacgacgaatgcgtggcagggttgtcaccagatcaaatttcacagcattcaatgtttcacccattcttgaacaaaattcggcttcaaatcattaaagaagtggagaaggaaaattttgacgggttagtatcaagtaaaaaaactcggattattttgcaatgcaatcgagttgggaatgctaatgaatgactagctaactatcagtcagtggacaatctttcagaagagataatccgtcagtgaacccgtcagctagttttagtgccttttttgcgattttggtgcctaatgctgggcacgtaattttgaagccttttttgacttttcatgcgtttttcgtgccttttttcccgaaattgatatgaaattaactcccaaatatgtaaaaaatgtattattttttcggataaaaaatcttagcaaaaggtgaataagcacaaactgctataaaaagatctaatttgtcttcgaataacgttttagctagcttagaaattaatttcgacattaattttttttgtaaaaaagaagattttagggaaacaattttgagaagaaatttccataatctcaaaaattgataaacaagaagattagtttaaaaaaattattttttcaatgtttggttctttttttcggtttgtgcatttttatgccttttttcacttttttcttgccttatttaggtgcctatttaacaaaattttgtgtctaaaaattctggctctactaatgaaaatcattttaaaaaactaataaatttttctacaaaatgataatttttgaaaattttttaaatttaatcgatcaattaattttgcaagatttttaatcattgctcaaaatatctgacgaattgaccactgaccggtttttcaattttatcaatatttaaccaatgtaaaattcaaaaaatattatattatttaaatcgtgatatttgcctcatgtttatagagcttctcatttggttcagtgaaattgatgacgacgatcgcaaaaaattgttgaaagaaatggagaacacaatctttgctttt

SEQ ID NO: 31178 - DNA, 1309 bp, Heterodera glycines
  misc_feature (1256)..(1256): n is a, c, g, or t
tgcagaatgatttaagccaaatgcatgtgcaaacaatggaaaagttgcccatggtcagggaggaattttgccaaaaaataaatggtatactgtcaattactgtattattgttgttacaattagcttgatgagcatggctgagatttatctgtttatacataggcgttaccttaatgcacaattttaataatatttgtggtgcttttaaattcaaaacgaaagtctgaattttttaattttttattttgccagaaatgagtggccttgaaataatccgacgcttctgcattatgtttccactggacaaaatgatcatgatttggccaactgttcgcaaatgtcgcgtttccaggaaagtggcggattgggtgttgcttacgcatgacccaaacataccaataaaggaccaacaaataataccataccaaggtatgtcatgccaagtaaaacacgacgcggttatattacaatttttttcatttttccaggcctatgggaacaaggttttcccgattttttgtcgtccccgaattccaagttcgaacacgaagattttaggcattgattcgggacaaaaaatatccccctacctaaagatgcattaaaagtcatggatggataaattttaaaaataattttttgtgcaacaattgtcaactttttccatttttaatatttttaaattttgggcaaaatccgatccaaaatggcataaaatttcaatttctgcaatatgtttttgctttcagacagtgaggcagttctgttatcaaacacttatgtggacttgttaaaagacaatgaactgtttgaatcaggcacagatgtatcacagatatatcgcataattcaacaaagcgacaaatttttattggcagcaatttggctggtaaattaataataaatttaagatagttgctgaacctaaaattggcacccttttccacccattccattagcattcaaaaaaaaaaatcagatctaagaacgccataacttaggggtcaatggcaactcgtacaaaagtcaactcatgctttacaaaataaagcctaagcttaagcctatgcttagaggcatagtcataagcttcggccgaagtctaaaccttggcctaaccgaagcaattgacgagttgccttagtacaacattgtacgagttaccttttgaacgagttgtcatgacacctaacttagacacaacccaagacgggatattgataaaagtgtatgcattttacaaattattttccctnattttaaattatgaataaattttatttgaaaaaatattcgttttctgcttaat

SEQ ID NO: 31179 - DNA, 794 bp, Heterodera glycines
caatttccaatgaaaagcgataaattggaaatttgtgagtatttagtccgatgaatccttcgcttggcaacgcttttgtgccgtcgggccccgtcgcgcttctgccgcttggccgtgacctgtgctcgttggtttggaccgtgtcaactgccgacgcggcacggcttctccaactgtcgcccgaacactttgtggaagagctgaatgggacacttgtaagcagtgccttttatgggtctccaaataatggggtccattttgaattcgttttatttgcacttttaaactttcgaattatctttttccatttttagcaatttgacaactcttcggctaattccctcgtcaacaattcgttggattgtcttggcaaggcactgaactttttgccgtccaaagaatcgcctgccaaatgcacaattccccgcgttttgtcgctgccttacgatgaccgtgccgtgtttcctctgtcccttggctacgcttacgactacattcggccgcgggttgcgcttattgggtacgaaaaattaaatcaatgtggcggcacagatccttagattttaagcaaggattttgtcactcttggcatttttaaatcgaaaaacccatgagaatggcgcgtttatgccaagtttaagaaagctgaattcagtgatccggtctcattttatgcaaatttaaccaccctcattaaatgtaacttttggttaaaatgttagggaaaagtaccgataactgaaaaatgggaaaagggcctataaaagaaaaatgacaattcggcgctatatgaa

SEQ ID NO: 31180 - DNA, 970 bp, Heterodera glycines
aaatttttctttatctgtcaacttcaattgagagaaaaaacaaaagcaattggattccaattaccaaggacagtgaaaagctgacccacacgtcggtgtcattcaaaattttgggcacagctttgtcaaaacattaaaggtgtcaatttcctgctgctgctatggcttggctttgctacgggcggtgagcaaagccgacgctttttctctattctgaagtaatattcattcattcacataccatcccaaaaaaagagatgtgtaccaataaatagagagtgccagagaaaaaacaatatctttttttctctaatttttctcaccttttggcgtactatctaatattttcattattaggaaaaacaagatttacttcaccaccagcagggatattgcaaaaataaaaataaaaagcgaaaccaaaataaaaagcgaaagcgaaaaggcgaaagcgaaatgcctaaaaaagcgaaaaggttaaatttattttccaaaaattattcataattgaaatcataaatttgaatattgtggtgcaaaaacaataacatttcagcattttcgggcgtcaagctttttctcaaatcattaaaaaaaatttttggaaatcgcaatgccaaataaaaaataaatataaataagattatttccaatatttaaatttttaaacaaaatttttctgacttggacttggtatgtagatatcttcaaaaataaaaatgggtttttcttgtattttcatcgaagaaaatcagcacaaaaaatatgttaaagcccctaggaaccataacttcgtaaaataaactgcaaagaaattttgccaattaatttaaaaaaagtttactgtattttctggccaactctttttccaatgctttatatttgtccaagcacttcttctgttcatccttcaacacttggatttgtccaaccaaatcttaagcatttatattttaacaaatataaattt

SEQ ID NO: 31181 - DNA, 1004 bp, Heterodera glycines
ctgcaagaaattagataggcaataaattgttgtcataacttttgtgtaaggaattattttttgaagtgagtcaaacaccctattagtgctttgctgtgccgagaaccggcaggcaatggatggctttcaatctgcaagaaattagattgacaataagtggttgtaaaaaacttttgggtaaggaattattttttgaagtgagtcaaacaccctattagtgctttgctgtgccgagaaccggcaggcaatggatggctttcaatctgcaagaaattagattggcaataagtggttgtaaaaaacttttgtgtaaggaattattttttgaagtgagtcaaacaccctattagtgctttgctgtgccgagaaccggcaggcaatggatggctttaaatctgcaagaaattagattggcaataagtggttgtaaaaaacttttgtgtaaggaattattttttgaagtgagtcaaacaccctattagtgctttgctgtgccgagaaccggcaggcaatggatggctttcaatctgcaagaaattagattggcaataaattgttgtaaaaaacttttgggtaatgaattattttttgaagtgagtcaaacaccctattagtgctttgctgtgccgagaaccggcaggcaatggatagctttaaatctgcaagaaattagattggcaataaattgttgtaaaaaacttttgtgtaaggaattattttttgaagtgaatcaaacaccctattagtgctttgctgtgccgagaaccggcatgcaatggatggctttcaatctgcaagaaattagattggcaatatatggttgtaaaaaacttttgggtaatgaattattttttgaagtgagtcaaacaccgtattagtgctttgctgtgccgagaaccggcaggcaatggatagctttacatctgcaagaaatagattggcaataagttgttgtaaaaacttttgggtaatgattattttttggagtgagtcaaacaccctat

SEQ ID NO: 31182 - DNA, 1071 bp, Heterodera glycines
aaaactttggtccaagccaatgaatggcacaaaaaatgacaaataatgccaaagtgggggaggagtaaaagatcaacaacagcacatactgtaagtgtatttgttatctcttttcgcaccaaaaaaaaagtgtgaaagaaaagcaaacaataaataaattttcaggcaattttctattaattccatttaaattcatgctcattattttacttaattctcgataattagttataaaatggtatggaaacattaataatgtaaagcaatttttagttccgacctacgaaattgaatttcgtgtcatcataataccgtacccattttcaaaaatacgggtaatgattatatgaacttttgaaaatcacaatgataaagaatcaaataattacctatgcaaaaatctgaaaatggatttttttttttcataacaaaattttttttaatgatttattttacatatttaaaaaaaattccaataaattcgaattttcaccaaaaatgaatttaatttacaaattgttcaaagtggacaaatataaaatatttgtgcttttcaattgatgctcaactcggcaaagtgcccgtgcatgaagttcgcttcatttggttttcatatttctgctgtattttgtgtgtttttgtgccaattaattcggccggtatttttagagggattaagcgacgatagcataccaaccaaagcgcaatcataacgccaatttcggcaccttcaaaaacccaaatgggtcttgggccgaagctgcgataaagctggctaaaagatgaaacaatcaatatttaaatcgaaaattttaaaattaattcactatcacattaactagattataattcgtttccgacccaatcactgccgggccaagcattcggcccagccctccgcacatttccagcatgccctgctcctgcgtttgcatgcgcggtccgatcacacgcgacagcagcggaaccattgtggcattaatgttagggaaggcgatgccaatgcagaggaagatgaacacgtaatagacccatatattcacctaaagcatttacaaaatacagcaaaca

SEQ ID NO: 31183 - DNA, 1261 bp, Heterodera glycines
  misc_feature (1244)..(1244): n is a, c, g, or t
cattcacggtgagaaaaatggggtttgtcaagttattgtggaaaaaagactttacaaaataatacccctgggagaagggagtgggaaacatgatttcaaaattttcaattttttctagtctaatctactcaaagcggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaatttttgttgaaatatttgtcgtgctctgaagggcgtgggagggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaaattttcgaaaatctgagtctttcgtgtggatttattttttgcaaaanttaattcataaatattt

SEQ ID NO: 31184 - DNA, 980 bp, Heterodera glycines
aaattttattaatccgagttcagattcgtgcttagcgaccccgaaaacccctgggagcatgtttataatgccttaaaaaaattttttttatgtggtctaaaccacataagtaccttatttttttctaatttaaataatcattttaatttttaaaacattttcatctgctgcaatattttaaatttattttgaaattcatttaaatcttttagaaattttgaattttatgtttatttatttttgtaaacttttaatacttaataattaagtcactttttattttttcaattatattttcaataaaaattttgaaaattacttaatgaaataaaaataaactttttttaaaaattatttcaaatgaaataaaaattgggttttttaattatttattttagcgttttaaagttgggcaatgcctttgccatttttgaaccgggccctgcaaatgttctcgagcgtcgatttgcccgatttcgcatcagattggcactgttcgacgccgtgtcactttcacagaacgaggctgctcaatttgttggcacgaaatttgttgatgacgacaattatggcacttttgggcgcctaaaaattgggcattttgccacaaattatgccaaagacagtgccgtcgttgatgatgacacaaccaattcgaaaacaatcaccgattttggaccaattgcttatgccattcaaacgtcgggctctaccggtgcaaaatttttgttttttgtgccaaccgatttttgtgtgaaagtgccaaaatttcgtttttttcggattttcaggcattccgaaggtcgtcttggttccgttctctgccattttgccaaatgttgaggattttatgtaattactatgtgaaggaaacttcaaaaaacttcgaaaatttctatctttttataaaaactgtaatttaatgacaaaaatgaaaaaaaaaattcgtttttcaaaaataatgcaaaatattttttgaa

SEQ ID NO: 31185 - DNA, 2257 bp, Heterodera glycines
ttgagcgacgaatgtcagcagaaatttctcgacgatccccaccaactctttgacgatgccgacacaattgggctgcaactttcggcattttctgcggattcgttgcggcgaaaattgtccccccaagtgacagacattggctggtttctccgcctcttttgcacccaaaacggtgcaaatccaatgatttgacactttttttgctcattttctccttttttgtcagatgatggttccttttgcgtttgtccgtccacttttgtgtgctgtcgtgcccaatttgtgctgcggtcggccgccgacggtgccaagcagtggcgcctcgacgagttcgagcagtccgtccgtcggctgctgcccgacgccttccgtcacctcaacccgtgcgactttctccacggaattgccctcctctccgattcgctcgtctacgggaaaacccttcgggcgcttttgcccgatgcattgcccagggaattgggcccgaggtggtgcacagacagccattgaccatttccaatccactttggtgctcgagactgagctttatcaacgatgagattttccttgagactcgacatacacgagccccttaatcccgcgacttttctcgaatcgagactctcgagcacaaccacaagggatcggaattgtccattctgcttatgactaatcgccccccgccccccacagattgatgcatttgttcggtctgaaagcctcgtggaagcgtgatgagttgcggccatacgttgcggacttttgctccaattcagccaaaatggaagagttgctactcaaatactgcaaaattattggcagtggcgctgaacgtgcttacatttacagacaaatgtgaagaacctaaattgatcaatattttgtttttgccttaaatcgtcgctcatcgttataaattttgcttttggaattaaaaatttttttctttccatcggattcctcccctgcagaatgaatgattggttgtgtgtactccaaacaatttggaaaagggaatggtttatttagacgagctttaggttaggcttaggcctgagtttaggctattttggaaaatatgatttggtttttgtatgagttaccattgaaggcagacaacactagtggttaactggacttggtggcaccaccggaccaattagccatttttcgtgaactgcatatttttttcctggagtgtgggaggcatgaaacgcacgaaaaacatgttttaaacttggtttgaagcttctaggccgtatttccatatgcatattttgcagggaaccggccactttggcgcaagactctatatcattttgatttcacagcaaaattaaataatcttggtatgattttaagtggcttgatagtgcctattaacctgcaaagtttcaaaaaatttagctgagaaacaaaaaagttatggccaaaaaacctcaaaaatttgcattttcctggccatttttggcgcagcgcgccatatcttttttaaaacctaatataattttttgaaattttgcaggctaataaagaacatttagacctattgattaatattaacattattttatttggtcgaattaaaaaaaagttatgaatctttaaacttgtctgcgccaaaatgaccccgaccctttttcatggaaccatatgcttgcttttcttggacccacccaggcctatgtttttcctggaatgagtaatggattttttgtaagcataggcttgggttttcggttcttatcccttttgtccccctccccccctgaaatttttttaaaataattttttctagggtaattttatgcgctgaacacatatatgatgtttatttttagctcttatgctcttacgtgtgttacgtgaaattttttgactagtcaacaacagtatttcgtcgataataatgtgctttgtcccccccccccccctccatttttcgaaaaaaataataaaaattttaaaaaatcgtgaaacaccttccctgggggttttcgaggtcgctgatcacgaatctgacatccattcatattaattccgaacccgaacccgaattcgaagaaaaagttgaaaattcaaatttaaattttatttaatttttcaccattgctcaaaaattattataattcattgaaacatcaatactggttattctgtacagattctaacataaaagtaaatttttaaaaatttgaatttcgaccttttgttcgagttcgggtccggggttcggaatcggccaaaactaatgtta

SEQ ID NO: 31186 - DNA, 1018 bp, Heterodera glycines
taaaaacccaaattaaatgattgtcaaacattataccaatttatcaaaattaatcatgaaataaataaatattaatttataagatgcaaattttttggaattaatatttaagacaaatttgaaataaaattactatggtttaattttacattttaaatcattatttctaatgcctgaattcgttgccggtacagagaaattggcacttttaacaaaatcagcaactatacagctaaaatattgaataatcgatattttgataaataataatagtttattttcagaaggacactatattcgtgaactagtcatttactttacatatacactataacacataaataaataaattaaatcagaaaactaaaaaatataaaaagagtggcattaaaatctaaattagagaatatttaaaaatgtgataataaggcctcaaactttcagttatgtgaaatttttatcccaaaatttttgaacaaatccaatacaggtgtttatttaaaccattttaccacacaaaagaaaaaatgcataaataatacttaaaaattcatgttgtgtttcataaggcttcattacaaaatttttgaattagtgcaattttgtgaaataaaccaaacaaaaactataaaatttcagtttcatttaaataaaaatttgctatctcattaaatgctaatttattttttcattcaatttaagcatcaaatttaattaaaataatataacaaattttaatatctacaaattgataataaggttttcattgagactaattatttttaaaaagaaataaatgaattaaggattcattatttgtgaacaattattgatagaaaaaaataatggaaatgttaatgaattctataaaataaatgaaaacgttttaaataaaaaacaataacactaaaacatctattattttttatgaattgagctaagataacaattatttcccctaaaaatatctatgtgaaataaaaaaattttttttgtaagaaataaagggttcaaaaaa

SEQ ID NO: 31187 - DNA, 1246 bp, Heterodera glycines
  misc_feature (29)..(29): n is a, c, g, or t
ttctttatgtgttttccttttttctgtgnatgcaatttttgctttgttgccgatatgccttcacttctttcggaatcatttttgattttctttttctctaaattattaacttatctaatttcttctaaacttatgcacctcgtccaatcgtgcatctttttgggttttagttcctgaatcattcatttgtaaaaggagaaaagaaattctatttaaaaaatgttcagttgtttgagtaaaatcatcttcattttgtatttgtggtaaaaacggtcttaaaaatttattaaaattacaaatcttaagattgaaattacttacttcatattcagttaatgtttttaacaaaatttcgtctaatgcctcatatattttagctctgggtcttggttatattttttcatttttcaatttgacaattctatcgactacttccgacatcactgtttgaaaaaaatttaagaaaactccaagagaagcatgccggacactatttcgatctcttaaacagatttttctgtgtatcataagagttcaaaaacctttttatagctgaatgccacgcttccgcagggtttgtgtttcttgttctggctaaattatgaaaattccacaaattaccactttcaagctttcttatccattctcgttcatagtactggtgaaattctttaagattttcatttatatttccatcaacttcaaatgcctttagatgtggccatattcgaattgaagccttttggggctagttcaaaagtcgcatcagcgaccataatccgacaattttttgctgcgtctaattgtgtttgagaggcgaatatcattacacctatttcttgatttttatagatcagccattcacttccagcaatttttttccccattgttaatttgattgccccaaatttggttaattgaagcctcggaggcacatcaaatggttctgctgcttctgatccgtgtgcttgctgacgtcttctgttataagactttctaatttctatccatgatggatagaggttagtcaaggaattttgttccaaagaatcgacatctttttgcgcatcttcttccctaactttttcaaggccttgtctccagatagtctttacatcgctattacatttaaatattttttttctttgttttctatccacttgttctgcttttattacttccattgtttctgcttcacatttcgagttatgttctgcctgggtgatgaacaaccttttctcccccc

SEQ ID NO: 31188 - DNA, 1097 bp, Heterodera glycines
ttacctcagcaactgttgttcagttttgttctctttttgtggccgtttttgtttttcacgctgatcactgctttttgtaattgaaaatttagttagtttttttgttgggctaacaaataattaattaattacccaagtgtttcttcagctccttgcagtttccattgttcgcgccgattacgaaaccatatctaggcaattcattaaaatcttaattacccaaaattatttcaattggacactaatcaaattaacgggggggggcggagtgtgcaatcgactctcgtaggttctttaactgtctgttctcttatttttctaccatctctttcgctgtctctctttctttagttcctccaccccactgacttgtcctgccgccccgttaatatagaaataatttggcattatttaaaataatcttttactttgacttccgtttccgtcaaacagtattctgcggccattttcttgcgcattgaaatgtccggatattttatctgttcaaattcgctttccaatttggcatatcgcttggacgaaatgcaaatcagttccatattaaaatacataattagaatatttaattttaaacaaagaatttgtgttttaatgaattcaaattttctacggcgtttgtctgttaacattaatcatttccacaaacttttttctttatctgtgccgtgtgttctgcgagtttatcccattttctttctcttgttcgtcgactttggaaccatttctaaattaattttcgaaaataaatataaattaaataatttgggcgtccccctcaattacattaacttgctccgccgtaaggcccatttccttggccaattcttcgcgcatataagcatccgggtatttgatcttctcaaattcgctttccaattcctgccattggtcagactaaaattttgtcattattcacataaattaattaaataattttatattttgtagtttaaattaaaagaattttgactctaaatggtcgtttttttaaattttgctaatttaattttttttttctatgcattagttaccgtatattcctgtcgcttagccaaagtggacatttttaagttatt

SEQ ID NO: 31189 - DNA, 1384 bp, Heterodera glycines
cataattgacttttattatgtaaattattgctttaccctcctcaaatcacactttttttttgcttgtaattttctttttttaatcaaaacagagatgattaattttgtttgtccatcgcttttggtccaaacaaatgatttctatagaaaaatggctaaataagatagtttttgatgatgttatcagcagctatcagcagatcactgacaaaaaaaatttacataattaatcggaaaaaaataataattaatagtgatcaaaaataaaaataaaaaaggtctcagtattcggtttgttaacttaatttttgatcaagatttgctccgaaaaatgatccaagttgttttgcttttttgctgaattttaattaatcgaggtaatttactgtcaagagatgccgccgattaccgccgctgtggaaaatttcataaattttctcctgatttgttaatatgtagatagatattgcaaaactgtcaatcttaccgaatttttaacacaaaaaatataaaataagtcacaattttcatcaattatttaactctgaactctaagtgttattttggattttttttcccatttttattcttaaaactaacaaaatctccaaagacaaggagataataatctttgaagcagcttcccttaattatgaatttaatttttacataatttctcgaaaagcgatgtcttccaattaaagaatttttttagtttgtttgttgcaaaaatctttaaataatcgagaaattttttaaattttattgggaaatccttaaaaagatcatcgtctttacttaaaccagataataattgtttgacacctgtagaaaattatttgtttttttgtttatgaacattttaatatatgatattttattcaaaattccccaaaaaatagaattaataaaatatttttgcaataaattggttttaaatgccatcatgggttaactttcgagacatttgcttgcatgggacacttttcttcaccattcatcataatttgctcaataagcattgaactgcagcagatggtcaacaatcagcgaattggccacagcaaaagcggctaacaattaaatttaaatcaaaaacaaattcaaaattatgtttaccgatcactagcatcagtcctccaaaattggcacagtgtccgatggcattattttcttggaaattcaaccaaaattctctttcaattatcaatgatacgaacgaatattttaccgggtgctgggtcgttactcaaaaaccatcaaatttaaaaattttgacataaatttattcataacttcgcccaaaattaatcaaagtttaaaatcttgatacctttccgatagccctaagtgttttctattattctgcaaaatttcaaaaaaa

SEQ ID NO: 31190 - DNA, 1295 bp, Heterodera glycines
aaaaattatttgtgagtaaattggtttttaccgattgagccgagtttggttgcccactcatcaattagcttttcaatttgtttttttacttttaaaattttttctttcttcttttgacttaattcaaacggagcgatgaattggataaactaattaaaaataagaattgaaataataattaatttggtttcttctttttctttttttacctcatttgatagtttaatttcactttcacgagtgaattgagttgttcggattaaatggtaatcaaaaaaatagtcatcattataaagaaaagcacctattttaattaaaacattttaaaaaataataattaaaagacatttaacctattttctgttgtttttccatcttttcaatgttctccacggatttcaccaaattttccacacttttgaaaagggaattcagccgttccatgtttattatgtgtgaataataacgttgccaatttggtgcgcatttcgtttcatccgattcgtttgaagcggtaattttttgcacattttttgctaccaaaactgaaaatatgtgcgtgtgaagaatgtccaacatttggttgaattctgtgcttttgaatgacccaaattgggtggtaattagcccattagcttttttatcattttgaggaattgacacggtttgtttgggagaatgggttttaaaatcggcactttctttttcaattttcatcagttcaatcgcctccaaatactcaattgttttaattaaactcctttcattttgctcactaaatttaatttgctctttattttcttaattaatttattaatagtttccagttatactacagaataagccgtaaaaccgaaatttttttaagtttttattcaaaaaagaagaaattatttttttatatttaaaattcttgattaagttatattattttgaaaaaaagtacagatttttcaaatttttcgccactatttaggccaataaattggaatttcgctcctaaaaatcctcgtcctaattataatattccatagatattttttgatcatttaattatgaatattatttaatgatcaaatttagatttttcttactcaagaacatatatatccaattcattgtgcacaaaatataatttctccatcaaaaatcgcatcgtttcgaatttgtccaattttatgccgacaaattccttccattttccattaaattttttccaattgtttttttctgcaatttcattttttgcacttttttcaataaatttgcgcttcgcttcaatggccttttcaagc

SEQ ID NO: 31191 - DNA, 1317 bp, Heterodera glycines
  misc_feature (1272)..(1272): n is a, c, g, or t
gatacaaaacgaaggaacgattgaaaacgtcgaataagccatatgatgacccaaaaaatccagcagtcgtaccataatttagcggttttttaacataattgcaaaatttttacgagatttttttttattatggcggtgaaaaaaacatttttctacgggcggcgaactaaaatcaaatcgcggtttttgcgtgtgcttttgcccacccggtagagtcggttcagaatttccttcttctccaaattgaattggcattcgcctttccccttggccaaaagtgtccttttcttttgctcttgttcctccaattcggcaagctgaatttgcttcagatgacgctcaagctctggaaaataaagcaattcgtttttaaatgtggctcaaattaaacaaaatttccatttttttaaattctaaatccccccttttttaaccggtgtatcgcaacatcaaatcggcgtttatctgattgaactgggggttgtccgatgtgttcatgtgttccgacattttggtcttcagataatcgagcgagaacgaattgggcaacaaatcgctgatggcaatggcatggaaataatgctgaaaaatgagaaaaactttaaaataagtgaggggctgggtaattagtgtaataagacttaattaatgagtcattaccgaaagatggtttatcgagcggaggaggaacagccgtgtgacggggtccggcaaatgctgcaagtgcttcttcagcaaaccgacccgattttggtattgcgtttggtcgtccacgttggggaacacaatgtcatcctaatcaaaattggggggaggggttaataaaattaaattattcattacaaacaaatgaaaataataaatcattcgcttttttcgcccacttttcctagggctgccaccagtcgcttttccacaatgttctgcaatttctcctgcattgagcgctgaatctcggccatacaacttttgatggagtccacaaattcgttgttgtgcggccgactgaccttttcgacgcctgcaaaatgcacgcattttcatagacaccgcaaaccgaccaatggatgcctcatggaaaaaattccaagggtattggtcctggaaacccaaaaaaaaaacccgagactaattgttgtaagaggcagctagaaacgtgaaaaaatctgcaaattctgttgccttcgcaacacttacggtccaccggcggcgtgacgtaatccttcaaattgtccaactgatgccgcacggaactaatggtttcggctctcnaattggcgcacagcgatagcatgtgctaaaagcaattgccaattt

SEQ ID NO: 31192 - DNA, 1032 bp, Heterodera glycines
agctgggtttaaaaattttttcaaaaaatcaaagtcttttcgtttttatttaattatttattattttttgcaaaattaattcataatttttttttcagaaagtgctctgaaacgcaccaaattttatttccaagatattttaggcacttagatgctttttctatcaaaaagggagatgaataaatttttaaaaatttttaattcctttttaaacaggccaaaaagtttaggcttaactttttttttcagaaactgatcagaagcgcaccaaactttgcagggaaactccccggtaaaggactaacttacactgaaatgagcgccgagctagctgggtttaaaaattttttcgaaaatcagagtctttcgtttttatttaattatttattattttttgcaaaattaattcataattattttttcagaaagtgctctgaaacgcaccaaattttatttacaagctattttaggcactctgatgctttttctatcaaaaagggcgcgaagcggccgagtcagtattcttggttgcaagaaaaaacaggccaaaaaatttaggcttaactttttagtgaaaattcaatcactcatttttcgagtagtgatcagaagtgcaccaggttttgcaggagcctaaaaaggtcaaggaaaggcgtctctgcgttgatttagcagtagtacctatgaatttaaatttcctatgaatttttaaaggttcacaatttatttattttttgcaaaattaattcataattattttttcagaaagtgctcttaaacgcaccaaattctatttacatgttaaataaggctctctgatgctttttctatcaaaaagggagatgaataaatttttaaaaatttttaattcctttttaaacaggccaaaaagtttaggcttaactttttagtgaaaattaatttactcatttttcgagtagtgctcggaagcgcaccgggttttgcggggtaagagctgagaataatgcggattcgtataattatttaactgtccccataatgtttctttaa

SEQ ID NO: 31193 - DNA, 1403 bp, Heterodera glycines
  misc_feature (52)..(53): n is a, c, g, or t
  misc_feature (1295)..(1295): n is a, c, g, or t
  misc_feature (1299)..(1299): n is a, c, g, or t
atgctatttttaagcccctttcttcatagcatatcgcttcttcaaaatatgnnaatccatataatttacaaccctattaatttattttgatggctgattttaaaaatggatatgggcgaaatgtccccaatcgtctatgggaaataaatttttgtgtcgtcattgactttttgccgctttttcctttgctgaattggtccttcccctccattttgatttcaaaataaaattcgggtaattaataaaaaagtttctaagctatttttcgatttttgaaaaaataaaattaatgaattcatcaaaaagtataaaaatcagtagggatgcgatttttaggtaagaaaaatcccagaataggtacttaaataggtaaaaaaaatctcaaaataggtattaaataggtacaaaaattccaaaataggtaccaaaataggtaaataaaaatttttattaacgattttttagcggaaaaaagcaaacaaagaggtaaaattttggttctacatatctctttgtaaacgaaaatttaaatatattaatattttcttagataatattgacattttaaattaaaaattttgtcaatagaaaaaataaataaattttgggataaatttttgagaaatttttccaattcttagggtgcatttttgaaaaattttttggtcgattcttatgggtatattttttgattttattgcatttttgttaagaattttttgaaaatccttaaaataggtaaccaaaatgccgaaataggtataaaaataggtacctaggtaataggtagaaaaatcccaaaataggtaaaaataggtattataaaagtgggtgtagaagctccaaaccaagttaaaaactcgttttttatgcttatctcaacgttacaagtgcgtaaaaattttaggtatttaactaaaaatcgcatccctataaatcagtcagaattttgcttttttcaggaaaggcaagcgcacctcaatgcgttacaggccgtctgcgatgccgacatcaaaagtgtcaaagaggaagaggagaaggagaaggaggccgcgcaaattcttttacaggcggaaaaacagcgtgaagaggccgcgcaaattcttttacaggcggaaaaacatcgtgaagaggccgcgcaacttcttaaagaggccacagaacgtcgcaaaaaggcggaagaaaaaaaggaaaagtctgttccaagagcttcgatgtcactggtcacgaatccgttatccatttagtacaattccatatcacggacccgaaattcagttcgttttcgtgtttanatanaatttgaaaatccgaaaaactaaattttcgattttttattcaaatcagacccggggttagaagctgtctgaaatggatgagagggattcgtgatcagcgactcc

SEQ ID NO: 31194 - DNA, 1260 bp, Heterodera glycines
  misc_feature (191)..(191): n is a, c, g, or t
aaaaaatgtgtttttattttgttgcaaaattttcgtttttttaagtcttaaaacacttgggaaaaagaaaaattttcccgattaatacaaaaaaccaaaattttaattaagaagaaagacacaaaaatgattaaaaagagcaaattgatcgaaaacattagtgaataattaattcttccttcagagagtgnccaaatcgaatttgaaattgggcccaaaattcgcctcaattttgtcaccagagtcaaacaaagtaacgaatggataaaatgagccatcagcaaaagatggatcaaccataaaatcagaagtatctgtgaaaaagttgcgggattttgattatttaaacataaaaatcaattagcattattgacgccaattcctacggtatcaccaaaaccgtaggaatatttgtcgcagaaccatacacactgggtttggcacaatgtgagacaaaagttttctgtagattattctgattacaagcattttaattttttttaattattggctataattagggcagggaaatttaggtaagaaaaatcgcgaataggtattaaaatcaggtagaaaaaatagttaaataaaattttttatttatgttttttttgtgaaaaaagcaaacaaaaagataaaattttggttctattcgtatgaacgtataatttaaatatttctagtattttcatagcaaaaaatgaacatttttaaattaaaaattttctcaagaaaaattataaagaatgggttccactaacatcatttactaggcgatatcctcctgctgatcactgtgattgataaaggggcgacggagggacttatgcgcccattcaaacaaatttttgtattcgcactttttgaaattgaaggggtttgattcaatttgcaaaaacatttccggtttattcctgctgcacgtgcgcatacataaggaagagaggcgaatagagcagggctcggatcgaaaaattttcaaaatcagaacatcgggtccaaaaaatcagattctggggtcgaaaatcaggacattttgcaaaattgcttcaaatcagttatttttacaatttttcgatcaaaaatgtatcaaatattatatttttcgtctcccattatcgattttaacaattttggggagaaaattagcaaatcatcaattttagcgcattcggaatcaaaaaatcagattttaaagaattttttgcggcgcatttttccaaaaaacttttaggaaatgggcgagggggggagggtccg

SEQ ID NO: 31195 - DNA, 1287 bp, Heterodera glycines
caaaatcccgagggccaaaaaattgccaaaaaataaagaatttttaaaaaattccaaaaattctggaactgaaaacaaacaccatattcgtgctcagcacctcaaaatagcccagaaaaatatttttcacccccatttttgacccaaaaaaaaattctgaaaatttctagggggcctagctcgaaaatttttgaaattttccgggcatatagcacacctttcggtagagcttaaaattctctacaaaaatgttctaagacgatttttagctaaaaccaactcctgacgagttatgggcccgggactcaaatgtcccgctgaggctaaaaattttttctatttccgggaaaaaatcgaaaattttccgaaaacaataccagtcgatagagctcgaaaaactatgttttggaagtggtcttcgttttgccaggaaaattcgttaaaaattcttaaaattcaaaaacccaaaaaccgttttttaggcctagctcgaaaaattttgaaaattttcgaaatttttaaatttcagaaaatcgagcttccaaaactctacaataagtctgctgggcacctttccctcagataaaaccccgacgcggtattcgcctggtactgaagtgtactttttgagcacgcttcagttgccattttctgcaggccagggggtggctctattaaaaaaataaaaaataccagcatgtagaggacactttggcggggtgccctcgcagcgggcattttttgattcgagttttagaaaaaaagttacgggccttgaaataaaaacaaaagtgagaaattagccgccgggactcagttggccaccggagagaaaaacccgtatttttcccagatgcgcctcaaaaagttgtaagacccttccactactttcagggcgctcccggccttcggccgggagattttgttttttaagacgagtccccctttttctctatatatatataaactagcgtgtggcgcagtaattgctcggtgtagacagtatgctttgcacagtaattgctcggtgtagacagtatacttttggtatatatgggcgggcgctgacatgagcgcttcgcgcaaaggacttcgttgctagtgcatgcgcgtttgataagtgatgagcaagtgcattcggccgctttgcggcctcagacgggccttgcgcccgttttttaattttgcgggggacattcggccgcttcgcggcctcaggacgggcgctttgcgcacgttttttaattttttgtggggcattcggccgcttcgcgacctcaggacggg

SEQ ID NO: 31196 - DNA, 1040 bp, Heterodera glycines
tctcgctgatatggtatgtttcagttaaggtttagccgatctacaaaatttcggcactgtctattttgtaaaagcgaatcaaattccttggatttccaaagtggaattacagaattgcgacggcaaatcctaaatagacaacgacgctttcattataaagctttaagggagacaaagtaatacgaatatttcaatttcttacttatccgaatagacaaagataggttacacacgaacatttttatagaaattccggctgaaactaaaatccctcttttggtcttaacctatgatttttggcccattatggatgaattaagtatagaaggcgtcgcagaaatacattcatattttctaaattcgggtttcagaaaattaagatttaaaagaggctgaattacagatgcttttcaaattttgggtgtatccgaatagaaagaagttggaaatcagtacttttcacgcctataaaattcgggccgaaaaatattggtgtttgtgactagaaaaatagcagatgcatatcaaatgactacagaaaattacagcctccaagaaaataattgctttgcacaagcaatattttgtagagcccatcaaacacattgtgcttataggaaaggcagaattatacaataggggcctttttattatgattacaacaaatcagcatggcgtctcactgatatggtatgtttcagttaaggtttagccgatctacaaatttcggcactgtctattttgtaaaagcgaatcaaattcctttggattccaaagtggaattacagaattgcgacggcaaatcctaaatagacaacgacgctttcattataaagctttaagggaggaaaagtaatacgaatatttcaatttcttacttatccgaatagacaaagataggttacacacgaacatttttatagaaattccggctgaaactaaaatccctcttttggtcttaacctatgatttttggcccattatggatgaattaagtataaagggcgtcgcagaaatacattcatattttctaaattcgg

SEQ ID NO: 31197 - DNA, 1284 bp, Heterodera glycines
  misc_feature (10)..(10): n is a, c, g, or t
ccatcaaaantctgaggccaattcatcgccttcctcttccattggtcgcattgtctgttgaaaaacaatttttggggaccctggttagtgctatatgtccatgtcaaatttgagtcgagaattcccgaaattctctcacaccccccccccttttttttggacggttctgctgttcttcgcttttctgcaatacttgatttatataaaattttttaaaaatttcactattttggctccaccatttgctcgagactggattcatttgactctcgaatgtcttttggattgattgagtcaattccaattctcgattagaggcttcttgctttatctcacaaactgctgcttactgctggtgggatgattaccaatcgggacaacattttgccaattcttattttataccaaaaagcttgacatggaatggaacatgatccgcgcggagggggggggggggaagtttgagcaccagaaattgggcatgagtaagtttggacactttaatttaaaaatttaaaaactaaaaaaaatgctagattacgctgagagttcatctttaaatgaccctagcagcgcttataatttattgaaatttaaaatggaaaatttagaactttattatttaatcagtttttacagctgtttaaatgtaattgcttggttttcattagagcccggaaatttgaaattttcgtattccactgcgggattgaaactcaaaagggatgatggagccaaaaatggcgaaagttttcaaatactttataaatcaattattaatccagaaaatcgaagaacaaaaccgtcaaaaaaagagggaagagggggggggggggtgagggaatttcaggaattctcgactcaacaaaattgacatggacatatatgtagcacaagccaactttaactggcagacgacaacttcaagcagtatttttcaaggatgaatgagtgatagtggtgagcagcagcacagaggaggaggagaagcagcaaattgcaaaagtaaaagcccctcaatcggcagagaatgggcggcagcgcccgagggcttcaatttatggttgagaatatgcaaaagaagcgcacaaccggcaaggcgagttgtgttgtgttggttgttgctgctggtcggctgaatgagttacggacggagacggaggaacagatcggacgaatttgggggagacggaagtaaaatgggggagggggaaagaggtcatcatcattcatcctccattcataaagtcattgtaccgcgccaatcgaacacagcagtagcac

SEQ ID NO: 31198 - DNA, 1192 bp, Heterodera glycines
  misc_feature (1156)..(1156): n is a, c, g, or t
acaaaattgctcataacgccaaatagcgtaattggcgtaaatttttggcgctaattcaaaatttacacttgtgccgtttttgtattgttttaaatttttttttttgtgtacataaaaacgctaaaatgcaaaatacgaaaaaatcgcaaaaaatcagaacaagtgttgaaaaactggtactagtgcagtttgggtccacaattttggtcaaatttttcagaagcgtagccagacagtcagacagtgcactatttccttctttatttttctcacctcttcccttttcccacacacaatgctgccagccagcacacggctgcttactgtctacccttccacccgccgcggccccacgttgacagacagtcagacagtgcactatttcttcctttctccagtgactaagcggaagaaaagaaggaaatagtgcactgtctgactgtctggctacgcttttgaaaaatttgacccaaaagggggacccaaaccacattagtaccgaaaaatttttccctatgttcaaattttcttcaaattttgcataggccaatattttgaccccctctagcgattccaagtttattttatggaacttaagtttttaactcgagatcggctcttctatttttacaagggaaaatccccaaaaaattttaagttttgcaaagttttggcgttctgattactaaataaataataaacttatttgcactgggagcccaaaattgaatcgccgtgtccaatgataccaaatttatatacgttttccgagttacagttcgggtggttcccttgtgagtcggacctcaactggctaatacttactctctaaattaaatttgtaccaatttggaaaaatttaattgttaaattttaggccattcccaaagcattttgtgcgttgactcgccgagttgggacgatcaaatggtcgcctccgggtccaaagacaattccattttcttttggcgcattggtggagtgaagacggactcggccagcgatgggcaccaaaatttgacggatgcatttatggccgacaaaattgcagtggccacagggcacactcattccgtggcaaggttggcttcagcactttggcatttttcgtcattgttggcattgaaatggctgacaatgatagaatattatttcngtaatcactaaaatgctcttttcagtatcgcctttt

SEQ ID NO: 31199 - DNA, 1281 bp, Heterodera glycines
  misc_feature (46)..(46): n is a, c, g, or t
  misc_feature (49)..(49): n is a, c, g, or t
  misc_feature (60)..(60): n is a, c, g, or t
ttatagccctgcttttctcttgtcagttgaaggtctctcatggcgntgncaatcataagntatttttttaaatttatttttcatcaaaaacagtggatcattttatttggtcctttatcagcatttttcgtggtatccaattgttgtcagatgaatgttttcttggtgagggaggagatggaatggcgtgtggagcatgtcgttgtcgaattgtccaaattgtatcgccgattgctaaatgaaattcattctttcattggttttaactttcgcctcgggcactcacaaaagtgctgttgttcggaatgtgctgtgggccgtgtcgcccagctgagagtggtgcctggtgggcttgggttcggcacgagtcgccttctcgaggggttacggacggagcggcgtctttcaacgcctcccaattcgggcccatcgttttgcaatgcacggcctaagggcaataaaagagtaaaacggcacaaataagaacattaattacaaagcaaacaaagggctgacccaagggaccgtgttagttacgccatccaacggagaacggacgaataaacggaggaagggatggcatttgcgcacctatccaacaactttccccggcccttccaaggccatcccccccccccattttctcccctctttttttccctttgttttgtccatcctctcactttcgttccctccatcaattatgcttccaaatgacacttttataactcatttccctccccgtcgtccccgtttaaaaaaagtgattgggcatcactcgcacctttaagccatcggcgttaaatgttaatccccaaaatgatgggacttggatggattatcgtgtcaatttgcagcatttccttcccttcgcttcactcacttcgtaataaggaggaaaggaattggagagggaaaaagcgaaataattcaatattttggtcattttgaagaacaaaaacaaagtgccaaattcggcttttccttgtcaatgccttcgtttgcttctcaccctcagatgcttgcgtaagcttgaagggtgcgtgtatttcttttcgcagcccaactgatcgcatcggtagggtttcctctgcggttgatgaacatgttgatgtttcttccgatcggaactgttggcaaaatatttgcaacaattctgacatttgaagggcctttcgcctgaaatattcgaataggtcaatcgtttctttcatttttctttttcaatttttttcattaaaatctttgaaatgcaaaacatttccataaattgactaaaaa

SEQ ID NO: 31200 - DNA, 955 bp, Heterodera glycines
  misc_feature (929)..(929): n is a, c, g, or t
tcaggctgtcttttaaatttttgacagccttcaactccccagtttgtgtcttattgaattcttgaaatcctactgctttgcctctaaaaaggctattgagagatttattttagaatgtgaaaattttatttacattattatttttggtagatttattagtgctgacaattatattaagtagaaatcactcaggctgtcttttaaaatttttgacagccattcaaaatttttttataattttttgttctataattgaactcattgaaaatttagactgctttgcctctaaaaaggctattgagagatttattttagaatgtgaaaattttattttcattattattttggcatttctttagcatgaattggtagatttattagtgctgacaattatattaagtagaaatcactcaggctgtcttttaaaatttttgacagccattcaaaatttttttataattttttgttctataattgaactcattgaaaatttagactgctttgcctctaaaaaggctattgagagatttattttagaatgtgaaaattttattttcattattattttggcatttctttagcatgaattggtagatttattagtgctgacaattatattaagtaaaatcactcaggctgtcttttaaaatttttgacagccattcaaaatttttttataattttttgttctataattgaactcattgaaaatttagactgctttgcctctaaaaaggctattgagagatttattttagaatgtgaaaattttattttcattattattttggcatttctttagcatgaattggtagatttattagtgctgacaattatattaagtagaaatcactcaggctgtctttaaaatttttgacagccattccaaatttttttataatttttttggtctataattgaactcattngaaatttagactgctttgcctctaaa

SEQ ID NO: 31201 - DNA, 554 bp, Heterodera glycines
atgaaaaatggggcaaaaaagtggcaatttggagagagaataacagctcaatcgaccaagcggtgcacatgaatgaacagtaagctgcgatgaaaaacagctgtcacagccaacccgacagcagaaaccggccctccccgcccaaacatggtccgatggggacaaaaagtgcacgtgaatggagacaacatcaaccaatgcatgtgaatgttctaccgcaaatgaaggaagtcacagcgaagaaagaagagaaggaagagaaaaagacagcccatttgatcagcccatttctctaattaattgttttgtatgtaggcccaacccaaatgtgatcgtatttaagccccatgatttgttcatttcagggctccgatcgtgcaccgaataaagagaaaaaacccagcatttgggtattcggtagcccctccccctcgccttcctctcctacccccaccccgaaccatggacgatgaactgtcccgttgcggcttgtgggccgagccgcaacaagtggcgctcctgggtggattttggtggggttttgagggttgtga

SEQ ID NO: 31202 - DNA, 1669 bp, Heterodera glycines
  misc_feature (1596)..(1596): n is a, c, g, or t
  misc_feature (1601)..(1601): n is a, c, g, or t
  misc_feature (1609)..(1609): n is a, c, g, or t
  misc_feature (1633)..(1633): n is a, c, g, or t
  misc_feature (1665)..(1665): n is a, c, g, or t
tttacagtagcgccgctttttctttttttgaaaaggacgaactttcaattcgttttcttttgagcccaaaattgaatcgctttgttcaaagagtttatctttcgtgaggtatgcatgtagttatttaacattattataaagtttggattttaagattttccttattttcatgagcttcacatggcgtgaaatggtacgaaaataaagtatttttggtcctatttctcttttttcctttctttttttagtagactccaaattgtactattttagacagcttaggtcctcaaaattcccagtcctttttacctacaatatgcggggaaataatgcaaattgcacttcttatataccacgcattgaaagaaattttttccatttttccggtgttttttggttcaaaaatgagtatataagccgacttttttgctccctctcagcataatttccgtgtccaaataatgcctttcttctccccctcctccgccgtctttttgctgccctttcaatttcttttggttgtcctcggcactgttttcgtcgtcctcagccaatgctgtggttgttcgaagaaggaaaaggccagttttcaacctccttccccacaacgagcaaaaactgacatttacaccactatttttttcagccgaaaaaacccgaaaagtcgtcgaaaacgcagcagtcaatggcatccaaatcgacgacggcaaaagcagaatgggcgaatgcgcttccgtcagacgttttttcttcaggtgatgccgcattttgtgtgtgtgatgtgtcgagaatttccctccttttttcagaagccaacatggactatgggacattgcggaatttcgatactcaattttttggaggagcatcgccgttgaaaccgcaacgcggcactggaaagaaaggcgagagaccaaaatggacaatttggaaattggaataattgttttttgtttttcaggtccggcgccgcccgtcgttaaaaagccaccgccgtcaaagacaaagccaccggagaaagggaaaaaagtgccgccgcagccaccatgtcggtgttgatcctttgatttgaaattttcatgtgtatagtgactttttgctcccatttcagcgaagaaaaggccccggcaaatgggcaacaaacaaagtgatcaatttaaacgattatgactgaatggcacacacacttttctctttccccatttcagaacagacaaatgccgacaaattcaaggaatttttctcccagagaaggccgtccagttcaattagtaggatgacaaggggagaaattgggcaattaatgcttttaatttccatttcagttggcactcctcaaaaaccaagccccggtctcgtaccatgtaagaactatatcaataatgatcatcacaatcaatttttgacgaattttccccccatttagcaagccatcctgactatggcacacttcacttggtggacaaggatcttttcaccaaggagcagcaggcgaaaggtgggcacatcaggcggagaaaacggcacaaaacactttatccatccctctccattttcagatgccaaacgaacgccaccaaaggctgggcctctatntgttncgagtgangtgagatgcattgaaattggacancaaaataaatggtcctttttcattttcagcgngcga

SEQ ID NO: 31203 - DNA, 1181 bp, Heterodera glycines
aaaaaaaaaaacacacccccccgcggggggggtgttttgttttttttttgtttaaaaaaaaacaaccccccacggggggggggttgttttttttttttttttaaaaaaaaaaaaccaccccccggcggggggtttttttttttttttttttaaaaaaaaacacccccccccggcggggggggttttttttttttttttaaaaaaaaaaaaaccccccccccgggggggtttttttttttttttaaaaaaaaaaaaccccccccggggggggggtttttttttttttttaaaaaaaaaaaaacccccccggggggggggtttttttttttttttcaaaaaaaacacccccccccggggggggggttttttttttttttttgaaaaaaaaagccccccccggggttggggttttttttgttttttaaaaaaaaacaccccccccgggggggggattttttttgtttttttaaaaaaaacgccccacccaggggtgggtttttttttttttttcaaaaaaaacaggtccacccagggctaggagtttttttggattttcagaaaaaacagtccacccagggctaggagtttttttgggttttcagaaaaaacaggtccacccagggctaggagtttttttggattttcagaaaaaaaaacaggtccagccagggctaggagttttcttggattttcagaaaaaacaggtccagccagggctaggagttttattggattttcagaaaaaataggcccagccagggctaggagttttcttggattttcagaaaaaacaggtccagccagggctaggagttttcttggattttcagaaaaaataggcccagccagggctaggagttttcttcgattttcagaaaaaacaggtccagccagggctaggagttttcttggattttcagaaaaaaaaataggtccagccagggctaggagttttcttggatattcagaaaaaacaggtccagccagggctaggagttttattggattttcagaaaaaataggcccagccagggctaggagttttcttcgattttcagaaaaaacaggtccagccagggctaggagttttattggattttcagaaaaaataggcccagccagggctaggagttttcttgggtttacagaaaaaacagtcaagccagggctaggagttttat

SEQ ID NO: 31204 - DNA, 1039 bp, Heterodera glycines
tcccctcgatgttttaagtgataaaatttaggtataactccaccccgagaaatttgaatggacttaaaaaattgtaggaaaaaaatttattgtttatagataagccaacaattaaaattaatgaaaattttcgatgacaagagttataaaaacttgtcttcaaaaatttaagacacaatttctatggactcaaaaatttagtaagaaaaaaaaaataataatttttgcttcgattttgaaagccgacgatttatctgaaataaaatttttgattttatacatattttctattggaattttgaacaaattgctcatattttttaccattaaatacaaatttggatatgaaaaaaaaaaatttttttttgtttgtaagtttttactttattttgtctaaaattttcaaaaattcaatttctaatttttaattatttggattatattcatcatgcaattgatggagccatgccttttccaagtccgtcttgtgctcgtccttaatttgtgcaaattgaatagcgctgttcgcctccttaatgtactgcttggtgtcgttgctgatggtctccaaatcgccagcaatcacatcaggcatttccacatgaccacttttgttcattttgatcaactcattgctggccccgtcgagcacaaccttttgaacagaaaattaattatgtaattaataattgtaaaattatgagtaggatggaaattttattcaacaaaaattaccaaatattttgagaaaaaatatttaaataaaaaaatttaaaaaaaaatttatgtaaaattttttgtatcaattttttagacaataaaatcgtaaaaagtaataggaaaaaatgtcacaaaaactaaaatgaaggcctaaaaatatattttttttgtatttaaaaaatgattttcaaaaaaatttctacagtcataatttaaaattaaaaaggaaaaaatgaagagtttaggtaacatattacggtcaaatttttaaaattacttgttttaacgctaattaaaaaatcagtaattaaaaatcgct

SEQ ID NO: 31205 - DNA, 1540 bp, Heterodera glycines
tgcaaaaattctagaaattttttgacctcttccgtgaatttggcccctgttttatttattcattgctcgtctcttcaccacctgcaacgcgtcgattggttggttctgctgctggtagagaacgccgatgctgcgccaaatgttcgcgtccgactcgtcgctgtctatcgccgttcgataagagacgaaggcgttttgtgccgcttggtcctgtcaaatataaatcaccaaatgatgccgtcctccgcttcccctgccccgcccccttacggcgttgtatcgcggctgctgctgctgcccattcgccgcgttcggctgttgctgctcctctgcgcctttcttcgccaattcccgcctctgttcgctgtagcaaaggcccaagtagcaatttgctttgctatctgacgaattaaaatcacaaatattttcttaatcattcgttttgatagtaaaatgctccgactcgtcggggagagttcgcgcgctttgcacaataatttctccgcgtcctttagcttttggtattggtgctccttcggttcgcgctcgcgagtgcaaaggcttatccaacctgaaaataagaaaaaaccgaaatggaaagtttcaaattgagaaacaaaacgcaactaccaagtcttgaatatattgcggccagaagatggttgctgaacttaacaacggtgctttcgtcaattaatttccggtattcctgaaagaattttcaaaataattataatacatttcgatgcagaaatttaagtccaaattatcaagattaaattttcaatattacttctactgcctttcggacgtcacccgctatatctgaggacaaaataaattattatttttttaattaataaaaatcagcaaaacaaccgaaacaatgcgcaatttgaaagcggagaaaatgtttgggaaaagcgcactcctcttggccctcttcaaaggcaattgtcaggtgttttaatgccaacggaatgttgtcgacggatttgaatgaaaggcctaaaaggcaacatccgtttgagcagtggccacttaagcggggcttccccccccccccccgcccaccgacccaatcggacatgcacatcagagaggacggagttggcagtgtacggatgcgaaaaaagtaattggcagaaaagatcgatgacactgaaaagagtacaaatgcaatacaaatgggaaattggcaacactttctgtggcctctggtttgtgttgtgtattcataaaatacatatttagtagcaaaataacataggttttccgggataatccgtggtttggtatagtaattctgttttgtttactcaattaatgctaatgtaaaagaaccatttattcatgaaacctcgaaaattttagggaaaaatcaattgcaatcggaattccgaaagctgatgtttttgaatttggattggtttaattattttaccatgtaaatttgaaccaataggtaaaattaaaacgaaaaaaaattttgttgggttgagggagaaagggaaaggacgccaaatgaagagggcatatg

SEQ ID NO: 31206 - DNA, 861 bp, Heterodera glycines
  misc_feature (23)..(23): n is a, c, g, or t
  misc_feature (140)..(140): n is a, c, g, or t
  misc_feature (313)..(313): n is a, c, g, or t
  misc_feature (348)..(348): n is a, c, g, or t
  misc_feature (365)..(365): n is a, c, g, or t
  misc_feature (376)..(376): n is a, c, g, or t
  misc_feature (491)..(491): n is a, c, g, or t
taaaatgaatggctaattattantttaatatcaaaactttcagtttctatttatcatttaaattccagaaataataaataaatcaatttttatttttcaatgaaaatttgtatttaggagggaaattcattttcaccttnttcgctcggctgttcgcgataacaaaaataaattaacgatgatgcaaaaatttaatgattgattgtaaaaaggatgcattttccaattaaaatgaataaaattccaaatattttaaaagcgtataatgcaaattaactaattgttttcaactaatattaataaataacatttntttgtcttatgaaaaatttgggtggctaggtcgtnttcttaaaaaccgccanctatgggcgtnttcttaaaccagccaagggataggaaaacaaaaaatgtaagatatacaaattcataacttggcttaaattcaatttaattattcttcgtatcattcaatagctctaggtgttctnctatcagaatattaatttttatggtcacaaaattttaaaaaatcttgagtcagaattttttggccataacatttttgaaactcaatgaaattttttgaaattttaaagattaatagagaattcttaggtctattcattatataaattaatttaggctcaattccattttaaggactttagaattttaaatgtttataaataaatatgcatgaccatggcaaaaaacatagcatgttcaatgctttataacttttttcagaagcaattagattaaattttatatatttatcttgaaaattttaaaaaatttcattgagtttcaaaaaagttatggccaaaaaattcagacacaagattttttaaaattttg

SEQ ID NO: 31207 - DNA, 424 bp, Heterodera glycines
gcagcttataaccagcccggcgtatcagacgtacataccgacggacggcaccgatgaacagttcctgttattccgattcggtattgaagggcatgaatgtggcttttgtttttatggtgccgatggagaaatgaagcgcgttcacaagaataagaagaatttgccgttattgttgatgtacgccttgtcaaaagacaaaaaattggacgtgtatctttgtgattagccatttgctaacttttattagggttttatcaaatattagcgttaataaattgttgaaaattaaaaaaatatttttttttgtggcgcaaatgtcgatttggctgggcggcgcaagtgtcagcggcgcaaaagtcacggcgcaagtgtctgcggcgcaaatgtcgatttggctgggcagcgcaagtgtcgcggcgcaagt

SEQ ID NO: 31208 - DNA, 1386 bp, Heterodera glycines
aaattttaaattacaattatcaattattgagacatttaaaaaaatttaaaaaatatttattaattaataattttttaaattttaattggtaaaattaatgggcttgttgggcttgttttttgtgatttaactccatttattgaaaattgttaatattattcaaatcatttattttgcgaggaatttttcattcttaatatttttcaagaaataaaatattattcaattaaaatcactaaattgtaaaacctttttaatatatttaaattataaatttgtggggtttttttttcaccttcgctccactcatttctgagcctgtttatgataattctccgtttatgccataaataagtgcgtgtgacgaaaaaacagcacaaaaaactgatggcaccgccggccaaaaaaaggaactgaaaattcaaacaaattaattttttaaattgcaaaaagtgccaaaccgtcgcggcaataaccgactcaaactcggcaccaagcgaagtcagacgcatggcaaaagccaaaaaacaaaacaaattaactaattgagcaattaacacaataattattagggcagcataaatataaacaaatccaataaatctgaaaaaaattttaataaggcgagatatggaaaagattttattaattaaattggtaaagatataaaaatttggaatttgtgctaaatcattttaaataatttaatcatttaaaatgactgatgagagaagagacgaaaattaattaaatgttaatgatttaaattaaaataaaataaatattggattttcatcttcaatttataaagatagttttataaaattattttaaataatttttataaagttgtttactcttttttggagtagtaaaagtttaagtgggattaaaattcactctttcgtccccattccaccgcttgttgccgctttttgctcttcaatgcattttgtcagcagcagaaattgatcggccgaacgccgccggcgctaaaatccgtccgaaaagccctcgggaaaaatggaaaagagagagcaaagagaggagcatcgttcggcggagggccaatgctcgtcgatccgccaaatttcgattttttgccttgaagcaatctgtgacgcaaaagccgggccaactgatgacgccgggggggggatttgggcaagtggctgcacttcgtttgtgcgccatcccaaaagccgaattttagggtaacaatttttaattgggtaattagtgatgcacgagagtctcggaattaacaaacaattctccattcgagaattttggtggtttttagggtgcttaggtctcgattttattcttggaaaatcgcttatatattagcaatggcgtctgaatttgacgtaaagaattcgaatg

SEQ ID NO: 31209 - DNA, 756 bp, Heterodera glycines
tttttcgtgattatcattttaatttcaatttaacaattttttatttatccaattaaaaaataaaaatcaaattttcgactatatcattttttactcgtcggaaatcattgaattatcgctaaattaacatattcgaccaaatatgtgaagcaaaaagcaaaaacaattttttcccattaacttatttattatgcacaatgggaattaatttcatttgctttactaatttttattccatttttatttgaatattattttttacgaatttttattattactaattttaaaaaattctcaaattttacgccatttataattttaaacaaatttataggaggaaagattttaacggcactacttttgccagattaacagtttattgtcagattgaccgatgggattgaagaatggagcttggaacattcttttttgctgtttattttttcagcttttaggccaatgctttggtaaaaataataattatttttatgagaaaatttatataattttaaattcaatagttcaaaaattttatatataaaaatattaaattggaattttctatttttacccacatcaatcattttttagtccttaaaaatgatgaatataataattttatttaaaaagaaaattattttttaagcatacagagaattgaaatggaaagttggccgtgctcaggcacagacaaacagtaaaaaattagaagtcaaaactgggaaatgcgcgtttgaacagtatttttgctgatga

SEQ ID NO: 31210 - DNA, 975 bp, Heterodera glycines
  misc_feature (28)..(28): n is a, c, g, or t
gtaattaaaaaaatcggctttatggtcncaattacggcataaacgttttccaggtgtccgtgattcgttacgaagcgccaattctttttcataatgccaaacatttcaaatactctgtattggaagcagctcgtcaaattaaagggtaattattatataattattaaatttattatgttaatttaaatattcagccaattgttgggcattggcattggcactcggacgggcagtatgaaaagcatgaaaagcacaaatgccggtgaaaagtttagaaaaataaatgctaatttagtcaacaaaacctttaaaataaatttgatgcttttcaatttcattaatttagttttgttcaacttattctttatttgcttaattaaggtaatgttggctccggcgcaggtccttcagctccaacaaacaaggattcaattcaaatgaaatcaacactgttgatcagcggcgacattgtggtaaagttttaagtcgattttaaaaattattttatataaaattcattaaaatatacattcatataacttatatacaaatttcacttaaaatatttttttgactcttaagtagggactccatttttttcggggtttttgtgcctaaggtgcctactttcggatttttgaaaaaatccttaacaaaaatgcaataaaaacgcaaaatacacccctaagaaatggcccgaaaaaattttcaaaaaatatacccctaagaattgaaaatttttccaaaaattgatccacaaaatttattatttttcttaacaaaattttttgatttaaaaatttattcttttcggaaaaaaaactttcaaatatttattaatttcatttacatttggaaatttttagtgttttgctacataaaaagcgttaataaaaaactttatttgcctatttgaggatttttgtgcctatttagtgcctattttgcgatttttctgcctaaaaatggagtccc

SEQ ID NO: 31211 - DNA, 1494 bp, Heterodera glycines
  misc_feature (254)..(254): n is a, c, g, or t
  misc_feature (342)..(342): n is a, c, g, or t
  misc_feature (349)..(349): n is a, c, g, or t
  misc_feature (384)..(384): n is a, c, g, or t
ttattttatgactgccaaattaacattatatctaaccttcaccagacaaaacccttaaatcaaaatacacaatgttaactgttttttttttaatttatatttttatatacacattttttgtttggaatgaaattttattatcaaattttaaccaatgtttaaatttaacgtttaattagatcatttatccgccgggatatttggtatatctcgtttgcctcgccttccaaaaataatggcaacagcctaacganatcgggtgggtaaacagatctgtggcaaccaattaaactctcacataaatttataaaactcgtcattttcaatagaagaatttcatgnttataantgataaatacttttatattttgctcttttttattnaaatttattttttaaacttaaaaattatattttttttcatccaaagtttgtgtccgacgtttaaaaattttttaaaacttaaatcaggaaatttatcctttttatttttcttttttgaagaaaatccaaaactttttttttggtttttaaatttttgaaaaaaaatttaaaaaataatattttttttttttttttccaaaaaaaacaaaaaattttttacaatttcggtaaatttttgaactaaaccccccttttagaaaaaaaaatatttctctttcctctccacaaaatattcccttttttattaaaaaaaatttatttttttttgggaacaccccttgtgggggcgcttgttttttaaaaagggggggcgaacaaaaaccccctccaaaagaagggggggggagaacaaaattttttttttgttttttttttggtttttccccccccttttaaaaaaaaaaaagaaacaaaaaatataaatataaaaataattttttctgttcttataaaaaaatggtggcgcgcgggagaaaagagggggaataatatttttttgttgggggaaaaaatatttttttttttttttttttttattttattttgttaagaaaaaaaatttttttttttcctctcccaaaaaaaaaaaaaaaaggggggggggggggcaaaaaaaaaaaaaaaaaaaaagaagggggggggggtttataaaaaaaaaaaaaaacccctcccgcgggggagaggaaggggggggggttttttttttttttattttttggggggggggggggggggggggggaaaaaaaaaaaaaaaaaaaaaaaaaaaaaaaatttttttttttttttttttttttctttttccccttccccttatgagtagggggggggggggaggggggagggaaaaaaaaaaaacacaccccccccccccccccccccccccccccccccccccccccaaaaaaaaaaaaaaaaaaaaaaaaaaaaaaaaaaaaagaagggggggggggggggggggggggggggggggggggcgcccccccccacccccccccaccccaccccccccccacaaacaacctttttttttttttttattttttttttt

SEQ ID NO: 31212 - DNA, 1540 bp, Heterodera glycines
  misc_feature (1486)..(1486): n is a, c, g, or t
tggtttggtgttattttagggtttgataatttcagcaagcccacactccgttagcatttaaaactcccatattcgtgtttacttcctctgccattttatttaaggcccttgtgtttgcatatgcccttcgatttacaattctaaatgatctatttacagattcctctaggcgtagaacttctatgtgggctctttccaaatcgggaacctttaccgacgttttaccattccaaaaatttcggtcaatgattgttatgtttatttcttcatccctctcttgactggtggccctagagccagtcttttttgagtgtgacataagccacgaaaatgtgcactgattgctgtgttgaaataagtgaggggatatttgggaatgatttgaatatatgcttggctaaacaaagaaattttatgctataaatatttgaattttggtcatcattttaagcttaagcaatataagaaattgttgtcgggagtgataatgatttctttgcttttcctcgatgcttttaaatattgccaaataaaaagaattttcttagtttccgttcgcttttgatgggaaattacataatgtttccatagtcaattgacgattgaacgcggtgataagcatcattccattaagatgcaagcagctgactgtaaaagcaattagcagcatcggcggtaatggccggaaggggtcaaagtgaatgaacatcgtgtgaaacgaaagattagtttaaagtgaaattcgaattaaagttatttgtaaataacgttttagttgaaatttaatttttatttattttatttttgcattaaatgttaatttgcgtagtttttctttctttttcttgactgttctccccagggagtaattttgcattaatttccaattttatgctttacaataccaataattgagggtttatttttaaatgaaattttatgataaaccttattatctcagaagctatttaattgattcggatgtttttatcgcggttaattagagcaccgaaaattggtttgaatcgtgaagtttatcatttctaactcacttctcaaaattgttgataaattgcaaacatatttttccaaaagtctgttgacactttctgaaaataaattctatactcatgtattttccacttattagattttgcaggcttattgctgcatgttagttgacacttcttcaaaataacctatgccctttattcgttcaaaacaccatctttgttgtttcgctttggattgataagcccgatgataaatagctcgagcgcaaaacgcgtgcatgtttggaaagtatcgttcataccaataattgagggtttatttttaaatgaaattttatgataaaccttattatctcagaagctatttaattgattcggatgtttttatcgcggttaattagagcaccaaaaattggtttgaatcgtgaagattatcatttctaactcacttctcaaaattgttgataaattgncaatatatttttccaaagtctgttgacactttctgaaagtaatctatactcatg

SEQ ID NO: 31213 - DNA, 1060 bp, Heterodera glycines
tagaagaggcaaaacagtgatagaagaggtacaacagtgattaaaagaggtaaaacagtgatcaaaagaggtacaacagtgatcagaagagctacaactgtgatttgaagaggtacaacagtgatagaagaggcaaaacagtgatagaagaggtataacagtgatagaagaggcaaaacagtgatcaaaagaggtacaacagtgatcagaagaggtacaacataaattcaaattaaaaattgtatgaattataaatttattaaattaaaaataaatcctccatttattaattgaaaataacgttgaaaattaataattgaatatttaataaatttaagatgaaatttacaaattcaaaaaaataaataattaaattctttaatgtaaaaatttttttttaaataatctacaacaaatcttaagattagttaaaaacattgaaaatgacgtaaaaaggcatataaaataatttacaccggccggattcgaacctgccgccccccccccccagaagatgactcagaatccccaatcacacagggattctgagggcttaacgatgtcaaaagtaaaatctgatcacgtattcgtgatcagcggcccaaataacccctaaagacatgtttttggaagatttttgtcgaaaaaaatttttcactcagaaatcatggtcacccccctttggtcccgaatgccaaaatcacttttatttctataaattttttcaaaaaagtgataataagctaaattaaaatttataaaatagagcaaaaaattgcggatttttgtagtattttacttttcccgaatagcttttcagaaggcagttacgaatttttttctgaaaattcgaatttttccatgaaattctggaataacttttttcgttttttagatagaaattccaaataaagtccataaaattctcctagatttttcctctatttttaaggctttattcctgtaaaattgatcaacccttcgatttgttatgaattttcataatattaggcctaaaaaaacgaggccaaaaaattgccaaaaaataaagaattttaaa

SEQ ID NO: 31214 - DNA, 1286 bp, Heterodera glycines
gggggtcgcaaattttgaaaattttcttaacaaattcattaaaaatccaaaaaattttccccggcggcgcctggcggcaccgccagaacccaaaaatcccaatttttcttaaaaaagtggcttaaaatcgcaaaaataggccattttttggtgaaaatctgttaacaaatcgcattaaaaattacaaaaaaaaattttcctggcggcgcctatcggcaccgccggccccctgtttccaaaattttgaaaaaaccgcaccgaaaaaaaactgttttttgaaaaaccaagcaaaaaaaaagtcttttgcggccgatcccccttcgcaaaaattttggccgacccaccccccttttttatttatttttggtacataaaatcgctacgtaagaatattaatttaaatttaaatttattttatttattcgtatttattatttaaaataattttaaaatgttgtattcttgatttcattttttaattaagttaaaaaaactattttttaaatttattgactattttttgttgttgctttttttgttattttaatttaaaatgttatttttattgatttctaattttttttttggtatttaatttttttttttttttgtaaaattcgcaatctctgccccaccgagttaggaattgcgatgccttgaggccaatgtccggtcagtgccgtccaaaccgattctcggggcaatgaatcgtccccatttgctcgctgattacaacagttgacaagctgacgaaacagaatgagcagatcacggaaggatgacagaaagggatgatgactgatctaaaaagcgcacaccaaaataaaataatataaaatttcgtttttaattttcagcaattttcttaataaatcacattaaaatttccaaaatttttccggcaacggcttaatggcaccacgggacccccagtttaccatagtttttgtaaatttgtccgcaaaatggctaaaatcaattatttttggcgaaaaatggctacaaaattaaaaattccattttttatatcgatcctacaataataaatatttttatgcgattttttaaccccataaattaaaccacctaaggtgcaatacaagttctctaaatctagactaaaattggtaccgaaaagaaggaagttatgaatttttcaaaaaaaggtattaaaaaacaaacaatgaggcaagcccatttaaaaatgaaataaaaattaatttattatctattttttttaccaagcaaagtgaaattaacgaagccgaactgcttgtgtttgcatg

SEQ ID NO: 31215 - DNA, 1139 bp, Heterodera glycines
ttttagtttaaaatatatttgaatacttttttatccctcccctgttttttattaatacagaattttttgaaatttcctaaaatccgcaatcctgcgcaggatcctgcagattttaaatgcaggatttgcaggattaatcctgccggatcctgtcctgtaaaaaattttgaattccaatcctgcaacaggacccgcaaatttgatttttatgcaggattcagcaggatcctgcattgattttttgaaaatttaaaaaaaaagaatgccaaatatcagaaactttcttttttcaaaaatttttttctaataaaaatttttcgtttaaaaacttatccttattcgaaaaaagtttatacaattgaattttttatgtgttttgctacctaaaaagcgttaataaaaaatttttttttactatttttgtgcctattttaggatttttctgcctttttaagtgcctatttcgcgattttttgtgcctaaaaatcccatccctatacataatggattatgacttttttgcaaaggaatttaaataaaaattattttactttaatttaagctattattatgagccacccaatttggcaaatcggtctttttaaacgcattaaaaaagaatcagtcgattgcttggagtgtaagcaaaaaaacgttattaatttttcatcttcatcattttttagtttaaaaatatatttgaatacttttttatactttgaaagacttttttattaatacagaattttttgaaatttcctaaaatccgcaatcctgcgcaggatcctgcagattttaaatgcaggatttgcaggattaatcctgccggatcctgtcctgtaaaaaattttgaattccaatcctgcaacaggacccgcaaatttgatttttattcaggattcagcaggatcctgcattgattctttgaaaattttaaaaaaaagaatgccaaatattcagaaactttcttttttcaaaaatttttttctaataaaaatttttcgtttaaaaacttatccttattcgaaaaaagtttatacaattaaattttttatgtgttttgctacctaaaaagcgttaataaaaaattttttaaaagtatttttgtgcctattttaggatttttctgcctttttaag

SEQ ID NO: 31216 - DNA, 1911 bp, Heterodera glycines
  misc_feature (15)..(15): n is a, c, g, or t
  misc_feature (1753)..(1753): n is a, c, g, or t
  misc_feature (1830)..(1830): n is a, c, g, or t
  misc_feature (1844)..(1844): n is a, c, g, or t
ttataattttaaaancggagcatacattaatttttattagcatattttttggtcggctttcgcttggacttaatttgttttatcattgtcattagtcattcattaccttgtttagtagatgaattatttgccttttcaccacctgttaggaaaataattatgaattttaaagataaaaacttttacaattccttaaatattcaagtaaatttttattaaagattccgaaggtaaagcacatatgattttttgataagaaatttttgtaaacagaaaatgatcactcaatttctcaaataaaactgaaattaaaaatttttgccaacatatttatcaaaatattgaaaaaaatagaaatatgtatcctaatatttaaaaatcccgttcttgtcattattaccttgtttttttctgtgtcgtagaagatgacttgttttttacgctttcaccacctgctgcattaccatttgttgcttaaataatattttaaaacatttatttgaatgcgtattttttgttttaaatatttttaattttttggcaaaaattatttttatttatcgtttaaaataatttttggcaaaaaactaacgcattccgttgactgaaaaaagttcaaatgggaggcaatggccaacaccaacagaaagatggctgttgaagagaatcgcatttttacaaatgggatttgggttccttttctgacctaaaagaaatttcgaatattttttatgatattagaaaataagaattttcatagtcaaatataaatttatgggccatttatttttgaatttggaaatttggtttcgtccgcctggtgtcatgacaattcgtataatgttgtgcaaaggcagctcgtagaattgcttaggttagacctaggctttagtcttaagcttaagcttaaacttggctttattttgtaacatacgaattgccttttctacgagttgccattgactcgtccgcctttcttcgttcactaataaatgggttcccaactgaattttccaaaagcttcatttgactgacaaaaagttgcatctgaaactttatcccagatataaaaaccaataaaaaaaaatttttttttttcattgcctatgttcaatttctcagccttttgtttgtcagaaacaaacacttaataaaattccgagcaagaaaaacagggaaaatgttggaattttatgaaatttttacagatttgtccaaaaagtaattttgagagatttttttgatatcagataatgcaattttatggggcagaaaggtcctgttttttcagagttgtcctgaattggcatatgatcgcaaacattaaatgtccttatttttttgtttagtcctaaccaaagaaatcaaatgaaagatgaaaatatatttttattttttagattcgtcctctgaattggaatgacgatttgaataatcgaaaatgtcctgatatatcagaggtgtcctgaaatgcacaaatgatccgaaacattaatatgtccttattttttgtgtcttggattctgttcatagtaatatttttttcgaaaaataattatggcaaattagtgaatattgcgtctttttcatagtcaagagatttgatccatagacaaagttttttatgataaaatttttataaaaatttcactttaatacaaaatttatatcccaattgttacaaaataaagtcgtccaatttccggcttttcaattttggctcattttcacattctccccataattattattnggcaagtccaatggccttgtcacatttcgcgctgcatttgctgcacggttcgcccgcttcataaaccggcgcgccanagtaattaccactnaaagggtaattaaaatatatttaaattgaaaacattttttgttaatgtggcttacgctgcgtaatac

SEQ ID NO: 31217 - DNA, 1059 bp, Heterodera glycines
attaccgtattatctctaattatcgccccgtctccatttaaccccccccccctttctgaggaggttgaacaataatcctcccaggcccgtaccaaaagaacgaggtaatgttaaaatttgcctttttgaggccaaaaaccggaaaattttacaaaaaaatcattttttcgccaaattttctcgagaatattgaataaatttaaattttcttagaaattaataaatttatgtcaaatataagcaaaaaagcgaaaaaatttcgcttttcgggttgatttttcaataaaaatgagtaaattttagctttatcgtgttttttcttctaaaatgatttttaataccatatttagccatttttgaaggttttactttaaatttaacaagtttaaagaaattttgggaaattataccctcaatttggaaaaatttatgtccatatttcgcgatctttggtccatattttatggccatattttgcgattttatatccatataattccccgcccaagtatttgcggataggcaggataaaatgaacaaaatgaaaaactcataacaaaatgttttagttccaagtataaaaaaaaatgttagttaggcattgcttttttcaaaagcctaaattaacatggaatttatttagaataaactttgaaccgatggatcccataccgtccccggtgatatcgtcagtggttgatttcgtcagtgagtgatttcgtcagtaagtgatttcgtcagtagttgatttcgtcagtgagaaataatttttaaaaaaaatttacctatcaaatattaaaaatgaattcaaaaatgcaagtgatatgaacatgctcgtaaatactctaacggatcacgattatcgaaattttccacaagagtcatcaaattgttgtcctgccgaacccattttgcccttctcttttcatgaggtcctctaattcattgcgaagccgttcattggcttgtctgacctatacccaggaaaatccatttcgaacaaattaaaatcccggatccgaacccagggacggtcccaggatttggtttggggggggg

SEQ ID NO: 31218 - DNA, 1201 bp, Heterodera glycines
ttgctgatgatcagataaatcaaatccactgatcaaatccgctgtgccattgtttccacggatcattcaagcatatatttgcgattgatcaggcctatattttaaaaaattgataatttttgctcaatttttgacaattatgcctgccaatgacgaattcagtgtgtagcgtaagccgaaaagttcggtccaatgaatttttcatcaaatttctgaacattttaaacttcttagacctcagaaaaaccgtggtcatcaaaaaatctttctattgtgatcatgaaatatattaattttttgttgccaacctttggtccaacttactaaccaccaaaagcagccttttggcttttcataaatgccatggcctcaaaaacactcaattcgcccccccccatcccgccgtttttgttggtgacattctcccattttgcttgatcacttttttaatcaaaaaagggacaaaaattgtttttttggcataatgtcacaatttttcgttcttttaccgttcacatttcgttcacaatttttcccctctctttcttttttttttttgtcctcctccgccgtccatccgcccaatttttcgtgtcgtaaaatttgcaaaaattggtgctgggagagtggggggagcgggggatgagagagtggtggattagtggatggtggaaaatggaaaagaaaggagagaaaattgagagagacagaagaggagagagagagagagaggagagagatacagagaggggagagagaggaagggggagagaggaaagatagagagaggacagagagagagagagagaggagagagagcggggggggaggttaaaacaaaatagtgcatgtgtttgtcatggaggcggagagagtgagtgaggaagtgaacagggctcgtgggaccaaaggctccctcccccgggggtgggagggggacgtgaaaatgttgtttacgtgctcggggacggacagtcctttcctcttcctctttttgtcccagcagtgtttctatttgttcatgggtttctttccttccctctcttactctctttttcctgccttccttttttccaactcttcctcttcatccattctttttcaccctcctcttcgcgttctctctctctctctctccctttctttctttctctaggagatatgttcagggatggcagatgaaaattttcaaaagcctcat

SEQ ID NO: 31219 - DNA, 902 bp, Heterodera glycines
ctaaaattaagaattcacaatacaagtcgaccccgctcttacctagggtatatagcttatatgcattttcccactcacagctctgaatgttcccttgttaacgtaggtaaattagaaattaaaaatgtgccaattcggtatgccaacgacggaaacactaacccaaataggtgggccgtaggcatttgataatgtcctcctcgaccccgccggcactggtcaccacacagtccacctggtcatgctccagcaaatagcgaaatgtctaatggaaatttgttatttaacaaaaagccatggcaaaaagatggcactaacctccctaagtccagaagtgaccaaattggaggtgtacccgaggaaaatggttagcctacgccgacggcgccgattcggttgcgggtagtcgaaaaaggggtcaacaccaggctcaaattggacggggacggaacgctcctcaatcatcgcgttgatttcctgacaaaaagtttcattaaaattatatagataaacaagcacccaaaaatgatgcattggatggggaaaaggaaggaagggggcttgagagttgaatcaacggctcttttttttttgctataacaatacgtgtttaaatggaaatgattgttgctgaaaatgtacctggatggcgatgcccatgtggctggcctggaagccggtggtcaaaaaggaatccaacaacgcctcccattgaatgccggcgttgaaatcatagccaacgatgaccggacgctgctcatagtcgtgcaactgttgttgctgctgctgatccgaattgaccaacaccgcctgacggcacagtgccaactcagcgggacagggcacaaccgaagatgctgcaaaaggacaccggaatattaatcgtataaactcattgagaa

SEQ ID NO: 31220 - DNA, 971 bp, Heterodera glycines
agttaatttttttgtgctgaactgtgtttgggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcatgtggggcgacccggaacattttagacagtttccaaaccaaacactcatagt

SEQ ID NO: 31221 - DNA, 915 bp, Heterodera glycines
ttggacttttcgaccttttgctgaaatttctacaattagttaataaataattaatacaaaattagttttaatttgtggcgttttgcccacctcgccgccgttgtgacgtgcccactcgcgcgggttcagcgtgttcaccactccgtttttgtacagccacgcgccgcgcagcatgtttttgcctccacggagcacagcggggacataaaaaataattaagtgatagtaattaatcataaaaggctttgttaatttacgggttggccttgcaataagccgacaagccaaaggagaaagtcttggacttcggccggaagacgcgcaattggaacaacactgtgaaaacaaacaaatcgaattaggaaattaattatttaaaaatcaaaaaatattttttgcccttctatttttacacaaggttcgcgtccagcccaaccacataacgtttcttcgggaaatgagcagtggccgcgtggaaatagctgcaaaatgcgattaaattctaacataaaaaacataaaataattttttaatctttgccaagggactcacacgtccgtcacccattcgacgtgcggtgagttggccggcgaggccaaatggtcgtgcgcaatttgcttaacttaagttgaaaattttgtaatcgtgtccaatccaaatttaaatgcttcgcaaatgctaacttttttgcagaaattcctccccatactgttcccgaatgtgtgccggcgcctgtctgtatgtcttttcgaaactcgacggcacattttccggcgtggtcatcggcgttcggaaatagcccggctcaacgatcgccacgtgcacaccgaagggggccaactctcggctaaaagtgccgaaatttttaaataatttccatttattcgctttaaaaggaatttcaaactgagtgag

SEQ ID NO: 31222 - DNA, 936 bp, Heterodera glycines
taaaaataatacaaaattaattttttaagtaaagaaacttttcgaattcgggttcgggattcgaaaaatggatgtttggaacatatccgaccaatttcagtcgtaaacaggcactcacgcgaaaacgtaccccacgcgaaaacggccacgcgaaaacgtcctggcccccatagcgtgggtttcgcagaaaattaattttcagatccctctttgagattgggagttcaattcccgtggtattaatcccgcaaaaatcccgcgcgctgtctatgttttttctatggatagatagtattttattagaaaagtttttctccatgtaattttcaattataatgatttgtaacataaaaatactacttacaattagttagatttgaaagccattgttttctctatttgcttgcaatatttcaaaaaaaaaaattcgttacttttcaataatgaaatcttgcaggttaatggagaaaagaatgtttgattatttttgtcagagagcagctgcggaatggctgacgaatttgccaagccgaaatttgacggcaaaatcttccaaaaccccgacagcttcacaacatggaaaaacccgccttcggcaggggacccgagaagttggcgggacttcattaaatggaaatgggatgcaaagagcacgaaactgcccaatttgaaagtatgtttaaaaacttcgttttttgtcactaattgtaaactgcaagaatgccgcatttcccatttaggtgcttgaccagactttgccggtgttaaagcctcggttccaaacggattctcggctttcggccacttggctcggccatgccacactttttgtgcgcattgacggcatttcagtgctcacagacccagtgagttggaaacaataatagacaaagacatctttttgaggactttaggtaaaaaatatttttcattcca

SEQ ID NO: 31223 - DNA, 1159 bp, Heterodera glycines
  misc_feature (25)..(25): n is a, c, g, or t
cattggaattcttttataaaataanaataatataataaataaaataaattaattttatttgtttacagtttagaacaacaacaatcgtgttcattatggcaaaattaattttgttggcgttggcctttctgagcatgtttggcattgtttgtagtttggaagaaccgtaaaattttctaaaataaaaaatcctataaattttaaaaataatttaaaattgaaattaaatatttactaaaatcttagtttaatttaaattattgccaaaaattggattatccataatttaattggccataattttagtcgagatctaaatgtgttcaaatttcaaaccgctttaaatgccaatgttataatttttggaatttttaattttaaaaatttatttttatttttttagctccgtttgctgtgaccagtgcggcaaagagtttttggaatgccaaagcacgtgcaaactggagcatcgggcaggcaatgtggaatgtccagagtactgcaatttcgtgttggaagactgctcgcgcgataagtgtcgtaagccatgcccacgtcccagagataaacactgaaaaaagagtcatcgagaaaaatgaattcgatgggaaaagcgatggatggaaaattgtgataaaatccatgaaagaattaaacaaaatttacataaattttatatactaatattattgtattttgcaaattgattttaaagaatttaaagagtaaaaatccaactcatactaggcaatctcgtactattttatgacaaaaaaaaaaacaaagtcgtccaaattaaacattcttggcatattccatatcccttaagattttctatctatactcagacttcaagaaaattttattggttttcaaaaaaaccaaaaatcgaaaaaaaaagattctttttttttcgtcaataattttttaaacttcatcaatcagttttttagtttgcaaagaaatagagaagcttaatgttaaatttggttgacttaagcaaaaattatgaccatttttttgcctacaaacagcatttttaaagatgaattgtcacattttaagcgacaaataaaatttaattaggttaattattagggatgcgatttttaggcaagaaggtaaaatttcagcgcacttaatagcaaagtgcaataaa

SEQ ID NO: 31224 - DNA, 1254 bp, Heterodera glycines
  misc_feature (1229)..(1229): n is a, c, g, or t
gcaattttaggtaacttttgcgctttgaaaatcatcctttcaaaaagaaaatcatccttacctctcgaaatcatcaaaatgatgataaatcatcactagggctgtcaattttatgtaaatacatttttttcctggattctccatgctctaattggtagaaaaacactttcttttttgtgtttgcgaacaaaaatcgggacttttatttacatatttttacatatttcgggcttttatacatatttggtacatattttggactttttcttacataatttcattttttttacatattttgaggattttttacggaaattttggaaatattcaaaaaaaaacattctcaatttcggcaaattttttgtttattttacatattttgagtagagtgcagcgggaccgggaattttgggcaaaaccgggaccggaacttgccgggacctgagaagccgggaccggtaccgggacctcggttttttttcgggaccgggaaccgggaccaaccgggaatttttaaaaattcaaaaaattttaaaaaatttaaaaaattcaaattttaattttttttcaactgaaaataatacaaaattaaatttttattttgtttttttatttaataaaatccaaaagttaaagctaattaaattaatgaaaattttgaaatcaaattttcatcaattatttcaagcaattaatcatttttgactcaaatgatcgaatattatgtgaaattcagatttgcttttcacatcattttttcggcgcgcttttccaaaaaacttttgtggaagatgggggtccggcggttccgacaggcgccgccgggggaaattttgaaaatttgaatgtgatttgttaacagattttcaacaaaaaaggctggtttttggggttaatatgctcaattcgtacggattttcatttaaaaatgatgaaatatgtgtcaattaaaaaaaactatgaggaatcatattttgtcgatagggaaccaatgaatatacaaaaagaaaattaaaaataatttaatttatgtagaggggtcgaaccaggggaaagaagtaaggaaagtcaacgcgactagccactaggccgtttgtggacgtgtcaactttccttttaaagaatatatttaattattttttcaaaattttcatttcagtccaattttcatctctaattttcactcagacccccattcttaccagtgcttgttttttccgggtcccggntgccctaccgggaccgggacctgag

SEQ ID NO: 31225 - DNA, 916 bp, Heterodera glycines
tctctttgcttcttcttttctcccccccccccccctaacttttggcctcacttaaatgtgattttcttctccatccaatttttgtttgctttttgtgctcttttcgttccaatttccttcttccttccgttcaccaaatggcctcattttgcgctgattcgatgcgcaaacacttttcaaaagtgccgttcgtccgtctgtgccttttcactgtcttttttctttggctgtgcctttatttgcatatttttttgtctaatttcaccaaattttacttcaatttttgatcgttaaccgatttaaacattaattaataaaaatttatttttattctgtattgtgatttcaataatgctttattgtctcttggcacttctcaattgctttttcacatttcttcttgtgccaaatgcatattcggatcgattaccaaagtaaataaaataaaacaaatgtaaattaattttgttttcaatttaatcaatgatagggcaacgggtaaatttgttctgttcaccgactttcacattgacaatcattatgacccgcgaggcgacccgaccaaaatgtgccattggaatgaaacgaatgccacaaatcgaacaatggcaaatgccaacacttcgcccggcccatttgggacacggagttgcgactcgccattggtaagagaaaaaattggaaatgaatttatagttggaattgaatgaatttgagcattttcagtctctcgttaattttatggtgaaagaagcacagaaacaattggaaagccccgattatgtgatttggacgggggacaatgcggcgcacgacgaatacgacgagaaaagtgaaaaggaaaagcagaaataaacattaaaataagaaggaaataaattgcacagggtttttcgacacattggaaagtgccaat

SEQ ID NO: 31226 - DNA, 357 bp, Heterodera glycines
  misc_feature (65)..(65): n is a, c, g, or t
  misc_feature (98)..(98): n is a, c, g, or t
  misc_feature (105)..(105): n is a, c, g, or t
  misc_feature (107)..(107): n is a, c, g, or t
  misc_feature (116)..(116): n is a, c, g, or t
  misc_feature (119)..(119): n is a, c, g, or t
  misc_feature (130)..(130): n is a, c, g, or t
  misc_feature (134)..(134): n is a, c, g, or t
  misc_feature (136)..(136): n is a, c, g, or t
  misc_feature (146)..(146): n is a, c, g, or t
  misc_feature (161)..(161): n is a, c, g, or t
ggggactgctccgaaaacaaaaaaatcgatttttcccttaaagggccccggggcactcaaacaancagggggagcaccttaaaagagcccaccaaagnacaggcnanagggaagcnacncccgaaggagncggncnccccagaaanctgggcgcaacggancggggggacagccccgaaaacaaaaaaaacgagaacggcaagaggccgcaagggggactcaaacaaggacggggagcaaaaaaccaacgcagaaggaaaggacaggccacagggaagccatccccgaaggacccggactccccagaaaaccgggcgcaccggaacggggggactgccccgaaaacaaaaaaaccga

SEQ ID NO: 31227 - DNA, 1121 bp, Heterodera glycines
atggacccgagcaaagggattttacaacaaaaatgaggataaagtgacgctggccattgattttacggtgggagaagaaaaaggaaccaaaaaacgcaaaattgaccgatgaataagccaatccaatcacactcattttctattattttatcattttcaaattttatcaaatcctgaatcttgcttttttcctattattttttatttttcatagaatattttgtgcttctccactgacaatgaccatttcgccttttcaacgataataaatgaaaacaaacattatttaaaccgccggtgttaggtcgaacctcaaacgacacaatggggtgaacctaaaagagataattttaataattttattttagtaaaaattagcttttctaaatggaatcccgcagtgattaatcccgcaaatatgaaagaataaaaaagtggatgatgaataagcccatcgcctaatactggggtcatggcgtgctgagccgaaccgaaaatagtctcataaattttaacattattatatattttaattaaaaaacattgctttaaaataattaaatttaaatatttttattgacactgagactattttcggatcgacctagcaccaggtcacaataccaaactcatgtcatgcttttcacatgttcctcaagtccaaagaatttgttaattataaatttttcttttttatgtggaatgcttccgagtgccgagacgaaaaaatgccagtgtttttaatgagtaattaataaagtttttttcctttttcaatagtctttgtgtggataaagtgggcatttcaacattttttggtcccttgttaaaatcccttacacctaaatccattttccactttttatttatgcaaaataattgtaaccgagcacgatttttcaaagggagccaaggttcagagtacttttttgtggctagctttttcaaaaaactttggcaaatgggagaggaagggcggtccggcggtgccgtttgcgctgcgcgagagatcccgcaaaatcccgcgcgtgatcccgtcccgcaccgggctctaatctacacaatgcataaaaaaaaaaaataaattttgtataaatgcaacttacgatgaaaaataaatg

SEQ ID NO: 31228 - DNA, 1284 bp, Heterodera glycines
tcgatggagaaaaatctagtttgatatagtaataataattgtgtcagtaaattgagtggagtgtacatttctgtctccgttcactgacagagagtcgtgtctttagtgtgtaagttagtcgtcaaacgacttttgtgccgaacaaatggcaatactaagggagatcacgtgcgacatcgtaggctgtctcccgaaggctcttatgttcttcagcacacagacatcttcaatatgatttgatatttctatgtctcagtgtcctcatcatctgcataacatgggataatcacggcagagactgcgccgtgcatactagggatgtgttcaatcgtcagacaccgatagcagcgcgcatatcagcgcgcaggtaatctcggatcaagcttttttctattgtatctggtgtgtgatatgtgtgggataatatgtattcatagtagatctctgtgtcatgatcactcacagattcttgtttgtgtgatctatatatatatatatatatatatatatatatatatatatatatatatatatatatatatatatatatatataagaaaaggcatttatttatattctaaaaatttcttataaagccttgccattaaatttatgtacggtatgtgtcttttcttattacgttcatctttttcatcgaatctttgatctgctatacatatattatttcaacaattttattggcaaaaaaaaatgaaatgaaatttcaaaagcgcaaatctcggcactttttgttcgagttgaaacttcttgtcaagaaaacaaatagataaaattttttgtagacgaattttttgagaaaatttttcatttatcattatggggtgtattttcagaaaatttttgggccgattagaagccctatgaaaacagtgaattgagcgtggaatttggtcaattctcttaaaaagagagggaaaaggaaaggatttttctgcgttcgacaatcttttcgtgaataattcctaaaattttgcctattttatttttaaatctcattaaaaatttcctaaattctcttaaaaagttgactttctttgcgttctctcgcttttccttttgccacagggcggatcggagagcaaaaaatgcatgcctaattaatgagattgattttcgaagtggattaagtgcatttatcgtttcattgatttgaattgatgaaaaataacaaaattttgagtaacagttttaaataagatggatgctttaattatatgttaaaaagggcttcaattcattgatccaatttcgtaagcgcatttt

SEQ ID NO: 31229 - DNA, 2015 bp, Heterodera glycines
gccaagattttaaatttaaaaagcggaaccccaggattttaaaataatttttaaaattggaaaaaaacagaacgccataatttattttgaaaaaaacagaatgccaagaatttaaatatttttaaatgaggaaaagggggaaacaaaatgcaagaaattggcaagaaataaataggaaaatttggcacaaaaatgtgcaaaaatttggcaaggaaataaattagggaaatttggcacaaaaatgtgtaaaaattggcaaaagatagggttaaaaattgtggcaaaataatgccaaaaattggcatgaaataaatagggaaatttggcacaaaaatgtgcaaaaatttggtaagaaataaatagggaaatttggcacaaaaatgtgtaaaaattggcaaaagatagggttaaaaattgtggcaaaataatgccaaaaattggcaagaaataaatagggaaatttggcacaaaaatgtgcaaaaatttggtaagaaataaatagggaaatttggcacaaaaatgtgtaaaaattggcaaaagatagggttaaaaattgtggcaaaataatgccaaaaattggcaagaaataaatagggaaatttggcacaaaaatgtgcaaaaatttggtaagaaataaatagggaaatttggcacaaaaatgtgtaaaaattggcaaaataaagggttaaaaatttgggcaaaacaatgccaaaaattggcaagaaataaattgggaaataagggggcaaaacaatgccaaaaaattgcggcaaaatggcacaaaaaacggtaccataataatgccaatctggcacataaataataaatggcaaaaagtaatgggtaaatgggtaaacaaatgccaaagaaggaaaaaattaaggcataaataaatgataatggattattgattggcttttccttccgtaaagtgaattaaatgaaatgaaaatgaccaaatggacaaaaaatcaattaataaattgtttattgtctgaaggtgtcaaattacataatgggcatgcgggaaggagggcggcaacacaaagtacgcaaccaattaattaatttgtttatttggcaccttttcaacacccccacccctccttaattgatttgtttatttgaccccctccccccttctcgccgcctgctctcgcccccctcccgccgctggtgacgtcaatttttccctttatgagagcaaattaatgtttatcatcaattgccaatgtggccgagtggttagtgcgtcagtctggccgcccccatggggttcggatccgcttggtgcggggaatttttggagaattttaaatgaatttaaattcaacgtctttgatctttaagacgtttaaaataatttaaaattaaataaatttaattaaaataatttgcataaagtcgcgcaccaaaaaaagtcgcgcaccccctgcaataggtttgggtttgcaagaaaaaagtcgcgcaataggtttggctttcaaaaaaagtcgcgcaataggttttggcttcagtactgaaaagtctggcgctcagatggcccgcgctcacttggcggcgctcaaatggctggcgctcagttggccatgcacccctcccacacctatggggggctaccgtaatccggacaaaatggagtgggtaactactcatctgtacataaagtttcggttctggtcctttgtccttgtctattatgattgttctccaaattgttaattcgcttttgccatcgaaatgtttgtccaccaacatccggtggccatgtttcggctatcactatttccgttcacctgcgctttaatttaatatgtgcgatgtcacggcttactcattgacgaaaatcggatactgaagagcgaatccttggcttttttgcggaatttgtttgtcctaacactaacaaaagtacgataaaggtcgttctattaacgaatcaaattagtgtgaactagggttggttgggaccgggaccaaaacacggacaactgagtactgaagtcccgggtttt

SEQ ID NO: 31230 - DNA, 984 bp, Heterodera glycines
tctgaaaatgaccaattaattaatcattttggcaattagccaataaagaaatttagttggaaattgaattttgacacacatttaaattttaaagagtttaaatgaggataataatggcattatctgagcaaaggttgaatcgctttttatttgtccaaattttataaatttatatcattaaaaatctctaaaaaatattcatatgcattttctaaactattaagcaacccataaaaagttaaagcttgaaactgtataacttgcatttttcttatttttatttttaactgttttatttctttgcgagtcattgtgagttttggtcagataatagagcttatgaagagtttttgcagatatcatttgattggcaaacaaataaaaaaaatatgcttctcaaattgcaagactcagttggcccactttaaattaaaataaaattgaaaatgaaaatgatcgctaacctgaacagtgacaaagcgaatgtgatgccgcgaaatcattctgaaaaggaagcaatttgcacgcttttcacttttattaacaatcccaaaaaatgataatgatatttcttaagtgtttttttttgttgaaaatgattttaaaataattattcattttttgagtaatttaaagggttttaatattaaatattattattaattgacatggaattgaggcaaaatgttcacttttgctgtgccattgccactacagaatcggcaaagtatttgtccttgatactcccgccattgaatgccaactcaagatgggcagtagcggcgaaagtgtccgatttcagggaccaaacacgcaaagagtggacaccgatcactccgggcaagccgatcagatcattgtacaacttttggagatcaatctggcggggggttgcttccatctgaaaatttattctgaaatgattttcaattcagttttaaatcacaaatcatttaaaaaacaaaagttcgacatcaataaaca

SEQ ID NO: 31231 - DNA, 1186 bp, Heterodera glycines
atgttgccactctgtcgtgtgcagttctgcttttttcacttggtgaaaagtatgaagaagcgaattgcttccgagggtttaacccaggtattgcattttttattttccaattgaatttttcatattaagacatacaacaacaatgccgtgtttgctgaaaagagcaaaatgatcacctctatggcttttcttcctgtccaccatctccgtgctggcctcaatgttttgcagacacaactccctcaacaacttattggcgtcttcgattggtgagttttttggaatattaaatcaattttttttatcttaaaggttcatggacaattacaccagaaggccgtagttcaatggtggtttgacagtgcttcgcaccggaagaatggagtgtgcatcaacggacgttggatggaggagacagaactaacaattacgcagaagcattccatagaaaacttcaacaggcatttgattgtacccatcctagtgtcttccacttcatcaacacaattcgatgtgagcaaaagtcaattgatgctgacatctcacgatgcgtcgctggtgaactccctcctctaaagaagcccaaatatcgtgccgccgatgcgagaattcttcgacttttgcagggatacaataccatcaacaataacccggctaaccaaaatgaccacaattacaatgccaatgtcaatgttaatcccgataacatcaaccatttgctcgttggtgtttctcgaaattatgaaatgcgcccgtaatttttcaatgctttgttatttttttttgttgttaacacattgataaatattttttgataataaattaaacatttttagaaaaaaatcagaatataacccatgtgacacaaaaacagcttgccagactaaaacgaccccctgactaaaacgtcccctcagactaaaccggccagactaaaacggccagactaaaacggccagactaaaccggccagactaaactgacccggtccgaggcaatttttgtcaaaatgatgatatatgcctctattcattattttaaccgaggtcaccattactctcgatcccctccccttccgtcatgtacgggtcggggtccctttcccctttacttcattacgttagcatatcgtaccttatgggatatctgccttcggaataaaggacattattccatttgtatatta

SEQ ID NO: 31232 - DNA, 1590 bp, Heterodera glycines
  misc_feature (443)..(443): n is a, c, g, or t
  misc_feature (1579)..(1579): n is a, c, g, or t
aaattttgggtatgtttagaaatgaaaaaaagaccagtgtccagccgggcattgatgttacatgcggccatcagtggtgacatggcaaattgcggcgcgcccaagtcgacgtcggccccgtgtttgaccaacgcttggcacacttcgaaatggccatccattgcgccaacccaaaggggcgtcacaactgaaaattgatggaaaaataaataaaaattctaatttttccgccgttagaaatgaaaatttgatgggaaatcgatgtctttaagcaatcttttcaaacatttttctgccaaaaaggtgggtaccctcagcagtattacgaaaatcttctttttttttaatttgcgataagttatgtcccggtgaagtttcgcccgtcgatgttttgaggtgtacccttcgttttgacccaccccccccccccggtgtgcgaaggngtcacccttttgaatcactgacccccaaaaagcattttttaatgaatcttctcactcactggtcatggtgggggaacctcttgcgtcgatgagtttgcgaaggcacatttggttcggatcggcgccactctccaactgcaacgattacgataaaaaaatttttagtttttgattgcgttttttcctaccaaaatttccaccatttcgcctgtgcccaacacggaggccagcatcagtgccgtcagcgttttgttggtgccctccggggcgtaacgcgtgcgcaagaagccgcgccgcttctcctcgctcaatgtgccaatcaatgccttcattcgtttggtgtccttttcgtagatcgggtcaaacagtggctccacctgaaatgcgaaaattttagtttcgactttttgtaagaaatcgggtccggggttctgaatttggtatttacgggttttggcaaaatttgattaaaaatttttttgtcaaccatttgccgtttgaactcacttcttcgcgctccaattcaccgtccgatttcagtgcattcgcttcatattccttaattgtttacaatatcgtttcaagcactgtcacggcattttttttttaaattttcaactttttcatttctgccagcgcccgttagcatcaacggttttttttctgaatttatgaataaatccaaaaaaaattgacgtttttgggtgtaaaaccgttccaaatcaacttctagatggtgggccaccttttttgaagaatttttgttcaaaaagtcatgaaaatatgttatgggtggttttcgggttgccgctgatcacaaatctgacattcattttgatcaatttcgaatatcgaacccgaaaatgtcagattcgttcgtgatcagtgacccagaaacccgccccataaatcacgattagggatcaaatttcaattttttgtgaattttaaccgcaccaaccttccatgagatggtttgcacatgaattttgtagttggttttgctaccgccaggcatggacaggaggaaattcattggaagagattggtaaataaatcagtttcaaatcactaaatttcggatttggggattgattatatattagcaaaaattaagaaaattgaacaacaaatgngttttatgtat

SEQ ID NO: 31233 - DNA, 1357 bp, Heterodera glycines
atgttggcattttgtccgcttttttccaataataatcataattgtcgctccaatttttcaaatttgctttccacaatgttggcattttgttcacttttttacagcaactcgcgcgcaccaacgatttcgcgcccgcccgcacatttttcctctacaccgtgtccatggtgcaggtgctgaacgcgatgatcagcttctgcacccaggcgttgaacaacgtgatcagacgacgcatgttggagagggaaaagcacgagtgcgtttttgggggaattgcgaaggcgacggcacaaagaattgttgaaaatgccgaaaatttgatttgggctttaagggctttgttggatcgccaactgaaaatggaggtgatcctcagcaacatcgccaacgacccgacctttgatgacgagtcgcgcactcagcaggtagaaacaaagaccaaaacgaaatgccattcagtgttgggcgctgggcaaagtgaactaattactagtaattgctcgaattcgtgccgttttttgggggggggggggttttagactctgctatggttagttgtaacttgtggtttttgatggtctatcgatgctacacccgaaatttttatggaaaattttgtatttttgctgagattttcgattttccttgttcgtacccacccacgccaagacctcccttgtatacggtagtgatgttttgatgggccgatcgcattactgtattaacatttttccaacacgaatttgtcccctacgattgtctctgacccgttattagagcgagctgttgttcaacaacaatgggatatggtgccattgtttatcaattagaccgtaattagtctacggtgtaatgacgtttgatgagggattgccttactgtacatcatttccatttgtgtcccatcattcgtttgccaaaatcaaaaccccaaagatggccgacgtggagcagtcctacatgaccgaggcggaccgccgggcgttggagcgctttcggcgcgctgaacggcgcctgttttccaccgagattgagctggacaaggtgctgttcaccttccaacagtacgacatgctcagacgccgctgggccatggagcaggcacggcaaatgccgcacggcagacggaaaaggcaacaagcggcggcggcagctgtggcggcgacaacggcacagtcaccaaacgtgaacagtgccagccatttggcgaagtcgtgatcagaaatggtgttgtgatcggaaatggtgatcgatcgcttcactctatcgtgcttttttttgttttgtttggctttttgcccataaatacgggatacaaatgactagttcccatgactcctccctcaccttggttcca

SEQ ID NO: 31234 - DNA, 2068 bp, Heterodera glycines
  misc_feature (29)..(29): n is a, c, g, or t
  misc_feature (85)..(85): n is a, c, g, or t
aaaaataaatatttaaaatttatatttanaaagaaattataaataaaattcccctaaattatttaaataataaaataaagcctgnaatataagaaatactaaaaaatttaattgtcttaagattaagacaaaagaaagaaagatcttcgacgagagattaagcattcattaattttcgaaattataacctatttctaagacgaacccaaaattaattaatgaattatttaaatacctggtaacaaattttaatttttaaacaataaaatattaatactaattattaattaatatgaaaattggatatattttcttatttgtcgtgaatatctttttaacaaacgcaataaaataataaaataacattcaaacacataaattattataaagaaggcaataatgattttacaacattataagaaattaaatttttcaataataatgatcaaatatttttatttttccaaattattgtaatattaatttctttagaagaagtcataaaacaatataaaaatccttctaaaataaattataaagtccatgaataaaaagaaagcaaaaaaagataaaaattgaaatctttatgatgaagatatccgaaatgggatcaacgaccaaaatttatatattttaatagatatttgccgaaaattcgtacaaaatttccaattttgcctagcggcgccttcggcacctccgatgacccaaaattccctcaaatattatctttattgcgaggtgtttttgaggttctgatcagtttcaaccaattccgaacaaataaataaaatttcaataaaaaatctaaattttaaaatcttaattcgttttgcttgaattcatgttcgagattggtcagatttatgttgattagtgttcagcaaaacaaattaaaaattaaaatgcctattaaaagttaaaatttttactaagcatttaaaagtctaaagtcaaaataatattaagcaaaatgaaacaacaatcacgagggcagcataaaatgaatgaacttttcaaaagaaaagtcatttttatgaaaagatttttaacaaattttgttcaaagaacaattagttgggaccgtgcagtagtggtcataaacttttatcgaagttttttttaacttttatagagtggcaggcagcccattgaattaattttcagtaatcttttaataatttcagttaattctaatgcattttgtgagtcaaacaaattttaataaaaaatattttattctattcccatctattaataaatcatactattatgaaaaaaccagcacaatatatcagttttttgtgatttaatttctgtgtaaattgaaaatattaaacaaattaaaattcaaaatattcattcatttatttatttattttttctttcataaaattttatttttaattttcgtttttattgaaagaaaaatttttttaaaagtggtctcgctgtgttcatttttatcaatttgggggtccatattcaaagttcaataactttgctaacttactttccaacccaatataaatcacaatatttataatataatttaatggcacatacatcaagggtattaaagccacacaatagaataattggcgatcaaatattattctacaaatattcaaaaaataaaatgaaataagttaatgaaatttaagtaatatgatagttacatttttaatcattaatttgaatctataaatattactttatttattaattaaaaaatgtaaaaaattatttcaaaattaattatgctaaatgtatttctcaataatttattggatttttttatgtaattagtttaaattctgaaatttctttaataaaccggtaaattaaatgcaaaatattttttatagaaaaccttttctaaaaatttataaaatagaaaataagcttaaaaattgaattgaaatttgttaaaaatagtataagaatacaacaacataatattagcgcttcccactcaattcactaacaaatttgagggagcaagattgaaaatttttcgggaaagtaatcttcgacgcttaattgaaaaaactaagttaaaaaaatt

SEQ ID NO: 31235 - DNA, 905 bp, Heterodera glycines
ttttataatgcacaaaatttcgccccgttaagtcctcgtgctacgtttggctctttcgtttggagtggacagtttcagaaacttctttgcctgatttttaacagattttgtattaaaaaatgccaatttggttgatttttcgtcttaaatttaatttaaaattaaggatctgagaccggcggtgccgttaagcgtcgccaagaaaatttttgaaagtttaattgtgatttgttttatgtaattttcgagttgttgatcacgaatctgacatcaaaatttagattattcagaaccccggacccaaactcgaacgaagtcaaaactcaaatcttcgaattccgcatttttatctcaaaacgaaactgaatcttagtccaaaataaaaaagttaaattagggaccacaattgtttgccattaccataaaaaatcatttaaactcgaaaattcggaatcatgacatttttagtggatttttgtctttttcgtccttttatactcacaaatttgtccattgaaattgcgcaactaacagatttttcattggttgaaatggctatttaaaagcgattcttcgtcaattgttgtcattgtcccagaatcatttctttttttttgatgtttcattttttcattcgtgtcaataatttttcagcctccaatttcagccacatggctacgactgactggggccaattcgacgctaacggaactgactacgatgccatctacgacgacacagatgacgaagcgggcactacggacaacgggcagggcagcgggcagggcggcagcgtgctcaatcacctactgacgcaggtggaacatttgcgacaattgctgtttctgtttataattgaaattccattttcaggttggccccggaaagactccttcagaatctga

SEQ ID NO: 31236 - DNA, 1058 bp, Heterodera glycines
cactagagaccggaaatttcaaatttgcggatcccgctgcgggattggaactcaaaattctttgcgggacgggatcccgcgggattaatcccgcaaatcccgcattttccaaaaaatgcgggattgcggactgggatcccgcaaaatcccgcgcgggatcccgtcccgcgccggtctctacctagcaccgtgtggcggcaatggtaaattttcaattgccaaaaaaaaaagaaaaaatttctcttaaaatttaaacccagcagaatttctatatttggaaattacttatgtttattatatttctcaaatagatgaagcaccaaaaatagaccaagcaaaattgggaacaaaaatggaactgagagagacggcatggaaaacaactgctggagagaaaagagaaacaaattttaaattaaaattgaaaatccttttttaaaaaaattaatccataaataatttattagcaaaaatataatgaatttattttattttgttttttattttacttatctataaataaaaaaaagtcatcagaatgtaaataatatgttgtgaaaatattaattaaaaataagtttttgttatatttaaatcaattttatagattttcagtaattattttattaaaaaaagaaattttattttataaaattattaaaaaatatacgtaaaatatttttaaaataaaactttaagataattttgatttgtaaaaacacatctatcactattaaaggttatattaattatatttcaatatttgacgacaaatattttttgcagaataacattgccattaacttccttccaaattttttggattggccatggaaaaaaattgggttggcttaatgaatgaagaacaaagcaatttaaaggcattgtgcctatgccttggggggtggggaagcggccggcacatttatgccaatgccaaatagacagacaaattccttccttcctcccccccccctctctctctcccactccttagctcattgtgcggtgtcattggcgcgtgccgcccattcaattggcggcacttccattaatta

SEQ ID NO: 31237 - DNA, 1061 bp, Heterodera glycines
  misc_feature (998)..(998): n is a, c, g, or t
aaaatttcaaaaaatttgatcgtccataaacgatttgaaagagaatagaaagaaccaggttcgatgaagggttgttaagccaaaaaaaatccaaatatttaaaaatctataaaaaatttaaaaatgagaattcatgcgagattttctggaaataagcttaattgggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaagacacccaccacttttgcacttaaaaaaatttcaaaaaatttgatcgtccataaataatttgtaattgatcagcggctcaccaaattttgcagagatacgtatcggaacactacaaaagcttactaattttcctagatttattaaacccggtgaaaattttttgcagacacccaccacttttgcacttaaaaaatttcaaaaaatttgatcgtccataaataatttgtaattgatcaggggctcaccaaattttgcagagatacgtatcggaacactacaaaagcttactaattttcctagatttattaaacccggtgaaaattttttgcagacacccaccactttttcacttaaaaaaatttcaaaaaatttgatcgtccataaataatttgtaattgatcagcggctcaccaaattttgcagggatacgtatcggaacactacaaaagcttactaattttcctagatttattaaacccggtgaaaattttttgcagacacccaccactttttcacttaaaaaaatttcaaaaaatttgatcgtccataaataatttgtaattgatcaggggctcaccaaattttgcagagatacgtatcggaacactacaaaagcttactaattttcctagatttattaaacccggtgnaaaattttttgcagacacccaccactttttcacttaaaaaaatttcaaaaaattgatcgtcca

SEQ ID NO: 31238 - DNA, 1713 bp, Heterodera glycines
ttgatgatgaatttttcctcaaatattttttcattttctccacttggaattcaagcccactgtcactatatattttcatcgggataattttagacttttcgaacacacgatcaaaagcttcgatcatgtcctcactcttctttgacttggccggtgcactgaagatcattcgactcagcacgtcgatgcagaccaataaatatttataaccgtcgttatgctttttcaactggtcaaatatgcacaaatcgcactgccaatcggtatggaagccacttggtatcgtctttagtctcgggaatcttttcctgatgggcttgtgaatcgtgtatgttctctgcttttctaggaatttattaacgtcatcggtcgtaatttccgggtcaatctttttggcatcatttaaaattttttgaattccagcaaaacttgccggagattttaaattaaaataaatttttgataaaattttctctacagtctggcccatattagtggtttgaagggtttcttctctcgcactatgccgggtgtttttatagattttattgcctttttccttccacgtccccacatgacctttgatttatcaaccatgtcttttactgtcggatccttcagtaacctatctttgagaaattttgcaccgcgcggtgtttcatctttcttccccgcgagatacaacaaaacatctctataattactgttttcaatcggcaaattcatgttcgactgtacctttccggccgccgtaattttaaataaatctttgttttccttcacgtacctaaaaagaccgtttaaaagggtcgggtgtataatagttttgatcggaatgggttttaatgtggatgttgtttggggctccggagttaactcatttattgtatcattatctgattcaggatcaggagtttgctcttcaagtcttttcctaggaataattattttccggggttcatcggtctcctgtggtttggattgagtgttgaggcctagatatggtgcaacattcggaccgggtacatgattctcaatcactaccttctgtggtctattttcaagtatcccctttaccgtacgcctttctttatagagccaatcgtgtctcttcgccttgaggtcctcgcttatgccggggtcttgtaaattctgagaaatttttgcgtctaaactcgctttttcattttggagataatcaccactattcatcgcactccgtagagccaaatattccgcctcgggaatcattaacattttctttgcaaatttcatgatgttattttttctaataaatgttgggctaaaacactcaggacaggtatcaagacagctcccagggctataccactcccctgttgtatcctttttcttgccgttttctctgaacgagatttggcaatttctctataaaaatcggcgtattgtgccaaccttcttttttgtttgttcgttagtttaaaactaaaactcaatatatttgcacaaatttcaacgattgccaaaatttggtcagctgtagcgttttcgattaattcgttcttcttttgttctgatctggtggaggcaagcttctttaggaatgctgtattctccttcacttcggagctaaatttatacatttttaatttaatttaaattcatattcttatatactattcaattggtaaataaatttccagagtctcatctggaaaaattttgctacataat

SEQ ID NO: 31239 - DNA, 2372 bp, Heterodera glycines
tttttaaaattataaactttttgagaatacttaaggctatcgaatgataaccatgaatgttaaacttagatgaatttaagcaattttatgatttcactttcccattcaatacgccctgtccaatttacgaaatgccaaaggcccccaaggtggtaaattttacgaatgatccagcttcagatttattatatccaaaaattaaaaaaaaaaattattgtctcatttacctcaagttcgttgaattttataatgttttctttacaaagtttcccttttcttgcaagcattttctttttcatttgggcataatttttgtattttgccaaaagtcgactttctttggttgtctccaccaaaattgttacaggcaattttgatttacaatttttgaatcctttaggtgtgaacttattttcgcgcacatccgttgtgaaattccattttattttgcccttttcatcggtgacaaagtgaaattgtttttggggcttgcctaaatttggtacattttatggatgatgttacgagaataaattttttaaaaaccttaattgatatgtcaaaattagcaaaataggtatttagagatccaaaatttttcaaaaatttggattccgagaccccaattttttggaagcggaattagaaattccgaacacgaaaatgtcaggaatctgattctgggacaagtaaaggtacggagatttcgtgaaaattatgaaaaatgacaaactaattgcatcaaaaaagccaataagctttaatttcagaaattgagaagggctattggacttttttaccagcagaattcaaaaaatcattaccctcatttgtgattttataagtaatgggagcttttttttgaaaattaaaactattttgggaattgaggatttgtgtttttaaataaattctcaaaatttatgcattgtttattcttggatttaaataatggtagcgatgctcgagactgaaaattcccgagactcaagaccgagaatttaccctcaagattgaattttatgattattacaaaaattcttaccaattgggcctgacaaaatacgaagtttataatggtttctgggcttaaacctgtattcatttggacttttaataattgagtgcttgaaactttccaatgaatggttgattttttcacaattaattgccgaattggaattctttgttgactttgattggtttggtgtcgatttgggtgtggatgattttagtgatgatttgagtaataagggcactttaggcgaaactgatgatttggacgatttcgctccactaatccgttttgaatttaataagggcgccataagagaatctgatgatttggacgatttcggcccaccacaaatctgtttcggatatgtcaaaaatatggcgatgaaaaataaaaaacttattatattgaataaaacaagcattaattgacacagaatcgctgtaattaataagttatgagaagtaaattaaaaattttaaactgaaaatcaaattattttgtgttatattttgtgattgttaatggatcagaaaatattcttatttatttgactttataatatttattaaataaaaattataatataatattaaactaaaataataaaataattatattataattatccctaatcaataataaattcgattatccatttttgtgtgatgctaagcgttgggaataatgttttttaaagcaatgtaactttttttttatgtgatataattaaaaaaaaagttaaaatttttaaaaataataatttaaacaatgtaaaattttttttcatgtgatataattttaaaaagttaaaaatttttaaaagagcaatttaaattatcgtcaaaaaattaaaagcctcatttaaaaactttaatttttcaacccgtaatctattcaagtttcgtattttaaaaacaggtttgtcttaacattgctcaaaagcaaccctaattattgcgaatggcattatgtacaaaaataacataaaatgcagaaattaattcttaaaaatgcctaaatcagtttttctgtcaaattgcaaaaaaaaaaattcttgttatataaaagttataatgagaaaataagaaaattaattgaaataaaattaatttatttttttaaaaaaattagaaaatatatgtattattgctcttaaaatttataaaattaaaaaaataatcaattcattgatattaaatttggcataaatttttattatttgattctcgaattcgtgattattgtaaatttcagaaacaaagttgttacattgttgaaaaatttgcctcaattttttgcggagagatttggaaatatcaaacaatccaagtccatcgtttttcgtataaaaatt

SEQ ID NO: 31240 - DNA, 1417 bp, Heterodera glycines
tttatttctggcattctgttaaacgctgctgcgggatcatttgcgattgttctttattttaacaggtcattatcattatcggattattatttttttttcatttaattaattttaatttattactttattaataattaacttttagcactgaatatcgccgcgtgttcaaaaaagaatttctcattttattcaatcgtttttgcaacacaaatggtcatttttaataaataaaattttataaaaataattaatctatgcattgaacttttaattttagcacttgttgttctactatcaaaaaatattgaatacaatttttttaaacaaatatttaaaatttgtttttagctgttcaaactattggcacaatccaagtgcgaagtgccaacccaaacaataaaatgaacaaaatccgatcaagccaacagagaaatgttcatacgatcaatctgaatcgctaatgatacggaattttcgttgatatttttaacattttttatttaattgaaaaaataatggaatttgattggaattttgtattatgcaagataataattttgtaaaactagaaaaatttattttaaattaaattttaaaataattatttgttttaaaaatgcctcataaacattgctataaactgaaaaaagttaaaataatttgtattatgtttcaaaaaatttatggtcaaaaaggtttcaaaacttaactttttgtgagtacttttgaacataactttttttttgaaagttaattaattttttgaagaaaaaatgcatgccaatacaaagaacatttagcactaatgtagaaaagcctttcaaaaaataaatataatatcctaaaattttgaaatttcgattttcaatttttttattaattttttttattaccacccctcggtggatttatggaattttctaccaccttaatttgcattgcattttttctcgactttgttgacacagttgcgagaatggcgtcggactgccggaagtcaaaattggcacgacctttaattagcctcgggcaataatgtttagctaattaaaaaaaatcataagataaaaatgattttaaattgagtgtgaaataatgaaatttgatttttgtgagaaaattttaaaatggcggatttagtaaatttactaccaccttaattgcattgcagtttcttggcttttgaaattttggcattttcccatgggaattgtctaaagatttctgtgtccgttaatgaaatttttaagatgattgtcccacttttgtaattaggcgaatttataaactatatttggcactttttttattttttaaccaaaaattacgtaaattaaatgcatgtcttatttcttattttatactttttcaattcgatatttcgtgggtaaatttaaatattttaaaataaatttaa

SEQ ID NO: 31241 - DNA, 957 bp, Heterodera glycines
  misc_feature (863)..(863): n is a, c, g, or t
  misc_feature (896)..(896): n is a, c, g, or t
aaatcgttaatttatttgacaaatccaagacttaaaattggggagaagcatggggctgtggctgaggaaccataatggggccccattggggaattaaacatgatttctgaaaaagtcccagaaatgtcgattttttctttccatatcttcttgtaaagctcgagctgttctttccaacggtcttatcccggtctcgatccctgccgaactcaaaaagttatgaagtgaaatgtgaaatattgttttcgccacaattgggagaagcatggggctgtggctggggacccaaaatggggccccattggggaattaaatatgatttctgaaaaagtccctgaaatgtcgattttttctttccatagcttcttgtagagctcgagctgctctttccaatggtcttatcccggtctcgatccctgcagaactcaaaaagttatgaagtgaaatgtgaaatatgttttcaccacacgggattttttctgaaacccatcggaaccaaaaatctagggtttggtataagcgttttagaaattgcggagaaaaaagcttcgatattgagaaaccaagtcaaatccagaaaagaatattttaaaacgaattcgttttggtttggcattatgataccgaataacattcggaaattatggaaacaaaattggagaaattcgaataattttttgacttcaaatttttcccagttttgattgggttttcaaatagtagtttggttcagaattttcccctctacaaaaaaaatttataatagaattttttattattaattcgaaatcgttaatttatttgacaaatccaagacttaaaattgggagaagcatggggctgtggctgaggaaccataatgnggccccattggggaattaaacatgatttctganaaagtcccagaaatgtcgattttttctttcatatctttctgtaaagctcgagctgttcttt

SEQ ID NO: 31242 - DNA, 1084 bp, Heterodera glycines
  misc_feature (23)..(23): n is a, c, g, or t
aaaaaagtaatttgaatacaaanaaaagatcgacacatcaaaatgtgataaagggtcgattgaaagcaaatcagagacgccgaaaattattcattgcatttttgcttaagtcaccacgtcatccgtatctgttcagtgcgggcgaggataaacaggtcaaatgttgggacttggagtacaacaaagtgatacgccattaccacgggcatctgagcgcagtgcaagacttggcacttcacccgacgctggacattttggtaacgtgcgcacgcgactcgacggcgagggtaaaaaagaaagtgaaaaacggacttggtttgatgaaattatcttaaggtatgggacatgcgaacgaaggctcaaattttctgtttgtccggccactcggacactgttgcgtcggtgatttgccaaggtgtgaatccgcaagtggtcactggaagtcatgactcgaccattcgcctgtgggacttggccaccgggcgcagcatgtgcacgttgaccaaccacaaagtgagtgctttgactggcattgtttatataagggggaggagttgacctccccgaggtgggaggttgtcaaaactttcatttaaaaactccattccactgcacgcaatcatcttcaaattttcaaaaattccttcaaagctttaagccttggtcattttatgttgtaacaggatttttttgaataaaaataattctaaatgaaaataaaaatcgtaacgaattaacgccgtcgaacttctttcatgaaaaattttaactacaaaagaaaaatattttcatgagctttaacaaatacactaaattttaagtttttttcctgccatacctttggcagcgttgatttttcttttttttattcattttttcgaaattcttaaaaatcaaataatgaaacttttctggctttagtttagtttagtttatgcgtccaatcaatgaccatcctcacaatcagttttttttgccataacttatttttacgagggaagggagcaaactgtcagcggccgggaaatacatatgagttataatacctttagatagagcagagtcgacttctattatgaatttt

SEQ ID NO: 31243 - DNA, 1742 bp, Heterodera glycines
agtagcaagttatctgtgagttactgttactttttgccttccacgaccgcaattctgctttggtaaagcagcacatgtgtcattgcacgcttctttgtattctgaaattgaaataaaaattttaattaataaaaatatatttcttctctaaacatatcaaatactttcaaaatggaagagattttgaaaattgaacaaaatgttaattttgaatcttgaacataccaaattacgacataaattttttgaaatccatgaaaagcaaataaaattttgtttttataattccaatcaaaaaactccagtggaaatacagtaaaatttatgaaaaatggatcaagtgaatgtccgattataacggttataaaattcggaaaaatttgaaaaattttcattttaattaaagccattttcgtaaaaagattattaatgcttattcatttaattgttaaaaacaacattaccgtttgacatttcagcatccgttaattgcaaaacgatgaacagaaaaattgtaaaagcgaaaaactttttgcgcatttttctaaattttttaataaaaaagaacgatttaagcaaattatgtgcatttaaattttacgaaaataccttttccaattaacatggattaatgtacatattttataaaataggccttcacaaataatatatttatcactttaaatagatatttttacgttttgggggcattttgggcatttaaaattaacgaatttacactaaagaaaaataaaaatgaaattttttacaaaaacgaattaattcaaatattcgcttcaataaaaaacaatatgtaattaaaaaaatattaaatttttgcatttttattttcaaatccatgaataagcacaaagcaaggaggtcgtgccaaaataaggacaaatcttacaaataaggacacttggccgccctgattaatgtacatattttataaaataggccttcataaataatttatttatcactttttcataaataagagtttatgaatgaaaccattagggcccgtacggaccggggtcccgccgggattttgccgggactcccgacccagttcccattttttggacaaaccattaggaccgaaagtcccgtaaaaacgggagtcccggtgccgggatgccgccccggtccattttccaagtcctggccccgttcctttcccggcaatttcaaaattctgggctctcgaaaccattattgttggatttggccaacagaaaaagttatgtgggaagtaacaccgaagggtgggggattatcagggataatagcacattgtgaagcagggggaccatgaggagtagagagggccaagtcaaatggaactaaaatgaatttttaaaaattaagctaaaaatttcgcgatgcctttttttgacagggtgttgggtttttagaaatgtaaaattgatacattttttatcatcttaacccaataaaaattcattttttccaaaattttttattattttaaaatttaaataattaaaaataattttctttaattggcataaagagtgaaagaaaggtatgtgacatgcgcattgtaagtggcttttcgaccgttttaacttattaaatattttaaaaattaaatttattaaatgaaaattgagttaaaaatgaacctgaaccgttgggcaaattattttcaaaaatgtcagtcaaaaaattaaaaaatattaaaaaaaaaataaaaaagcccaaatatttacctt

SEQ ID NO: 31244 - DNA, 1100 bp, Heterodera glycines
  misc_feature (1095)..(1095): n is a, c, g, or t
gttcgtccacagcgacacggccttttgtacacatcaacgtgaatacggtaggtattttaacatgagtacgatagttgttttacggtggttcatcattggttgcaaatatgatacagttgtttcaacatggatatggtaggtttattagtttcgtggcacaattaattgtctaaatatgtctaattgcgatggaaaagtgcttaatcttcgttacattttcaaataattggcactaataatatttttgattaccaaagtttgttttgcccaactttattgggtccgtcattttccaagaatcagtagtgccaaaactttctaattagtgtttgccaatgccaattaattggtctgatgttcgggctttttcaaaaatccgtgccaattaattgcttcccaacttccctaattgccaaacattggcacggttttcgacatttttgctgcttggatggcattattcaaaaaatgtggcgcctttttcaggtggaatatgccgtgccatcggagtaccaatttgtggactatttgggcggtggtaactacggcaacgtgatgtgagttgagcacatcctcacattccacagcagacaacaccaaaaggcatttaaaaccaacaaattttatttccggcacaatttattcccccccccccccgccattttcaagcatttaattatttgaaaccccaaaaaaatttaaatcgttcaattttttgaaatatttcactagagatcggcatctggccatggtcccatgcctggattttcctggatccaggtccaggcttctcaaaactgaacctgaacaaaatgacaaatttgataattagggttttgtcgatcaaattgtttaaaaattcaaatcctggcacgggtttctggattttgatcgtaaatgggtgccattttactggttggtcatcgacccagaaaattcatagcttattgttataaacgtaaaatgaaaaaactccgcggcatttttttgcctttcagtgtgccattggccaaaaaatcggagaaaaaaaattcccaaattaaatccggcattttttggccgttcattgtgccattggccaaaaaatcggagaanaaaaa

SEQ ID NO: 31245 - DNA, 1312 bp, Heterodera glycines
aaaaataaacaaataatgaactctcttcctttataattttcctgcaccgaaggtactcactcggccgcttcgcggcctcgtggtgggccttccccccccccctcccacgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatattaaagcatcagagtgctaaaattaagttgtaaataaaatttggtgcgctttagagcactttctgaaaaaaatatttatgaaacaaaaaaatcgattttttcaagtgtccatttggggtactcaaacatttatggggagcaaaaatccaacgcagaattaaagtacaggctatagggaagctactccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttgcgtcccgcgccggtctctagtgctcagcgcctcaaaatacccaaagaaacttgttaaagaattcccagaaaaaatttaaaaaaaaaaattcgggaccaatgatcgacatgattgctctttaaatttgtggaaaatatagaggaatatatcgttctgcaatttttccttcctgcgttaactttcaatttgaagcatattaaattggagagaaactttgctgaaatataactccatgaatacaattaactgttaa

SEQ ID NO: 31246 - DNA, 932 bp, Heterodera glycines
gagagagagagaaagagagagagagagagagtgagagagagagagtgagagagagaaagggagagagagagagagagagagtgagagaaagagagagaaagagagagtgagagagagagagagagtaggggagagagagtgagagaaagagaagacaatgccaaagtttgaaaacaaatgaaaaaaaatttaaattttaagctggaaaaagtggaaaaggaaatgaacgaacggactgaagaattggaagaaatgagagaaatgctgacgcactttcaacatgtaaaggaagttgatttaaaacaattggaacaacaaattgagcaaagacaaaagagaggggaagaaagaatggacaaaaaggaagaaaaacaaagggaggaaaaggaaaagcaaagggaggaaaaggaaacgaaaggcgacagagaggagaaacaagcgcaaaagagaggggacagcagcagaagaacagtgctaatggtggacaattcgagcgaatgggccgaacagctgcagaaagtgcgggaacgggccaaactctgtgtggacacttacaaggtaaaaggagaaaagagagggagagaataaaaaggaaatgcgaaggaacaattggaaagtcgggacaaaacattggacgaatatcgccaattggtggaacaactccgaaccgaactcaccgaagtacggaacggaagaagagaagcggaggaacagcggaagagagacggagcggaaacggaagaggagacgagcaaaagcggagaaaggaagcggacggacgaatgggaagcggaagaagcggaggagcggtgggagaggcggacgagggcattggagaggcagctgaagaggatggtggaggagcaggcggagatggagagggagcggacgaagctcagagagaccatcagagccaaggaagagagcgagag

SEQ ID NO: 31247 - DNA, 1514 bp, Heterodera glycines
  misc_feature (7)..(7): n is a, c, g, or t
tccgttntaggctgcccctcctctttctcgctttcccttcatggaaaagaaaaactctgtgaccaaagtgagtttttcggatttgcatttcctttttttctcaattttccctccattgtttaagattgtgcctccttcaatgctttcgaaaccgcagaaaattggatcattcaaagtgagccaatcgtttttttgccatcttccccccaatttgcctgtcatttccttgtttaagccacagccatcgccgatgggccttccgcatccgaaaaacggtgtccgcactggaattgtgagtttttgttttggggcgtttcaccggcccccccgtgaaaatttaaaaaagaaatttttactaacataaatttttaaagaaaaatcttataagttgttttcataagaaattctaaaaaaaattatttgagaaattttatagcgaattactaagattttcggaaaattttttcttagactttcctcatgaaaaaaaactaaaaaaatttaaaagatttcgtggggtaagcgtagtacaacacactttgtttggctgtgtgttggtttaatgttttttgacaatcgatgtttaaggctgttcccacttcgatatgggcccccaacgatgatgacatgtacaagccgaagcagtacgaccagcaggaacagccgaagcaagcggagcgaccagcagcagcgcacggcaagctggccgacgacgacatttacaacccgaagcaatacactgaacagaaggctggtggtggtggtcgaccgacgtatgaagccgcacttgccgacgatgacctgtacaatccaaaacaatacagtcagaaaccacaacaacaaaagggcgccgacgatgatgacctgtacaagccgccgcaacaatacaatcaacagcagcagcagcggaagatgggccgaccgaaatcgtatgaagatgagcttgacgaagatgatttgtacaagccaaagcaatacaattagaccgagcctatattatatgtctatatgcttatgtaataataatatgtatgttttatgtgtgtgcgataacgagtgtaaatattcatttgataatgtgcaattctggaaaactcatcatttgaccgcgatttgacaattgaaaaggattttcattaattgaaaggttttataaagtttgtaaagggcttaacacaaaaaagcggaaatattgaacatttttactgaaaattagtcaaatattttagggtttatctcaaattttaacctaaaaaaaattttcaaaacttttgttatctctgttagtagagaaaaactgaatttacttcgctctacaaaacttttctaatttatatccacactaaatttttccgtgatgcgccatttgtgccgcgcagacaaaaataatattttcatttcaatttcactaatatcaataagatttactaaaaaccaacgacaaaaataacgaattgaaaaatttaaaaaatatacttaaagatagacattaatttttttattttaatcattaa

SEQ ID NO: 31248 - DNA, 892 bp, Heterodera glycines
tttttattttctcggcgggggccgagctgctcccgactaaaattccatggaaatggaaaaaattttaatcaacttattgtccattttaataggagtggtctcatcaacttttgcgcctgtgcattggcccttgccgacctcggcttccgtgccatcggatgtcgaattgacagcggtggcctggcttttctgtcaaaggaaattcgtcgccgtttccgacaaattgccactgagtattttattaaatttttcgaccaagtgaaaattttaatttcggagctaaaattgagtggtttgccaatttgaaaattgtcggctccaatgacatcaacgaagagacaatcattgctctgcgaactcagggacacgagctgaatgcttttggtgtcggcactcatcttgtaacatttttgggggttggcaatatttgaccatatataataaaaatgaaactaggtaatctaaaaagagcatttacctattgtaaaggcgatggttcctttctccatcattcattttctttgctcaattctttttttataaggtcacttgtcagcaacagcctgcgctcggaggtgtgtacaaattggtggacttggatgggaaggccaaaattaaactgagcgaaagcaaacacaaattgttgatcccgggacgaaaaaaggcattccgattgtacagcaaaacgggtaaaacaaaatggaacagtgaaacgggagcaaatttgacaagagatcgtattaaggaattcccttggtcgatttgatgatgctggacaacgagcccgacccgacgcctcacaaagaaattctttgcctccacccttttgagccgggaaagcgtgccaaagtgtttcctgaccgtgtggagcgattgcatcacattgtaagtg

SEQ ID NO: 31249 - DNA, 1787 bp, Heterodera glycines
tgttcaatggaatcgaaaattttgtatttgtttttgtcctctattagggatgtcaattttatgtaaatacattttttttcctggcttctccatagcctaattagtaggaaaaacactttcttttttatgtttgcaaacaaaaatcgggacttttatttacatatttttacatatttcggggttttatacatatttggtacatattttggactttttcttacatattttgatttttatttacataatttgcgggttttttacggaaaatttttggaaatcctcaaaaaaaaatccaaaattttggcaaattttttatttttttatacatattttgagaatttttgaaaatttttagaaatttctagtgaaaaaatttaaaaaaaaactttttttaaagtacccctccaaaaataattttttaaatgttacaaggtgattctaaacatatttaggtcatttttatgccattttacgcctatttaacactttacgaaggttttttcccaaaaaataaccatttaaaaaattttatttacatattttcgtacatattttgggtttttatattttttacatatttatgtacatattttgaccaatttttgtacatatttttgacatccctattcattattatcctttttctaaagatattttgtatgaatttcttgaatttaagcaaagcaaatggctgaaaaacctgattccatttggttttatttccatcgtcctataaatggcgcattcgctgcaaatattgcagtgccatttgatttttaaacaaattaaaaatttgtcaattgacccgaaacccggcctttttctcgacccgaaacccgacccgatgatttttctcgacccggaacaaccctgccccgcactcaaactcaccactggaagaaaacgaatagctggagtccgaggccgactcgcttccactttcgcttgtccccacttcctccactgacggtggttgtgttgcgcaacgtttctgcgccattgaacgttgctgttgaactgttgacaaaaactgacgcaatcgcttcccatccgtagccggcaaacagaagaaagagccgaggaccaaagtcacgtgccggattgatcggagagccgacattctgtcaagcagaaattaccaatagacgagggagggagtgattatgccaaagacaaacgtaccatgccaaaagaggaagtgatcagaaagatggccagcccaaagccgatcggatgcacccattttggcacttggtttcgcggatcgatcagcgcattgacgaaaaagaggagcagcgcagtgccgacaatttcatccacaaacgctgcaaaagggaaatgtgagacaaaggagagagaggcgagagcgagaggaaaggagaaagggagaaaaaaatagaaaatcctgaaggaaaagcatgaatgagatgagtgtggccattacattagcatttgcttcgcttacctgtgtaatgtccgatgtgttcgtccggaaaggaacagaaaattgcgcccgttccgctgggccctcccaccgttcgaatgcccgcgtcgaatttctcgaatgattctggcaaaaaaataataattttcaaaattttcgaaaaatagcaagtcaacccacacctctgtagacgtggaagcaaagggcggagccgaaaaaggcgccgacagtttggacgagggaatacagcaaaaagtgcgcaaatggcaatttgccaaggctaacgaaaggcgagagacacggccgggtcaaatggccacctttggacgggggaattggcaca

SEQ ID NO: 31250 - DNA, 1083 bp, Heterodera glycines
cacgactttctagaacagaaaaaaaaattttccaaaaaggggggggactatcggtagtattacctaaatttcttctaatcgtttttacgtttattcgatcaaaatgtattaaaatattttatattttttgcttcccattatcgaaataacaatcaaaattatgaggaaacgtggcatttaaaaatttattgctcgatacatcacatatatacaatatacatacagtaattggtgaatgccaatatatacacatatgtacagtgaacaaaagcagggcaaatgaacatagagacatcgttaatcacatacaatacatacataagtataatatcatcactcagagggcatcacatcacatcaaataataaaatgatgaaaatgagtatttataaaaaataatattatgggaattctattgaaaattaattaataaaaaacacggtaatagtttagatggtacccccccttttttaaaaaattttttcaactttcaaaaaatcataaaaacatgtttctaggggttttcggggtcgctgatcacgaatccgacatccatttcgaccgattccgtaacccctgacccggattcgaacaaaataaaaaaattgattttttaacaaaattcacatttattgctaaaaatcgattcaaatgcacgaaaaagaaaataatcaattcctaaccttccgcaaaactatgttcattggacagtgaaccattcacaaaactttgggaacccaggcaatcgccttgcccatacccagaatgttgaatcgatgtgaaagaaattgtaaaggaatttcaaacggcaatttgggaacaagactgaaacatacgacacctatttcccagaatttatttggcgccagcggtctggagaccgtgaaaatgcgccgtacaagttctggtcgcctgattccgcgctgtatccgtgcattcatcgataataccaggtcaggcctccgggatttcggggcgagcaataatgggctacaaaaagatttccaattttaaatgtgccggtgattagctttttgcgtttcccttccagcaacatcatttgggtgctccacgtggtggcgg

SEQ ID NO: 31251 - DNA, 1240 bp, Heterodera glycines
gtgtgtttaaatattatcagataaacaagatttcgcagtgtgtaaaaattcaaatttttcttcttttaaatgtgtaatataataaatatttatgaatttcattgataaaaacacatgctcaagagagcactccgagaaacgcgatactttcctcttggtgttccaattttcattatccatgtactattttaattttttctcattattaaaaattatttaaatattatatataatcattttactgttttggttttgttgcaaattataataatgtaaacgatctccttggttcttttccattattttttgtgggttcgattcatctttctgactgaaaaattaaaatatataaatgatatattttgaaaactgattcgaatagattgattttttgttttattaatttcaatgtgtatttattaatacagtttcaaaagaattaattttttattctcttttttctctcgtcattaagctggtcgctagaagcttgtttcgctaagtttaggtttcatttaataattttttgtttaaactattcatttttatgataattaagaaaatatttaattattttatccctgctgaaagtacctccgagcccgctttcaaggttgattatttaaagcaccaaatatataagtacgagcgcttggcgccgcttcgcggcgccaaacgcgtttttttatctatgctttggattttgcttcagcaataaaagcttactaacggcacccgcgacgggaacgcaccaaagcattgggcaccaaaagagccggaagctcaaatgatagttagagggacaatttgtgtcccgccctaccatacgctgaaccgcttccataatacagcgattaacttacctttaatggctctttttaaaaatttaaaattttgaaggttcctttgaaaaaactaattatgtatttctttttctttttaattttatttaacaacttagccaaaaatactataaaatttctttccaaacaatgttatcaacttttccatcaatattttcatttgataatttaatttttatttgttgccacgatccaacccgtgacaaagccacataggtttggccatgtgaaaaactttgacgcgtccaatctattccaattttttggtaagtggcaccttgacccttaataaatgttgctgcaaaagccaaacgcactggaaattgatgtctttttaatgggacaggaaattcattttctgttatgagagatattct

SEQ ID NO: 31252 - DNA, 1425 bp, Heterodera glycines
  misc_feature (1408)..(1408): n is a, c, g, or t
gactacgctttcgacccgtgggctcgagcaaaggctttcggctattactcactctacgaatttctcgcatcggattatatgaaaggacttgtgtttatagatttcaaggataatggcgaggcaattttcatggcgatccccggtgatgagtcaaaacatatttttattgaacaacgaatttggcactactacagagaaatgtaattgccattcggataattttaacatttcaaaatattttaaggaagagtcgtaagctgtttcgtagacgtcgtcgttcaattggtagccataatgggcgtaaaaatttctaaatccaatcccattgtgtttatgttctttttttcttgtcctaagccttttaatgattgaacccaagcagaaaacacctaagtaattcctatagattatttttcttttaaattaaatctgtccattcattcattccgtgtccatttcgtttaaatgtctttaattagtaattccatatattgtttcacattccatttaaatttaaaaaatatgaaaaaattatcctttggacatttcaacaagttggtttaagctgacaggcagccattgtcttcttgggggattgtattggaacagcagagtgccatcaatataaatggaatggattccgaacatgtacacttgcttcccatcttggaatttgcttctttgtgggaagaattgaatgccatttgtaacagcagttgattcaacgagttgtttgaaatttgtcggtggtaattgcacaaatggcgtattgattggcggaacgctgaaaagaggcgctgcaggccgagggagtggatgctgaaaatgcattccggggattggtgcgcccgtcagtcgattctgagcctggccgatgagcatcaacgcgcgtttgagttcagcttaaatgaatacaatttttattgttttctgtcatggcgaatcgtcgcccattattacccatgataacttgttgactgataatctcttgcgggaataaattcttccagttcatgtaattcttcttcaccctttccaattcttgcaccgaaagcatcggagaattcaattgagagcgtaaaaagtcatagtacttaataaatgaattaaggattcactatttaattgtttaaaaacccgcggaaagaatgaatttgccaaaatttttccgattggctcgccaccaacaaagtccatccagtcgaaaagttcaagttgatcaaagtaatcagttgtaatgagatcgattgattgtagcgccttttcgagtttcggcaaaatattcattccaataaaagtgtgaatgatgccactggagaacacttccttccatggtcgaatgcattcgatggcactgtaatgtaatttcattgaaaagtaaggcaaataaagacatggattcttttanatgaaaatttgaattta

SEQ ID NO: 31253 - DNA, 1534 bp, Heterodera glycines
tatttcattaaaaaatcaattattaaaaaaacaaaatgaccccccagccttttcgcgacataatgggtgaaacgacgattctcttagagccaaggtaattaaagaatcaacttgaattttaatccacagatatttaacaaaaacaatctttcgtccataattatatcattggatgtaattaaattttttctcaacttcaaatacagttcaaacttacattggagaattaattaaaataaaatcaaaaatttagctaaataatatataatgaaataataaataattcttcaggtatctaatagtcagcaattataattttttttatttaagatttttaaagaaaaatactaataaacatagcttaatgaaaaattatggtttagagataataaaatatcaaatataaataaatttcataaaaattcaacaaatacaatttaaattggttcaaaaatgatcaatttagagataatattattaattaatgtgaaaaactataaataatattcttcataagaaaaataaaatttaattattattttattatttttttaaaacttaaattcaaaatttaattttataaacataattaaagacatttaaaaagatattagcattaattattaaggttacgaaaaacaatgagaaaatttacaattaaaaaatagataattattaattaataagtaaaaattaaaaaagctaataaaatattcaattaataataattattctataaaatattattgcattatatttatatgaaaaattataaatttactagcatttgtttaagtcaaataaaattgtgaatatgtaagaaaaagtgattaaaaagtccaaaatagtaccaatgttgtaaataaaactagaataatcaattttctgcaaaggaactacgcttgaaccagtcacacataaaaaaaatttggttttaagataaaatattctgagtataaataatagcaataataaaagcacaaaaataccaagacacgaagataaagatgataaattcatataaatttaaatgagttagttaaagaaaaatattcaacaatatagatatgttgtgaattaaaattagtagaaaaccaaataaaaataaaaataattggctctaattcgccagtatcttcgctcattgcaattatcgagcgcctacatttcgtaacactttctttccttgcgatcggtgttaggtcgtttcttaaattccgcctctaggagttctctatcagaatataattttattaaattttttacttaaaaataaaaaaaagttaaggtcacaaaatttcaaaaaatcttcagtcagaattttaggccataacatattttgaaactcaatggaaatttttttaattttaaagataaataaactaaatagttgacttgaaattttaaaaagaaattttaattttattgcttctgaaaaaattataagcattgaacaggttatattttgccatggtcatgcatatatatttaggaagataagaaatggtaaatagctgctgaagtgaaaattata

SEQ ID NO: 31254 - DNA, 2014 bp, Heterodera glycines
  misc_feature (14)..(14): n is a, c, g, or t
ttaaaatgcttccncatggcgcggcccaactttcgccaacttttcgcaagacagctactctgcagcgccaggcgctaggcgccatttgcgaaaagttagcaaaaacaggttagcatatctcggcgcaaagcgcccggcgccagacggcaatttgttttcccagcctttcagggtgcgggacgcgcggggaaaaaaattctgtctctctagcatcgctggcgcaaaagttggctctctatggcgcaaagtgggcaccacaagttagcatatctcagcgcaaagttgtcgtagcgcgccaaacttttttttaaaatgccccccttgggatggcacgcatttagtcaagcggcgccaaacttcagcgccgggcgccacgcaaagttagcaaaaacaggttagcacaactcagcgcaaagcgcccggcgccagacggcaattttttttccaagccttacggggtaccggacgggcaggggaaaaaaatttggcttcctagcattgacgtcgcaaaagttggctctccacggcgcaaaaccggctcgggcgcgcgcccatttcgacccttcagaattgtcgaatcgcgccaaatttttttttaaaatgctccccacggcatggcacgcatttcgccaagcggcgccgagtcgctatctgtgcgccgccgggcgctatgcgccgattttcgaaaagttagcaaaaaaaagttagcatatctcagttcccaaatgtttttgctgtcttttgcacggtgaagttggagtagggggagatcagttggctaacgcaaaaggaattgggtcgataggtgcagaattcgcaatgtgcgggccacatttgcagagagccccccccgtttttatatatatagataactagccgctctgagggcatgcgtggggagcgtgcacttgcttaccctagccggtcgagttgtagccagtaacgggtgcacagtccaggttggctgggcagtagcagctaccgaaagatgcgtgtctggatgttcgtgcagcagcagctgccggtgtgtgcaagacttgtgagagacaatgatttcaaggagagactcttgctaccggtgcgtgcgattgatcagatttacaaattcgaatggagagactcttggcttccttacttgagctttgcccaaataagtactgacgcctcacaccagcgggaaggtggtctctttgcgcaaggcaaccctcacctgagccattgtttttttgataaatatatattttttttttgcttaaaaaggcaatggctcaggatcattgggcttctctgatcatcttcccccctcctccctcggcatctcttatcattttcgtcccctcctcccccggcatttcattagtccatcccccttcaaacttctctgatcatcttccccctcctccctccacatctcaaatcactcacgctaccgttactattgatccatagatccctcctccctattaatcaacacatagatgctccatactctatggtcattcgcgaaaataaattaccacaaattatcaaaatttttcaattttctgcctaatgtttctaaaaaaattattgaggcttctaatttcgtaaaataacaatttaaacatttctatgctttaggcagtcattcgacctgtacctgaagaagatcctcgagggcttcaaccccgacctgtacccggtcgccattcgagcaaaagcgatgaaatgcttggcccaaattgtggaagcagactaccaagtacagcaataatacataatccatgaccaaactcaactaattaccgtataattagataaattgctccatttctccttcaattcccacgtgctaatgatcgcggaggtcaacaaaatttgtgcaagatcggctgatccgatgctaaacgcgtccgtgcgaaaagctacgttcgaatcctgatcggcaagtgtttgggcacccggcccgacttgttggacacgtactactccattttggtcaattcgaaaaaggtcggtggccattttgcatccc

SEQ ID NO: 31255 - DNA, 1235 bp, Heterodera glycines
gtatatgcgttacggtacgcactaccgacatcttgtctatactgcttaacaatttcaaaaatccctttagcttcatctgccaactcacgacacattaacacatcttttctgtctaaacacttatccatttcttttctaataaatccaattttctgcttttcttcgtttaatttttctgagaatccttgtacttttctcacccattccaatagcctaccgaaccatgttttcatgcccggtgcctcaggatgacgaactttaattttctctgcctcagaaattgccctattagaaacagccgcgaaatctcgggcttcagtatttaatctgagtgtatcccgaaatgctttttcaatggtttttctcgcagcgttcaattgttgtttctcttcgttagataggcaacaacaattaggatttgtttggccaaataccaaaccaaaaagtacgaacaaaactattttattcattttattatatttattttttgtctgagttcttttatattttatttatttgatttttcgaaacttttaccaactcagcatcataaaatattcccttaatattatccccatttaaatcttcaattcggtaagcgattggatctgatataaatattttatatattttcaaaatttcttccgtaaaattcggaagatatcccttggcgaattttcctttttcttttgtaattcgcactaaatcaccaattttatatttattatttttttctgtttctaaatttccaaattatctttcccaaataatttcggtattttcaaaattaattgaagatggtttgacccacagggtcctattcacactgttgtcaatgtttgttgttattttgtctattacatcgacccatcggagagtgttcttctttgtaaaatatctgcaaaaacgctcctttattgtcctatttgccctttcaactactctggcgtgcatatcggggctatacattacatttctgatgatgaatttttcgtcaaaaattatattcccattcatttatttttgcatttttgatcatttttattttatatattcatttcaactttttaccatattttcattttttttttgcaaaaaaatatatgaaactccttatttttatgcgtattttggttatttttggtacctagcttttgcacatgataacctacatttccgtaccacattagccaattgtatctccacctgaaatctaattctcttgcacctgtatc

SEQ ID NO: 31256 - DNA, 1918 bp, Heterodera glycines
  misc_feature (32)..(32): n is a, c, g, or t
  misc_feature (49)..(49): n is a, c, g, or t
caattattaatagcatattctaatacatacanaattatttagtgcacanatgatatttttagtttcaaaaaataaataataaatgaatgaaaaatatgataatatcataaaatcttagtttaataaaaatcagataacccaaatgtgttgctatgaactggacagtcacagccgtgaattggtgtgccatcgccgatcgatcaaaattgatgaggaaagaaggaaaaatgatgactaatcgaccatttgacctttctcattattttgttatttttcacatttggagtcatttttattttatggaaatttttacctctatttaagggataacgatttgtcatcagcattttgatgcttgaaatttcaaatatttcttgctttctgaccccgggagggatgatgctatgcatgcttatcatgatcataattgatgaatcgaatgttgggaccaaaatggggtgaaagagagcagaattcatcaattcacccaatcactaaaatataccacaattcgaaaagaagtgtttgacattgcagcggaaaatttgggctgtgaaaaaggagagcttgcgactgttgttcaaagaatttcaaaaaacaaatgcgctaacaaaattgatcaccgaaacactcaaccgtggtgcgacattgtggtatcgtctcgataacaattaaaagaaacataaatattattaataaatttaactaaaataaaataaataaataattatataatattcttcatttaaaaacatgcgctttaatgattatttaacaaaaataaattttttatatttagacaagaataatttttaatttaaaacaaattttagctttttagcgtaatcggatggaataaacatatgaagaaatgaattataagtcgggcatttattatatattattttataaattattctaagtatttatttaagctaatctatttagctttcgtttttcgtcaataattatttcgtattatcaactttaacaatgaattaaaactttaattactgtttagcaaaaaataccaaagaattaaagtcataaaaatatattttggttggtaatttacagatattaaaaaactatgcgcttctcttttaaaattattataatattattcttatatgtaatgtcgattttttgtataaatatttgtttaaatgagcatttttataaattagaattatttatttatttgtccaggtcgtattaatgccttcaaggtcttcttcatttgatatataaagttaatttatttgtgcggtattattttttggtattatttaaggtaaatatttatattaattattatatgtattaaataattcatgcgaaaataacaatcctccgtgcacttgaatctattaataatttataaacccgtgattagtttataactgtaattaatagcaaaaaaattttattatgtgcagatgtccgaatgttctttttttttgatttgttacattttttaaattattaattgttggattaatttacgatttcgattttttcgattttttagtatttttagtgaattttatgtttatgggcgttactcaaaaaacaataaaaggaaaaaagaatttttttaaattttgcaggataatagaaaacacatagggcttaacaaaaaatatttttgacacttttcgattttttaaatatttttttaagagacggattccaaacctccggagcgtattccaataagggcctaacataagttttatataacgtaatacaaattttagatgattttgatttaattattcgaaataaagaacgcatacgtaaatactcattcttcatattcatttatttgtccattcgaataaattaggcaatattttatgcataatttctgtgcaattaaaaattctttgtttgtaggttattttctataccattt

SEQ ID NO: 31257 - DNA, 573 bp, Heterodera glycines
gggggggggggggggaacgagctgctcccgtttaatacgccgtattttttttaacattttttcaattttgcctgcaaattttcttttaacttccttgaaaaaaatagatggaaaaattaaaggaaaaaatccaagggtcatcccgtttccaaaataacatgtaaaaaacaaaaaaattaaattttaaaagaaaaaagtctcaaaaaatacatttaaaaaatttatgaaattgaaaaaaatttaaattttttttcaattcttgcaattcttccttcaaaaaatttcttttatgtttttcttgaaagaattatgcaaagattttttttaattggcctcaagaatcgagactagtgaaacacatttgtcgagagtatgccatttcgacctctttttttgccgtctatgcattcgactgttgctggggatggtgttggaggtgttcttctgctgttgctgcttcaactcctgttgctgctgctgtatggagcgaaagaatgactcggaggggcgcaacttttgttgttgttgttgcaggagttgacaaattgtcggaaaatggtcctgtacatttta

SEQ ID NO: 31258 - DNA, 1038 bp, Heterodera glycines
gtttttcatgtcaaaatgttgtcacaagactcaatttttttcctcctccaattaaattttgcaatatttttttataaaatcacttctgaacctttgcctgatcacttcatccgtctgctgttcacttggtccatcgcttggcttaaattcgaccctttgtttggccagatgatccaattgggctacacttttggccataaaatttcgcagtttggtccaaacacttttaaatgtgtcattcttggcaatcacttcatttgcactgtttttctccatgaattggtccaatgttgcgtaaatttgtcgataaattttgacagttcgaataaatttgtcgacattttgtccccctccattttcgccattttgccttcttgcctcatgaattatgtgaagaaaggtatcaacaactctgaaactaactttggtaagtcaacacaaaatgttttttcaacctcatgccaactgatcaaatgaccaaatcaaaggcactgatcagaccaaaccaagtcaaaggagtggaggggagagaaagagaggtcgggtcaaaccacaaagccaaccgatcagtgtgatcggacaatgagacgtatggagagaccagaccaatcagaggtcagagagacctgatcaaatcactaagtgacccgacctgatcagacagtatgaatcaggcaaaatgccggtgccgtcgattgagtttcggtcccatcataaactccactactgacagacgaaatgccaagccaccaccacttaccgttcagtgtcatttttggcactttgctcaatttgtgccaccaattcggtgccattgaccgttccgtcgccggaatttgccattagcaaacaagcaatgttattggccgaaacgttctccaaatggaccaacacacagccgaacttcagctggaaaatgtgctggccgaagagaagggggccaagcgaatgggaaacggcgaaatgtgccaattcgacggactcgcggaacaaatcgaaggcatcgagcgaggccaatgcacggagcacctttgaagg

SEQ ID NO: 31259 - DNA, 865 bp, Heterodera glycines
caaggaccaaaaaatatttttgacccccattttcaacccaaaaaaatttttcgaaaatttctagggggcctagctcgaaaattttagaaaattttacatcatgtagtacaccgttcgatagagcttaaaaagctctacaattttgctctaaggcattttttggctaaaaccaacgcctgacgagttatgggcccaggactcaaatgtcccgctgaggccaaaatttttttctatttccgggaaaaaatcgaaaattttccgaaaaaaataccagtcgatagagctcgaaaaactatgttttggaagtgccctccgtttttctgggaaaattcgttaaaaattcttaaaattcaaaaacccgaaaaccgttttttaggcctagctcgaaaaattttgaaaattttcgaaatttttaaatttcagaaaatcgagcttccaaaactatacaataagtctgctgggcacctttccctcagatcaaacgccgacgcggtattcgcctggtactgaagtgtactttttgagcacgcttcagttgccattttctgcagcattggcatttacagttagaacccccaaaccaacggcattctgtgccaaacagtccaacttaaaatcctaccagcaagcattttctgctcccgcttcttcccgcaaagttacaggccaccaaagacggacaaaaaaattttcgggccgtttcagcgccgccggcgctgaaccgtccaccggatcggaatgccgatagttttcctgaatgcgcctcaaaaagttgtaagacccttccaccactttcagacccctcccgacagccgttcgactcaagttagtttttaagacgagttgcaaccattattctatatat

SEQ ID NO: 31260 - DNA, 998 bp, Heterodera glycines
ttccattccttctacaatcgcctttatacatcccattatgagctctaaaattatcagagtgccgaaaatcgcatgtgatctaagcctagaaaaaaatggtctaagtaaaaatcgtaaatacgctcaaaaagcttctcaaacaattttagcgcttccaattccttctacaatcgcctttatacatcccattatgagcgctaaaattatcagagtgccgaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacatcgcctttatacatcccattatgagcgctaaaatatcagagtgccgaaatcgcatgtgatctaagc

SEQ ID NO: 31261 - DNA, 966 bp, Heterodera glycines
ggggcagtccccccgaaccgatgcgcccagatccccccagagaccgaatccttcgggaatagcttccctatagcccttactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttttctatcaaaaagggagatgaataaatttaaaaaaatttttaattcctttttaaacaggccaaaaattttaagcttgtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataat

SEQ ID NO: 31262 - DNA, 1890 bp, Heterodera glycines
  misc_feature (18)..(18): n is a, c, g, or t
tttaaaatggcctacacntggacaaaatttacaatcgcctccacccatagaaatttcgaacccatggttaaacggaaatagccctttaaattaaattccacccaccttcaaattcgtcgtgccaacatcaagtgccaaaattaatggacagttcgacgccattcgaattcttgccaaaaggagcgcatttaatggaaaatgacaacaaaaataaagggttaagaatcataggaagtggaattcttctcatttctgcgaataaaagtaaaaaggataatttgtaaatatttaaaacaaaaatgacataatttaggcatcggaatacagtaaacaatgaaaaatgccaaaaggagtgaaaaatgggaaagtattggacggaataaaaataccagcaaaattctttttccatggcggaaggcaaaatgaggtcataatttaattttgtttttattcccgtaaattcattcactcgccgattgtcctcatctttttcttcgataaatcgtacccttttggcgcttcaagtctgaaaaaaaacaaaatgggaaatggaacttttttaccctttttttgagggagggtagggctacagaatccgttgtgaaatcaaaaaaaaatacaagtaaaactattggaaaatcgggcaggaaggggacagtgacgcaaaaacttttgaaaaattgtggcgtaaaagttacaaatattcgttgcttttatgtcggcttcccccgcctaccggcgccaactatgggagagagtaagtaaaaatgtagagaggaaaaacataggtttgttaaatacagcacaactcacttgtacccgtacatctcacaccagccaatcgggaacagttcacgagacctaaaaaatttccgaattttttcgtgtccccatcatccgttccccggccacctgtagtcgaacagctggtccatttcgctctcccatccgtcaaagtgcacttgcagcagacgaccgcggatcgcacaaatggtggccggacagaccaagttgggctcgcattggtcggtggcctccaatttggcaccgacctgaaaatttagtatagcaaaaaatgttaaaatacagacaaatttggcaaaataccccatttattttactatgaaaaagcgtaccttaaaatactgaagttttgccgccgaaggaagtgggtcctggcaatgaaaaagatgaaagaaattcaaagcgtaagtgtaaatttaaaaaatatgcttacaaaaagtgcattgggcgccggaatcgcttggcactgccgcaaataatcgggccacgaaaaatcgccttcagtatctaaaaatgtgaacgaaaaatgagaattaaaggcggaatggtatgatggaaaaggagcattagcatttgaaaaattttcaaaatattcttttggaaaaatatacccccccacccccccgcgggagccttcggcccccgcccccccccgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaacattttttctccatcttcctttttgatactaaagcatcagagtgctaaaattaagttgtaaataaaatttggtgcgtaagtagagcactttctgaaaaaaatatttagaaacaaaaa

SEQ ID NO: 31263 - DNA, 1301 bp, Heterodera glycines
  misc_feature (22)..(22): n is a, c, g, or t
  misc_feature (329)..(329): n is a, c, g, or t
caggcaaatcgccatagtatgntgatggcgctggcagcgcgaacccgctctccaacatataatcatcatctgtatcactttcgggtaaaggagcggcagctgcttccgcaagaaggtcccgcacaaccggtcgccgtcgttgtatatcgtatcgccttttctcccactgctccagacgatcagctctccgagaagctctactcggtctgggaggacgttcaggacgaggcggaggactccctggcggagaagggggagcgggaggaatctgcgggggccaaggacgtcttccgggtggcggaggaggtggagggggaggacttgctccnatgtctagggcgtctcccaggcggcgggggtggcggcgggagccgcggtggtgtgttcacaacttcaccatcttcatcttcaccacctctcctcatcaacacacttatccctttggtgagctcaactttggtcggtctgtccgcaagctcccttctcattttcaaatagcgcctaagctgttggttgtagtggacaatctttgcagatggatgtgttcgttcggcccgggcacggttcaaatcgtgccgaacagcatccaaattgatgtcacccgtctccgacatggaggtgagaccacgataaatttcttgtgggacaagtaaaaatttattcgccatgaaatgaatgaatgaatgcacgaaaaaaaaatggtgcgtggtatttatgcatttttggtggacacaacagattttgccacttcaattagaatgggtgttaagagggcagcgaacaatccgccaaatcctgcgcctttctggacaagcacgcgcctggcgccccgctcacttctcgctctgctcacccgacgtacagtgtccgcatggggcatcaatcgtatcttctgacgagctgacaaacggaagcgggaagcaactatgttcaaacaaatttccaccagcgctagcagttgctcagtgtttgcttttcgtagcattttcttgcatttcttcgctgagcgagttctggccaatgcacagagccaacccgcattctcttttatcagttcgccaacctttacctgctgctgtttatgccgctccatttttaggaatgaacacaactgtcccttcatcttcttcctgctcatccttaaatatgttggttcgtagcctcaatgatgggtccgacgatgcatgcatatcgatcaacaaatagccatagggacgggcggtcgcttttcgatatgcgtcaagaaagaagtcaagctacacggaaagagctgaacacccaatgttgcggatggacagcag

SEQ ID NO: 31264 - DNA, 995 bp, Heterodera glycines
tagaaaagatgagagagagagagagatagaaaagaggagagagagagaagagagagagaaagaaagaggagaaaaagagaaaagaggagaaagaaagagaaaagaggagggagtgaagaggagagagataggaaagaggagagagagagagagagaaaagaggagagagaggaagagagagagaaagaaagagaggaggagagagaaagaaagagaggagagaagagagagagaaagaaaagaggagggagagaagaggagagagatagaaaagaggagggagagaaagaaagagaggagagaagggagagaaaagaggagggagagaagaagagagaggagaaaagaggagagaaagagagaaagaaagaggagggagagaagaggagagagatagaaaagaggaggaagagagagagagaaaaagaggagagggagaaagaaagagaggagagagagagagagaaaaaaggagagagatagaaagaggcgagagagagaagaggagagaaaggaagagagaaaaagagaaaagggagaaagaaagagaggagagaagggagagagagagagagagagaagaggagggagagaagaggagagagagagaaagaaaaaaggagagacaagaggagagagatagaaaagaggagagaaaaagagaagagggagaaagaaaagaggagagagagagagaaagaaaaaaggagagagagagagaaaagaggagggagagaagaggagagagagagaaagaaaaaaggagagagaggaagagagagagaaaaagagaagagggagaaagaaagaaaagaggagagagagagagagatagaaaagaggagagagaggaagagagagagatagaaagaggagagtgagaaagaaagagaggaggagagagagagataagaggagggagtgaagaggagagagatagaaagaggagagagagagagagagataagaggagagaggggagagagagagaaaaa

SEQ ID NO: 31265 - DNA, 1511 bp, Heterodera glycines
  misc_feature (19)..(19): n is a, c, g, or t
  misc_feature (1501)..(1502): n is a, c, g, or t
tttacatttcagatcttcntaattttgtaaactgaaaatgtgaaatttaagctttttgctgacgatcttaaggcctatctattctctcaaaaaatactatttctccactccattctttcattaataaatttcggaattactgtgaattaaatggccttaaaatcgctcctaacaaatgcttagtttcacatcttgggcctaaaaaccctaatgaatgttactttataaataatattccaattttaaaaaatgtaaaaggtgaaccagttagagaccttggcatttatttttcaaatgacttaaaatgggaaaaacacatagaatatatcactaaaaaagcaattaggacatcttttactttactcaaatcacttaaaacgaaaaacccaaaaattcttataaatatattcaatgtttattgtcgatccattttggaatttggttctccggtttttaatccatatatgaaaaaagacattgatgctcttgaaaatgttcaaaaaacttttttacgtattgtttttagacgtaataataacaaggatgatatacccggttataatgaacttctccaactttttaaacaagaatcccttttaaaacgcagaataaaaatagatttaagactcttccatgatataattttggaaaagatccatattcagcataatgattctttttcaaaaatatattcaggactgaaaaacgattatattataaaaaccgcttattgttcaaccaatgttcggtatcattcgttttttattcgtacctctcgcctctataggtgtttgcctaaagaggcaaggttacttaattccattgagtttgctaaacttcttgacacctatgatgttgatgctttaattttgaaaccacctcatctcattcagtgaccaaatttatttatttattttgttatttatgtcggtgtcacgcttggcgtataaattgattgattgattgatttttatttttcattttcactattcttcttttttgttctatcgatttgtctttatattattactacatatccagaggtgggatttatttatgctaaaaaccgccaaatatgcaatatatgtgtgccaaaagccccaaaatatgtgctaaaattaaaaaaatgccaaaatattgccaaaaatagaattagttgatgttgtttctttaaatattatgccataattattattattttaaggagcaaaataaaacaacaaaaaataacttttagaactcaataaaatgcgatggaaatatctgagctttgacttggaattttgcaagatttttaataaacaaaaaacattttaataaattcacataataaaccaaacttcttaaaattttaataatggaaaatagtcaataaaaaataatatcacaaattatgattaaatttttaaaactttatatcttctatcgcaataatatttattatataataaaaaacaaataaacatttttcgaattatatatagataaataccccaaaaannatgaataaa

SEQ ID NO: 31266 - DNA, 1765 bp, Heterodera glycines
  misc_feature (69)..(69): n is a, c, g, or t
  misc_feature (85)..(85): n is a, c, g, or t
  misc_feature (95)..(95): n is a, c, g, or t
  misc_feature (99)..(99): n is a, c, g, or t
  misc_feature (144)..(144): n is a, c, g, or t
  misc_feature (1693)..(1693): n is a, c, g, or t
aaaaagcaaagaatttacttttttttaacaataaaaaggaaaaatgggtattttaatgggggataatantgtgaaaataatttcnccgcatttgnttgnttgtttcttattcattctttctttcttcatttgtttaaaaatttngtgtgcttcttcttgtgaataatatttttttattcctataaaataatttattaatttttaatattttttgtttatttttgccaacttcctgagatgccaaatttctttctccatttgtaaattgtccgaatgtttatgcctatttcttctgcgattttttcttccaattctcgaatttcaccagctggtaaaccgttttgagtgcgcttttctttgattttgtcaaattttttaataagcatttttcgttggcgatctgtcaaccatttttgattgcctaaaaacgtaatgctgaattctgctatttttgtgggtgcgtgaaaaattttaagaaaaaaatatgtcttacccaaaccaaatttccttgtccaatttttaatttgatgaatcgtcacacccaattcacttgcaatttgttcccgctttttgtttttctgaaggattgaattttgaatcagtatcatgcaactgatttgaacaaatttaccaatattgatattgtaattttagaaaatttaaagaattaaaaagtgcatacctggttcaaactcccttttctctttatatattgcttaacaattcttatcttttcattatctgataattcacttcctgtaaatattaaaacttattttattttgtttttattaaagttcgatattttgaaatgcttagacttgaacctggacctgaattttctggacacaaatccaggtccaggaaaatccgggattgtcaaagcctggacctgattaaccattttttgataacttgaagtaaacattagtcacctaaataataaatttaaaatttcatccaggatagctaggattatcatgcctaacctagaccttgattttatatttgactggacctgttcttttctggcaaaaatgcaggaactctaggtccagaagaacccaggttgccgacatggacttggatctgtacccaggaaagtccaggccttggccagatccatgttacactttaattttttaatgtttacgttttgcaattgttcttttgaaggaatttttcacagatttagttgccaattttcctttttttgacgacttttcatcactttcttcgtcagtttgttcatagtctgaacttgcggtccatgattcttcatctgtatccgtgcattttttattgaatttatttaattatattaaaattttacccgatttattttcgtctgaactttcttcatccaaattctgttcatcattaccaaaatgttcatcattttgctcggatttaattttatcaaattcatttggttgtgcttcgttttttataaaaatattttcttcgtcattttcctccttttttatttttatttttccataattttttggctttccattgttttcattttgaattgtttccgttttaatttcaatttctttagtttcggcagttcgcaaaagctctgtttccaaagttaaagcatcctttggcccaaccttaattcaaatttcagactaatacacttaattttatgaaaaccttttcatttttgctccacaatttaagccanaaaaatcaccgggaaacgcttgacatttgcttggtagggtaaaataatggaaaacaaaaaaataaattttca

SEQ ID NO: 31267 - DNA, 947 bp, Heterodera glycines
taaatcaaaggacacgattttaaaattttcgagggtcgtgattttgctctccatgtgaccattcctttataatttaccatttttttcaaccaagtataactttttatgtacaagtcgctaccattaaattaaaattcggcagtaaattttgtgctcttttaatgagcttattcaaaatgtccatggaaatttttccacccctaggaatttttttcgaaaatttccccgttttttgtcacgtcactacgaaggagtgatttgaacaagttgatgtaaaaaacttttgatcaggctaaaaagataaaaaaattaattatttgagatgtttaaatgaattttttttatttttgaaaaaatgctataaggtgtttttcacgtgagtcaagactttctgcccctttttgagtaaagtctgatcagacgacttattcacgagaatgataaagtggaatgaaattattttgcgatgtatgaaaggcccatgtattgtaaaaataatcagctaattttcagtcgaaatttaaaattttaaaaatttaatcatcttggttcaggactttttccacaatgtatctgtgtcacttcatttttaggctccaattttaatatattcgcgttttttaaaaatttatcggtactgtcgaaatcacttaatgtcgaattcactaaatgctgtggatacatttaacatccccttttacagatttaactcaaaatataaactgggcaaaaaattcattccctttgctgggagggtaacaaaattgtggaatcaactcgacaaagaactaataaaaacaaattctttaaatcaatttaaaaccaaacttaaaagttcactagggtaatgaaaccggaaaagctagaattataacaaattcctaagtgatttggtattttttaaatttattttttttcgacctcatttgactttgacctcaatttat

SEQ ID NO: 31268 - DNA, 927 bp, Heterodera glycines
ccttaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctctctttttaggacaattttctatctcgtaaccccgatgctaatccgttccggagagcctcttcaaaattttttacggttaccctaagagctgcggaaattgtgaattattctca

SEQ ID NO: 31269 - DNA, 1083 bp, Heterodera glycines
taaataccataaaaatatttacattggcatgagaaaattatttaattgttttataatatatattttacaatttgatgtgaaccattatttttgtgtgatctcttactcctgtattatttgatcatctattcatttttgtacctcgagctgcagtgtaagtggcctatgcccttctgtggtagtttttatttgacattaaataaataaattaaaaaagcaccttttttaaactgaaaatcaggaacgttcctggggcggggggggggggggggtaaacggtcccccatgactcatccacattcgaaattattaaagaaggaaaattttgtctaaaaaaattttcgatttcattatttgtaccccatccaagacattccttcacccataccaaaaggcgctgccgcactctgatgtaaaagtgccattgaagcaattgttggtcctcaatgtaccgggcattgtccacggaggcaatggcctcgcgaaagtccgcgctttggagtgcttccaaaaagaacagacactgcgggaatttgagcgtacgcgcgtattcgggccgtttgaagtacagcaaatacttcaaataattgacgaaatagtcctctttgaagtagccgcgctgggccaaatctgacaaattattaaaaaccaattgtcagtgtcaaattgtgcgggttgatgtggcagaatgtcacgacttaaatttggctgtttgccattcgtgcaaaattaacgcacagttgaggtaatgcgggttagcgagtgcctggacgaattcgcactcaatttcaaagcgtcgcttcgcttcttccgccgtctcctgacgcagctgttgatggtgcaccaaaaattggcctgactgactcgctgattgtgaggcggagagttgctggccgaggtggggaaaagcgccggagggttgctgagagtgggagggagggacaacgccagaggcaccgacgaaatgctgcggagggaaagtgccggaaggaacggaagacggaacggctgcaaaaggcaaaatgggaaaaagcgggccatttactaacagtacctcgcgagtaatccagtgcgtttgttgaa

SEQ ID NO: 31270 - DNA, 1104 bp, Heterodera glycines
tttcattcatcaaaaaaataaaaagattaataaccgaacaattcataaagaataaaataattgaagagtaagatatattctttgcaaattacttaaaataataaatttttggaatattataacttgaatgatagcttgtcggcatgctaaaattataaaatgataataaatcaatcagactgaatcttgcatgaataaataaattttattaaaaaattcttaataaataaatacagaggagccacaaatatttattcgttagaatagaaaaaaatcaaaaacgctcaaaagaaaaatgttttactgtagtacgaaaatagttttaatttttctatatcagttaaatttttgaataaacaattactataacaaataattaaatagtgcattctaatgaaaaaaattttattttactatactatattaattttaatttagggatatcttaatttcaagaattaaatagttaaattagaaaatcggaatggtgaggaaaaaaggatacacgacgaactatatggggaaaatagttaaaattttgaacttcaatacaataatatttgtaaataagaatgtgaaaattcaatcaattaaataataaaataagaaaataaatataaaaggtttatattcctaaaatgatatattaaaataaaattttgctaatgacctagtgaaaaaaaactttgtgtttctttgcgaataaaaaaaacattttagatttcattattagataaaattgtagttagaatgcgaaaatttaaaattttaaaaacaattaaaagaagattatataaaaaattaaattataaacttaaaaagtattagaaaaggtgcccaagtttgatttctccaaaaattttattaaatgagatctaaaaaatatattaaatctatagaacacatagttatttgttatagcaccaaaatttatgctgtcgtaataaaattgaaattttttaaaagttaaaatttattggatttttacttttagtcatagcaattaattgaaaacaattcaaaattgttttcattggttgaaactaaatgaaaattataaaaaattaataacaatataaaattaaaaaagtgctaatcccatga

SEQ ID NO: 31271 - DNA, 1463 bp, Heterodera glycines
tcagcgagtataaatcgtataaattattgatcatacattagtattgtagagtattttgtgttctttttgattgcttaatcattatttccataaatttgccaattccctaggaatttttttttttcaaaaatttctccgtttttcagtgtattttggggtgttcagatcatcatgacgaactgatttgttcaagtttgaagaaaatacttttgatcgctaacataagcaggaagttttcaggaatttgactaaaattgtctgttttatcaccagctaccaaaaccatgaccatgacagtatgatttacgtattttattttaaaaatttacattcactgtcgtaatgtccactgtccaattgtccacttctgtccatatgactttcattgtcctaatgtccactgtcgaaatgtccactgtccagatgtccactgtacaaatgtccgggacatattttggcgtttggccatttaaaaaaatgttttttttttcgccaaaatttgcctactgtagtttaaataaattataccgtaataataaacataaaaattaaaacaagaaattccaggcctgcttttcttcatgggcaaagaccgtgatcagctgatggtggagcttgttggtggtcgaatcagtttgtcatttgaccttggctcagggcttggcaaattgttgaggtaaggggctataaaaaaatttttttttgaaaatttattaataactttttccagcaatggccaacggtacaacgatggaaaatggcatcttgtgcagatggatcggcaagaacgttcggccaaactaaaaattgacgacacggataaagtgaggaagaaataattttttgcatattttttgtttattattggaattttaggtctcaaaattttcttggaattggaaagataattgtgttttctatgattaaaaatttaaactttttactcaaattacttgatcaataaacttaggtatctattttaagtcatatttttcttgaacttatttgcgacttaccccttccaaaaaaaaaaagatctaaaaaatttttaaataattaatttaagcattttagttggtacttccccccccccccccctcctccctccgaaaatgtagcaattttttaaacaaatctagacaagagttcaaggaattttcccaagcttggtgtatttgtgcgcttattagatggtggtggtattttgtaaattttccctaaaattttcacaggttgagggcgagtcgcctggctcaatgttcgagatgagtgtttccgatgtgttcttcattggcggattgccgtcaaacattgacgcacggtttattgtccacccgttccatggctgcatgcgcaatttgaaagtgcgtaatttcactaaattgggttccaataccgtatattccctctaaaacagtatcgaattttgcgctaataatgaaaattttgtgtcaatatcgtaa

SEQ ID NO: 31272 - DNA, 1222 bp, Heterodera glycines
  misc_feature (25)..(25): n is a, c, g, or t
tttttaacaatgttatttcattaancaggggaaagttttcacaccaggaatttgtatggcaccgggaagttttggcactatcttaaggatttaaaaataaaaatatttaattatctaaaaatgcaaccatctaatttggggtcttggtattttcgggtacaaataagacgggtattcgggcctaaacccaaacagaaactggtacacgtctaaccctacatttagagtgtaagaattgactaaataagattgccaagttcgcaatttaattttttttttaaatccaagaagatataatttttaagcccagggattatttgaggatgaaatcattaatttagtattttttttagtttttcaaattaatatcagtgcccaaacttcatgttgacaattttatttaatcatttcattctcctgtgtttttacagttccttctgatgtgttgtcaaaagatgaagtgattgccgtttatcagttccatacccttccaaatcgtcgtgggatattcaacggatttttcccaatgccatttccgactaatggacggatttctgatcggaaaaagggcacccttttgatggacattgaaaaagtatccgaatttgcacgagaagaggttgaaagcagtcggtatagcgaaaaaatgtacataaatggacttccatggaaaatatatgcagaaaatgataaagatgaaagcactgacaataagttgtacatttttcttttgtgtgatgtcccagaggaaggtacaaattaaatattaattaataataattacaattaatttccattaagacaaacattggaattgcaaatgctcgggaaatgttcggattgtctcacaaaagaacggagtgttgggtttcaaaaaagtattcgttgaccttgtttttgataatgagaacagctgtcaatgtgtcaaatcgatttcatttgcagtgagtgacaattaaactttcccttaattgacccaattatggaaaattaaggaactgatggacctgaacaatggattttacaacagagaagacgacaaagtgacgttggccattgatgtcacagtgaaagatgaaaaaacagagaactttctttcggatcccaacaaatccaatgggacaatttcgatggaaattgaaaaagtgtcggaatttgtgcgagaagtcattgggagtgaatgcgaaagtgaaactgtgcacatcaaaggattaccatggaa

SEQ ID NO: 31273 - DNA, 1008 bp, Heterodera glycines
tgaatttgttcgttccaaaaagcaaatttgggacagaaatggcaccaagatggagctgtccattgataatgaccaactgatttgggatgttttcgcccgagaaatttggccaatttttgcgaccaacattcgcaatttgggctttaccagtgccaatggtttggacaatttttgtcgccgcacttcaccaacaattctcactgatctcaatcatctgaattcaatcaattccaattttctgttgcctgatgcaattgctgatgatgggccaaatgcttctgccggccaagtgttgtccaaatggttgcacacgccgagcaaaaatggacaaccgaagcgattgcattgcattgattattatgatagatcaaatcttgagtgggtcaacaatttgaaggaggtggccggccatattttgactgattgattgcctttgatttgcgttttctttttgtttaggcatttccccgtgccacttcttccgccagtttcattattcgaattgatcatgtgagaaaaatgccaaatgctgagccatttgaattggagaacgaacggaccaaagaaaagctgacattggagaaagtgtcacgttataatgttgttaatttgctgttggagcgatgtccaataattgttggggagacgacggcggcggttcaatgggaaaacgacgaaaattgggacgccaattatttgaactatgtcaaatttgagttgtggcgtggcattaattgcattgggtgagagcagcaaaacaacggaatttgattttgttgaaaaataaaaactcaatttagaccattatcgccaccagcggaataagaataagccgaccaaagcaaccaaaatgtcgtctgagtgtgcggaagtgaattaattatatttgagaaatggtcgacgatctcacaaattacaaatggatttgatgcttattctctctcaaaaatgcttttattgcttcctcaacatttgcttgttttattagaatttttgttacatatactt

SEQ ID NO: 31274 - DNA, 1066 bp, Heterodera glycines
ttcttcatataattttaatttattcattaatttagaaccctcactagttccaaatattaaaaaaatattacatgtaaatatggcgacatatattgtttttatatatagcatataaattaatttaaaagatttcagcaaacgtaattaatgaattttaaaactaaaaccataattaaaataaatatattttaaaatgtaatttttattcaataatttttttaagaaaggttataaaataaagaattaactggtaaaaataatttattcaattctacaatgcagaaaataaaataaagcattattgagcaaaaatttcaaatgaaaaaggttgatttattagcaatataattagttaaagcgaagcaaaaaataaaaactatgaaggattgggtacaagaatttagtaattatataaaaatgaatgcagcaataattaatcattttctaactatatccaaacgagaatcaattttttgaaaattaaaaaatcaataaatatctatttttataactatttaaaaaaagaaattttcctgcatggctttatattttttgaatttttttatctttaaagttttttcaaacacattattttctttattatctaatccatattttaattaaaatattctaacatttaagttttaattgctatatgaaagcaaaattattatttttatttgatatccaaaatgaatgtgaaaaagcctaatacaaaattcaaatacaattttcgaatgaagagacaaacataaaaaagataaaattgacaacaaataatatttaaatggggaaattaagctaaaacaatcgtcatgaaaaataataaataaaaggataaatcactatttatcctacgggcgccgcaaaactcggcgccgaaattgtcgattttttaaatttgctttatttaaattaagtgtttaaaatttacttacctgtaagtattttcaacttgatcttcgtccctggatgatttgttgttggtaccgttgtttattagattatttataatattcataagcatgagatcatttgtttaaaaagccaaatttgtgcctacatt

SEQ ID NO: 31275 - DNA, 1770 bp, Heterodera glycines
cagtacggtatcattgccatgaaggtcaaattaaaattagaaaattaatacatttttaaaatttatttcagagaaaaattcttagccaaatgacaaagaatgactttgccattgtgggagaaaatattttcaccgcttttttggaggaacacgacaaattagaccctgaggcggtggaagaacttaaaaagcgccacaatgaaatttttggcacggattaagctcacaaatgatcaattgtttctagggtgaccaattcatttgattgtttcaattacatattttcattttcggaattttggccaatttttctccatcgatcactcattttaactgctggtcgatttctttaagtaaagaacgcagaatttcttcatattcggtatgcaaaatttgtgcaaaatttttggtagaaacccctcgtcatttcgtcccctaagccaaaatgagtcatttcgtccctcgcatgggcagaagcccaaataggaatcctattttggtggagttttaaaaatttcagatttttaattcttatttctagggtaggtcactacgggttattgaccggtacacccggttttcggtttcgtttatttcggtaatggaaaatttttttgatttcaatttttaagtgttggctctacattccttacattcctttagtcgatatatccccttgattcaattaattttgggataaattacacagattttgtctaaagaatgaccaaatttattgatttatgcaattttttaagaaaaaatcgtttttttttttggggggggggggagcggcggtgccgataggcactgccgggagaaatttttttatgaattttgttagaaattagccaaatttttcagaaatttcattcttttggatgaaaatacgccctaaaatcagaacatttcttagaaataagaacataaagaaaccctgcattaatcagataaaaatcaaataaaatgaaaacgtcaaccggtgtcgaactcctaacttttttatttaattttagcaataattcatttgaagaaataagttaccgtaaatccgctatttgaaggcccctctctggtagaaggccccctccaattaaaggcccctttttggaggggttgaacaatagaaggcccgggccttcaaatagcggatttacggtaattaatttttctcgatttttttggaaatcccggtcacgtacgactctactaaaaattaacaaattttattatttgtcttttttaataccgtattcagaccttttagaggtttttttttactaaaatttattaagtttgaagaaatttttggaaaaaccattatatttggaaaatttatgtgcatatttttgcaattttatgtccatattcgtgattttatatccatatcattggaaaccctaatcatatcgactcatacacattaacttgttctatttgttccccaattaggagctaattgtatttttcccaatgaatcgtttttgtactaatacccagccggccaattttgggctccaagtacaattatgctggatttttatttagtaatcagaacgccaaaactttgcaaaacttaaaattttccgggaattttcccttgtaaaaatagaagagccgatctcgagatagataagaaactttcagaaaacaaaagagaattcgatagaaaagaccaaaaaattcacttaggcaaaatttcaataaaattggtcaataggaaaaaatttttttcaagggcaaacatttcaataattttaattctttttt

SEQ ID NO: 31276 - DNA, 1327 bp, Heterodera glycines
aacttctgtggggcacgcaaaaccctcctcaaactcccgaggatttgactaattttccttctatacaaatacgaaatgtaattgcattgcccggtgttccacacttttgtgagcaaaattttcgtcacttgaaggtaacgagcagaagaattaacgccaaatttaatccaaataaaagtgaatttgtaatagataatcaaattgctgttttatttttcgcgtaatgtttcaaataagtaaattcgctttgagggatggagaaagaagccaactaaagataaaaaagacagactcggagatagaaatgagatgcaagaaatttctcgctttttaatactattttttaattttaggactacctattcccttcgtcacttttggaaatgtttacgaaaaatttatacttaaaaaagagtgaaattcatttacaacaaaaactgtcgcaattggctgccaaatatcaaaacgtctcaattgggtcgtatccgaccatggaaaacaagtaaacttgaaagctttgtgtcgcagctttatttacctttccgtcagttattttaaaactcgtctaagcattgaaagcatttcgaaggaattaggcaatttggcttatgaagaattggcaaatgaattttcaggtaattttacagatgaattaaacgtaatttccaattcattcaaagagtgggtggtgaattacgatcccgaaccgtgggaggattgtgtccataaattggacatttattgcgcgactcaaaccaaggaattttctgtcaagcttttcaatgccatcgcaacaattgacgaaattttggacaaatatgggtgagtgcatctcaatctaaacatcctccccctcccccctcagctctttggatcaattgacgatttcattcaatggaggcaaagattgcacgcttattttgcatcttttccgcatttgtgttcctaaaaaattcgggaaagaaaagcgaatcgaagggtttttcgtaggaggcgatgagttttgcgaattaattgcatttgttcggaatattttcccaaagtacttatgctactctttcttatctttcataaaaaactcacttctcgttgtgtaaatactcattggagtggctcgagatgataggggaattgaagaaggtattggctgagctgccagaattgccactggacattgatcctcaagttatatagtactcataaagtgcattagagccggaatgatttcgttcccatcagaggcacggattttccatttcccactttaaataattaaataaataattaaattatttatcatttagtttaggctcaactcaaaaaaaaa

SEQ ID NO: 31277 - DNA, 1106 bp, Heterodera glycines
  misc_feature (17)..(17): n is a, c, g, or t
  misc_feature (40)..(40): n is a, c, g, or t
ggtgtagtacatttatntggtgctctcatttttgggcgcnggatctataaaagtatctttgcataatgcacaatgcttaagtcctgatcaggccaattgttccttgtataccaaacgaagacgttctgtggtgtagtaacattatttggtgctctcattttttggcgccggatcttataaagtatctttgcataatgcacaatggttatgtcctaatcaggccaattgttccttgtattaccaaaacaagacgttctgtggtgtagtaacattatttggtgctctcattttttggcgccggatcttataaagtatctttgcataatgcacaatgcttaagtcctgatcaggccaattgttccttgtattaccaaaacaagacgttctgtggtgtagtaacattatttggtgctctcattttttggcgccggatcttataaagtatctttgcataatgcacaatggttatgtcctaatcaggccaattgttccttgtattaccaaaacaagacgttctgtggtgtagtaacattatttggtgctctcattttttggcgccggatcttataaagtatctttgcataatgcacaatgcttaagtcctgatcaggccaattgttccttgtattaccaaacgaagacgttctgtggtgtagtaacattatttggtgctctcattttttggcgccggatcttataaagtatctttgcataatgcacaatggttatgtcctaatcaggccaattgttccttgtattaccaaaacaagacgttctgtggtgtagtaacattatttggtgctctcattttttggcgccggatcttataaagtatctttgcataatgcacaatgcttaagtcctgatcaggccaattgttccttgtattaccaaacgaagaagttctgtggtgtagtaacattatttggtgctctcattttttggcgccggatcttataaagtatctttgcataatgcacaatgcttaagtcctgatcaggccaattgttccttgtattaccaaaacaagacgttctgtggtgtagtaacattatttggtgctctcattttttggcgccggatctttataagtatctttgcataat

SEQ ID NO: 31278 - DNA, 566 bp, Heterodera glycines
taaataacaacaaataaaccggggcaattcgcattaaaacatttggtaattattagagctcgcaaaaaaaggcaccaaaaatcgcgaaaaaggcatgaaaaaggcatttaaaattttttattacggattttagggaacaaaacacgtaaaacttaaacttaattttggtcatttaaatgattattaaacattttataatgtttttcaaataaggaaaatttttaaacctaaagtttttgatcaagaaaaaaaatgaaattttggcgatcaatttttggagaaaatttttcaattcttagggatgtattttctgaaattttttcgggtcatttcttaggggtgtattttcccgattttattgcatttttaatggaatttttcggaaaaaacgccaaaaaaaggcatttaaggcacgaaaatcccgaaaagggcaaaaaaggcataataaaagtaaacgtagaagcttcaaaccaagtggaaacatcgttttttatgcttaatatatcgaaactagtgcgcagaaaaaaaaggcatatgcctcaaaatgcgagctctagtaattattc

SEQ ID NO: 31279 - DNA, 1262 bp, Heterodera glycines
  misc_feature (85)..(85): n is a, c, g, or t
ttttgcagttcgatcctgtcaacatgtcattgttttatgtgagtatgatgagtgattaattgctctctaaattaaaagcttttcntttatctagcgcattttcagcagcttcaatgacatctccctcccggaattcctcgaaatgctcgacaaattgctggacatcggacacctacatagccaaattgtttatttagaaatattttctgattaatgtaatttgcattaatttgtattgtattaaaggaatcgcatcaccgtttggcttccgaattggtcaccggaatggtcagcggatcgaagctgtggcagtacgcaaaagtcaagaaggtgcaggagcggctggagcaacgattgaccgacacttttttgggccttacggaagaagtcgaaaagaattggggcacggcgttggccaccattgttcgtcatcattttgtcagtttaatcattagtaattatttcatcgtttagttcggtgcgtgtgagccgcgcgtcactaattggcttatccaaatccttttcggactcgcaaagcgacccacagaaataagcacacaaattaaaacgtaatttgtttgctttcctcacaaattcgttcctttttttaatatttatttaccgtttaggcgtttatatttgctacaatcgggccttaaccaggtgcggtaaaagacgacattctttcatttttttaatgccatttgtcttacattgtttagtatgaatggcgaattccgaacgaatggcgccgattgtttgaactttgcatggatcatgtcaacggattgggctgttcctatcaaaatgtccgcttgcgcatcggaaggtgaacaaaatgatcaatgaaatttgggataaatggtgggcccataaaaattaatttggcattccattgaccgaaaaatgtccgaaaatggacccttaagaaactgaccgcaaatttccgattttcagcaggccgcaaatttcatataacattttaatttcctttcttcagctgccttgccaccatttcatcgtccgatttcaagaaagcgcttgtcgaggcgaacggaggagaagcgaacaccgacgacgacagccaattgaaacatgtcaccgttgaggaagtgatctcgcgcataaatgccatggtaacgtttgttgattgaatttggtggcgagaataccgcgtgggaaattattcaaattttatcattatccaatcagtgtgattctatttcaacatttttggggggattaattggttttcctataaa

SEQ ID NO: 31280 - DNA, 1140 bp, Heterodera glycines
  misc_feature (44)..(44): n is a, c, g, or t
ttttttattgatgcattatgatcagagcccgcttttttattgcncttaaaaaatgacaatttttaataacgattctaatttatggaaaaataaaaaaattaaattaaaattgtgaacaaaaataatctaataaaaagatatttttctttaacttagcaaaaaaaataaataaattattgcttgaagatgaattcctggttcttctcagttctcgcctcggtcacggtccaagctttagaggtaacagcatttcttggtcccgcttttccccaaaattcactatccgttcagctctacttttcaccatagaaagcaacaaacattcaaaatagtagttaaacgccaaaataatgtataattaattgtttttaaaggtatagtattgtggctcccgtggtgggccgaaggacaaaaagtgcaaaatttgccaaatttttgacaaaatccactcataacttttcttagactcaaccaaagtgcacaatcttggcatcatacgatagctcttgaattgcatattagcttgctaaatttaaaaaaaaaatttttaagtctttcaaaagttatgacaatttttccagttttttggctagatcacataataaattttctgaaatttagcaagctaataacgcatttcgagtgctatcgtattaccaagattttgcaatatggttgcgcatgagaaaagttatgagtttatttagtcaaaattttaccaaattttgcactttttgtcctttgacctagcacctgtggctccatgtgacaattgtgacgataatacctatgaatttccgagctaaaattgtatttttcgtgcatttcttatcaaaacaaaatgtgaagaaaaatagctaaataccgtatttcttcgattatacgcccccccccctcgaatggaaccccccccccctcgaaaataagccccctttggaggggggttgaacaatagaagccccccccccctcgagtagaagcccccttcaaatataagccccccccccccgaaaattttaaaatttttctaaatttttaaaagtttcaaaaaaattttttcacagactcgataattatattgcgaatttgataacatttattaaaatatttcttataaattttaattttgaaatttttttg

SEQ ID NO: 31281 - DNA, 1161 bp, Heterodera glycines
  misc_feature (146)..(146): n is a, c, g, or t
ggttcccggtcccagatttgcaaagcccaagtctgggccccggtagggtcggcccaaccgggaaaaacatgcactggtagaatgtgagtcgagcaaaaaatcaatgagcgaaatggggaaaaggaaaatttttgataaaaataatntaataatattattaaagttatattttcaaatgcacaaatgttctagtggttaataaaaaaagcagccttttttgttgcaaatttgttaaaaaattgtactcaaattttcaaaattttcccgacggcaccttttggcaccgccggacccacttctttcccaaaagttttttggaaaaagcgtgccgaaataaatgatgtagaaaaccaaaaaaaaaaggttgtcgattagggcggtggtatcccctcaaaaaaaaaaaaattctgggatcgcccctgacctctggaccacaacatcttccctaattataaaaaacgattcaaatcccaaagtttggcgaaatttggaataatttctgtcaacaaatatattaaaacttcaaagattttttacggaagtgccgacaggcactgcatccttgaaaaataccgaactttctgaagttttcaggaaatttttttcgattttgcaaatcagggttggcagatgaaaattttcaaaagcctcattttgagtcaaaaagcctcatttttacaaaatttattcaaaacacgcttaatatgttcaaatgattgtccaaaattttcagtaaatttttttgaaattttaagcaattttcttaatttttacagtcaatattaaaatggtatattagatccttctcctgacatggacttattccaataaaagaggaaacatttatttttataaaaatgaattttttttaatttgttgatttgatttgttaaacttatttaatattaaattttttgcccataaatattttaaaatttgtcactttttctcaaaaaaaaagttttaatgtttttggtattaattaacccacaaaattctgcacagatttttacgtttttttattatttttataaatataaaaattttatacaaattaaaatatgtaaaaatcgatgaataggcagcaattaagctgctgtaacaaatgtaaagcttattctttatacaaaaagattcatccatttatgattttataataaa

SEQ ID NO: 31282 - DNA, 1491 bp, Heterodera glycines
ttttttttttttttttttttttttaaaaaaaaaaaaaaaaaaaaaaacaaaaaaaaaaaaaaaaaattaattttttttttttttctcttttttttttttttttttttcttttttttttttttctttttctttgggggggggggggggggggggagggagggaggggcagcggggggggggagaaaataatagaaaaaaaaaaagaaaagaagagtaattatttttttatttttatttttttatttttttttttatataaaaaaaaaaaaaaaaaaaaaaaaaaaaaaaaaaaaaaaaaaaaaaaaaagagggggggggggggggggggggccccgccctcttttttagaagaaaaaaaaaaagaaaagaggggggcgcgccccccccctcttttttttttttttttttttttttttttttttgttggggggggagagaaaaaaaaaaaaacccccccccccccccccccccccgggcggggttttttttttttttctctcccgcgcgccccccccccccccaaaataaaaaagaaaatataaaaaaaaatttttttcccccgccgcgccgcgggggggtttttttttttttttttttttttttttttttttttttagaaaaaatttttttttggaacccctcttttttccccaaaaatatttttttttttttttttaaaaaaaaaaatttttttaatttcccccccctttttttttgccctttttttcaaaaatttttttttttaaaccttaaaaaaagcccccccaaaaattttttttcccccttttttttacaaaaaaaatttttttaaatttttccccaaaaaaatttcccaaattttccaggggaaaaatttttttggtataactttttgccaaaaaaggggtccaaggggggccaagcccctttttcttgggcattttgccattttttggaaccccggattttttaagtaaaaaaaaaaaaaagatcttccggtcaattggccaaaaattatcaaattccttaaatttcaatttgcaaaaaaatgaattttttggtaataaattcacactgctttttcattcacacaattttcacagtttgcggcaaatgctcggtaagaaaaattttatttaattggccgtttaaatgctttaatgggatgtataaacaaaaaatatactgtaacatacagccagtatactgttgatgataattatgaagatgaagatgaaaacgattgagttaagttgaatcaaatttctcttttataaattttaaattggtgacgaattctttttctcattgcttttgcccataattattttaagcatttgagcacttgataaataaatgtcttcaaatgtcaatctgaaagtgaagggttcgataatgaattttaaattttctgaatttactaaaagataaataataattaattttaggagttaaataataaataatctaaatgaatttgaaatttctgaattgattgaaaaattaaattaa

SEQ ID NO: 31283 - DNA, 1062 bp, Heterodera glycines
  misc_feature (870)..(870): n is a, c, g, or t
  misc_feature (879)..(879): n is a, c, g, or t
  misc_feature (1044)..(1045): n is a, c, g, or t
atgatcttttttatcatatgtttcccaataaattttctttttggttaaaactatttttaatcaaaagaggaggtccggcggtacaaatacgccgaactttttgaattttaggcttaagggcttccatttattttttgggtacaaatttatgcatttaaggaaaatatggtgtgggcgacccaaaaattttgatttttcttaataattttcacaaatttttaagtttggaacatatcgctctgcctctgatcaaatttttgtttaggcagatttgtacgccgattatgaaggagatggtgatgatgataatgaggaggacgagcagtactacatgcatctgatcgcgcacaaagactcgttggaatttggctcaattatggtggtgccgccaaccgagccattaacaacagcagatggcaattgggtgcccaacgaaggcaatgttagccgtctcagcagtcaaatgagttttagcgccgatggcttaatgacaccgcttggcacgttggacacgcaagagaccggtgagttatggtgatcagtattggccaaagttgaaattgatcatacgtgatgtttaggtctattaatagggcttgtaattatatggaaatccatttttatttcctggactgtgggaggcctgaaactcacgaaacacatatttttagcttggtttaaagcagggtagccagatgtgatgatttatcatcattttgctgatttcaaggggtcgatgatgattttatttttgagatgatgatttgctgatttttgagaaatttgatgatttatgctgattttttgaaaaatcctcaaaaatggccatttttagcctatcgacaccgccggccccgaaaattcctctanattttagcnaatttgccaatttacgatgaaaatctgtttaaaaaatggttaaattttcaaatttttactccggcggcgcctaattcaccgccggatcccaaaaacattttacatttttattgatttttttattcgaaaaaattttccaaaatgctgatttttgaccccaaatgnnatgaatgatttgttgtt

SEQ ID NO: 31284 - DNA, 2007 bp, Heterodera glycines
  misc_feature (31)..(31): n is a, c, g, or t
  misc_feature (47)..(47): n is a, c, g, or t
  misc_feature (53)..(53): n is a, c, g, or t
  misc_feature (66)..(67): n is a, c, g, or t
  misc_feature (94)..(94): n is a, c, g, or t
  misc_feature (119)..(119): n is a, c, g, or t
tggtcaatttaagtgaattaaagctttaaanatagcaaaaatcgggnagaatnttatgagattatnntgaaatttataccacaaaaacaaaaanagttattccagaaattctggaaatnttctatttttcagaaaaaaatttatatctcggttctgaaaagtcattagggaagagtaaaatactacaaaaatccgcaattttttgctctattaaataaattttatttggcatttttatcacatttttaaaaaaagatacaaaaataaaagtgattttgggattcgggaccaaaggggggtgaccaggattttcgagtggaaaaattttttcaccaaaaatcttccaaaaacatgttattaggggttatttgggccgctgatcacgaatacgtaatcagattttacttttgacatcgttaagacctcagaatccctgtgtgattggggattctgaggcatcaaattgaggggggggggcaggttcgaatccggacggtgtaacattatttttttgtgcatttttacgttattttcaatgattttaattaatttaaaatattttgttgagttaataaataaaaaattatatttaatttaatttttttttgataaataaattttataagtttaaattaattatttttttaattgatagaatttcatgtatttttttaattaaatttgttaaaaatattttcattttaatttaatgaatttactaatcactgttgtatcaatttatatttaaagatttgttgtaaattaataataaaagaatttatgtaaaaaataataattatcttttaataaagaatttcatattttttttaattgaatttataaaaattaatttcatattaatttaaatattcaattattgtacatttcaaaattctctttttaattaataaaaggaataattaatttattttttaaaatttataataaattgcattcaatttttgtacctcttctaatcacttttgtacctcttctaacaattttgtacctcttctgatcacagttgtacctcttctgatctctgttgtacctcttctaatcactgttgtacctcttctaatcactgttgtatctcttctaatcactgttttacctttcttaatctctgttgtacctcttctaatcactgttgtatctcttctaatcactgttttacctttcttaatcaagttgcacctcttctaatcactgttgtacctcttctgatcactcttctaatcactgttgcacctcttctaatcactgttgtacctcttctgatctctgttgtacctcttctaatcactattgtacctcttctaatcacagttatacctcttcatcaaatttgtacctcttctgatctctgttgtacctcttctaatcactgttgtacctcttctaatcactgttgtatctcttctaatcactgttttacctttcttaatctctgttgtacctctttttatcactatagtacctcttctaatcattgttgtaccacttctaatcactgttgtacctcttccaatcacagttgtacctattctgatctctggtgtacctcttctaatcactgttgtacctcttctgatctctgttgtacctcttctaatcactattgtacctcttctaatcacagttatacctcttctatcactgttgtacctcttccaatcacagttgtacctattctgatctctggtgtacctcttctaatcactgttgtacctcttctgatctctgttgtacctcttctaatcactattgtacctcttctaatcacagttatacctcttctatcactgttgtacctcttctaatcactgttgtatctcttctaatcactgttttacctttcttaatctctgttgtacctcttctaatcactgttgtatctcttctaatcactgttttacctttcttaatcaagttgcacctcttctaatcactgttgtacctcttctgatcactcttctaatcactgttgcacctcttctaatcact

SEQ ID NO: 31285 - DNA, 1112 bp, Heterodera glycines
ttcttcctttttctcctccccctcttcctcttcatcaaaatccacttttccgtccttttggttcttaatgtggtcctgatttcggtacatctctgcaatttgttctgatgatgttgcattttcgggttttttgtccgctaaattaccaaaatataaaagtaagtggctcctttaatcgtttccctcgtccatccttcttttttttacctcggtttcgaatgaaacgcggaaagcgaagtgaaatgcctaaaaacgagttttttgtgtctggaaatgacgaagaatgacccttctcagcgtcgaccaatccccgcgcagccaaatgacgtggcgaaatggacatgtcggccgccttcacttcccacaccaccgacggttcaaaccaatggtcgggcgccaacgaagggtcgaaggcgaagtacgaacggggctaaaagtgtaaacagaattggaaaaagagagtggaaagggaaacaaagaccttgtcaatccgaagctcttggaattctttaaactgacttttcaagtcttcgtctttgaacccagtgccaatctgaacaaatattagagttggttgcgaccggaggatccccgctcaaaccggggaacgggaaaaccgaggacccgcggaaagaaggattcgcgaagcggagatcccgtacggggatacttcgaatttatatattgtaattttggaattttataattttgttagtttttaatagatttcgtccaaactatcaaattttgatttcattataagattctaacaataagaaagaactgggtcagatggtatcacaggcgtcaaaccattttgaaaaaaaaattcggaacctttgcaaaatgctgccaaaattataggccaaaaaccatgaccaaaaaataaaataaaataaaaaatgtttgttttaattgtatttaaattttcaaaatatgaaagaaaatgtattttttaagagaaaaattttaaaaataatagcaaataaagaaaccatacccaagaagttaaggcaacatttacagcttaatcacagtaaaacggagatgaaaaccatggggatcaaaaaatgtgaattttctgtatcaaacctttgcaattgattcgtact

SEQ ID NO: 31286 - DNA, 1214 bp, Heterodera glycines
aagaaagcaatctcgaaaaagcatgggacaattgagtcgacagcatcgctaattggcagggggaaaagattaaacgaagtaattaacggacagagggcaaaattgtcaaaaatgtggcggatggaaaagcaaagaatttcgataattcatattcaaaagccaaatattcaaaattatttctaaaacaaatatttgtttttataatattcaaaaagaaaaagttatattttagcgaattttgaagcaattaaataaaagtcttttcttatcagtgttatcaattaagtgtttgttgttttgctctcattcatcactttgttcctaattagtgagttaaaatatgtaagtctaataaatgtgaagtaaattaatgttttttaaaatgcctaagtgctcaattatacggcttcccagatcctcggatcatcatgccccacgaatcacttatccgtggattgaaatccgtatgcataaagatcggattcggtgatccgtggatcaacaatccatggatttttcgcggagtatggacataaatttttccaaattaagaagaaaattctcaagaaaatgatattttggaaaattttagggtctttagggataaaaaggccaattttgttggtttttgggcggttctaatagaggcttttggaaaaatttaatatggcattaagaacaaacaatatagaaatatggacaaatcgcgagttttcgtgcatttaattaattctaccacagtccaggaaaaaaagtatggattttcaatataatttaatgtccttgttgatcagatttataagaatttaaaattgtttggaattttcccccttttaaattccgtttttaaatcctttttacggacaccaacttctggtgacatttcttttagctaagctatttttatattctatttagttaagcttctatttttaataagttttataattgccatattttggctggcaggagaattgtcattgaaaatgaatgaatgatttgacgatgcaaaaatggaaaatggcgcatcccaaaaatatctctccctctttccccctatcactcgttccttctctgatccgcttctcttctctctatctatcctaacacattcactaatccttttttttctacggcaaaacaggttaatacaaaacaatgattagcgaagcacacgcccctcgcgccctcccttcccctccccttcccatccc

SEQ ID NO: 31287 - DNA, 1697 bp, Heterodera glycines
atcactattgtacctcttttatcactgttcttcctattttaatcactattgtacctcttttaatcacttttgtacctcttctcatcactgttgtgcctcttctaatcaatcacagttgtacctcttctaatcactgttcttcctcttttaatcactattgtacctcttttaatcacagttgtacctcttttaatcactgttgtacctcttctcacactgttgtacctcttctcatcactgttgtgcctcttctaatcactgttgtacctcttccaacacatcttccaacaatttttgtacctcgtatgagctcaacaacatttaaatacgggcgcgaagcgcccgtccaaggccaacaaaattgaaaaaccgggcgaagcgcccgactgaggccgcgaagcggcctaacaagctaaaaaacaggcgcgaagctcccgtctgaggccgcgaagcggccttaatagcctaacaaattagaaacgggcgcgaagcgcccgtctgaggtctcgaagctgccttaatagccaaacaaatttagaaacgggcgcgaagcgcccatataagcccaacaaaaatttaaaaaacgggcgcaaagcgcccgttcgatgccgcgaagcagcctaaaaatcgctgataattttttaaaaattcaaaatctccacaaccagagctaatctaggtagcgaagctcccaaagcgcgaagcgctttttcccagctaaatagccgacggttcacgcacccgctagttatatatatgttatatcgattaggcaactcatcttcaaaaacaaaatctcgggaacggctaagcgtacagggctgaaattttgcaccgaggggtagctcgagacggcgcatctgggaaaactataggttttttggtccgaggcccaactgagtaccagggacttttttcccatttttgcgtgcgtttgaacgcccataacttttttcctaaaacctgaaccaaaaaatgtctgctggtaggaacctaagttgaagtgttttctaaaaaacaaaaaaaaatccaggcctctacctataataggaaagcttgtagacttggctagaaattcagtaccaactttgtccacttcagtaccgggcgaataactcgccagggtttgaactgagcggggggtggccagcggacttattgtagagttttgtaagcccgattttttcaaattttaaaatttcgaaaattttctaaatttctcgagctaggccccctaagaggttttggggtttttgaattttatgattttttgccgatttttccggggaaaacggagaccactttcaaacaaccgtttttcgagctctatcgattggtgggatttttggaaaaatttcggtttttttccggaaatagaaattttttttggcctaagcgggacatttgagtcccgggcccataactcgtcaggggtcggttttagcaaaaaattgccttagagaaaaattgtagagctttttaagctctattgaatggtatattacatgttcgaaaattttcaaaatttttcgagctaggccccctagaaattttcggaaattttttttggggcgagaaagtgggtgaaaaaattttttctggggtattttgaggtgctgagcacgaatatgatgtttgttttttgttagggaaattttggaattttttaaaattttttgaaaatcggtcactttttt

SEQ ID NO: 31288 - DNA, 1842 bp, Heterodera glycines
ccgatcagaggggggcgaagctcggcttagtactcgaagccgaagccgaaggcgaagcccaatttttattcgaagccgaagtccgaagctcgaagcccaaaaaacccgaagttttcgaagccgaagccgaagttttttcaaaatttttttttaattccaaaaaattttttcatcacaaaatttcggttaaatatcaaatagaccaaccaacaacccccttcgataaataaatataatgattttttttaacaatgtattttctaaatttcaatttaaaaaataaagggaattttggaactccggcggtgccgataggcgccgacgggaaaaatttgaaattttagtgacagatttagttcaaaaatgaaaagattttcgattttaattgttaaatttatattaaatttccgtcgaaaaaagaataattttgaaaaattagaagaaaagaaaggacttggatgggaactgatccaaagaaacttaatgaaaagagcaaagagccctaccactcgaccatgcgtgtgaacaaaaaaattaaaacaaaagattaataaatatatattaatttaagtttatcaaaagcccatcactaagggtgcattttcacattgaaaactcaatctttaggggtgtatttttcccgaaacttcgggtaaaatagccgaagcacgaagttcgaagctcaaaaaacccgaatttttcgaagccgaagccgaagtttcgcccacccctggccccgacagattttctccttgcccaatgtatgccattcagccatttgtgtctttgtgccatcaatcacttccgacactctcaatgactttttttccttttttccgccggtgtttgtgcataagataaataaaaattatgtaattcatattggtctctgctttttattccctttttctgctatttgctaacaaataaaacatacatattttgctaaatacatacctatttaataattaacctttaatgttttccttttaccattttatgattaaaatgatgtgaggcgtaacaaatcaattgcatcaattttattcttccgcacccattcaaaggctaacaacaaatttttaaagtacacaaccggcagaaaacaaacattttcttttccgtaaatatatgtataaatccatccatttggcactcttgacttatacgatgttttccgtggacggatcccgacaaatatgataccaatcgatagctctcaacaagacaaatcgatctaggggtgggggaagttgatcagaagcgattaaaccggttaaacctatttgttacctttacacaacatgcttttacaatttggcatcagttcccgatattttcatcggacatagcattttgaatctcacgcattcccacataaaatattaattcaaatatacaataaaattatttttaattaaaaataaattatattttaaataaaaattcttaccattttcattttgcttttacaatttgacttttcgtctgattctgttgctcatcagccacaacctatgagaaattgactaaaacaaaatcagatattataaaaaataggaataaaatttaatttatatttttgtaccccaacgccaattaaagcgataagatgggccacattgaaagtgagcatgttgaatttgtacaacggtcgaccattaatgaatgactcattaatgagcgggatattaaagaccaaatgacctccggagaaaaaaaaaattacaaatttgttctgaaaatgccaaaaaaaacggaagggcagatcccttggataagtttacctttaaataattaattaattaacgaccagccccagaaaatggccctccagctaaa

SEQ ID NO: 31289 - DNA, 899 bp, Heterodera glycines
  misc_feature (892)..(892): n is a, c, g, or t
ggaaaggacaagcaccaacggggggggggggggtaaagcagctgaagacttgaaaagttgaaaagggggaaggcaacaaaccaaaatagtcatcggcggaggaggaagaagtgcatgcaaacggagaagaggggagacaaaaaaaggaccgatgagaacacttgttgagggaggggggaggggggggggggacaatgtccgttgaatgacccttgaggacggaatttaattgacatttgggcagcgatcctcccagggccaacggcaacggtaatggtaatggtcggacagattggcaaaagaacacatcggaaggaaaaagaagatgattggctaagaggaggagtgcatcagtaattggccaaatcgggagcatcattttatggccactaattaatcaaacgcctaattgactaattaaactcttcatggcaattttctacatatttattaattgtccaattaaatgtacaaatccttgtcctgttgttcccgttcccgtctccgttttcttccgctgaactgcttgtcgtcctcgttggcattgctgtatttgttccaccgccttctttcggctgtgtccgctgtttttcccccgtcgtctgtcatttgtgtcttcaaacaaacaaatctcatcagcgaacattgtctcattttgcgacccaatctcgggatgatgatcatcatcatttgatgatgatgcccacagaatcccttccgccccccaatttctccaaaccttccaccaatttcccctcctccgcttcgccttgcattttggggttggagggattgctgtttgatttgttgaggaaaagctgcgagggatgcgtgcgcggaattggtttggatttggaggttggaggagacggcggagggattgggcggtggnggggggg

SEQ ID NO: 31290 - DNA, 773 bp, Heterodera glycines
cacaaatcatggtactgtaccaaattcagtaaaccctaccggattcagatttgtcgccaacacattcttccatggaaatcatacgcattgtaccgtacatgagttggtcagttgcactgtgtattccacttgaacaccatggttttgtgatgccccatccggcgacaacaaatggttgtgaattcagcatgttttttgtaccgtcagtaaatttgttggaaaatgagagttttgagtttgaagatccttgaaaaagaatttttaaaacaaaaaaaggacaactattatataaaagccaatccaaaagcacaaacacaccaaccaatgccaatgccgaataagcaaatgggccgaacggttgacgaaaaagtgattggttcctcactctaacaaataaatgaaatcccatttcttaatggtattttattacctcaattaaagctaaatcaggtttagctatatgtatgatgtcctcattcgtgaatgtgtcttttaaaaccacagaaatggcattttctttgaatttgacaattttattgcgtattgtgtgcctttgttttgaactttgagcagcaccataggtaatgatgaaggggcctgcaaattaatacatgtaaaactctttatagatttaaagattttttggtttttattacattatttaacggtttaaacccgggatttttaaaattttcggtttttccgatttaatttttcttcaagatgcatgctctaattgggattttttaagcccaggaataattgctaatgtt

SEQ ID NO: 31291 - DNA, 1322 bp, Heterodera glycines
  misc_feature (39)..(39): n is a, c, g, or t
ttttattgccgcacaaatcgcctgagggtgagtgccgcncctcagccaaaacggtccctttttgtcgtccgctcacaccttaacgaaaaaagcaccgaacagggtccaacaacaaaaccacacggagaaacgaacgcaatgcgttattaaacccgttttatttcacaataaatacaataaaaaaggcacattttatcatggaaataaattaaaatttgaaaattaaaacaaaaaacaaacaaaaattcacgtgacaatttgaatggctgtcattgtaaaatgttcaatcgcttttctccaatcgccgcccgaaagagaaattcgaatggaacgaacattcttcagggaaggcctggcaacaagcagaaaatagtcatggagaggagccgaattcggtgggggaaaagaggaaaaaagggaaaaagcatcggaggaaaaattggagggggaaaaggaggaattgaaaagggaggaaaaggaggaaaggggggaaaaggagtggaggaaacggacacggaggagcgaattgggcaacggaacggaagacaaattggcggacaattggatgacgaaaaacagacgaaagcctaagagaaaaagcgaattaattggaaggaaaagccaatttaaaccaaaaatgagaggaacgcacctcggagttccgccatcggattctgtgcgtacccaaattcgaccagtgtcagtccatcgtccgtttcgtcggcgtcgttttgtctcaattccgtgccgttcattgtaatcggtgcgttcttctcgtaaaatgcgtgccattgttccgtcgttgccctttcggcctgtacttcgtccaacggtggattttcgttcactaacggcgcaattgctttgttacggttgaagcgcgtctcggacaaattctgctttttgcccggcagcgacgaatggcggccgatgtgttggaaaagcggcggattccgacggaaaacgacgacgttcaaaatgttctgggcaaagagtgaaaaagcgaaggaatgaatgcttctgatcgcagcttcgcaaatgcttctcccttctttctcacctttttgatgcattgcttttcgctgtcgtcgagactgcaatattttgaagagataaatttggagagaggcgggcgaaggcccaccacgaggccgcgaagaggccgagtgagtaccttcggtgcaggaaaattattaaattttaaaaattttttaattgctttttaaatatgccaaaaaatgaaggcttaacttttttagtgaaaattcgatcactcctctagtaggctaattgagcagaagcgtaccaaactttgcagggat

SEQ ID NO: 31292 - DNA, 1255 bp, Heterodera glycines
cgaccgtgacgtgagattgaattttgaggatttgaagccctacaaccaggaaaaactcagcttataaatagaaaatgatcattaatattgccaaaaacaaattttttttgttaaaaattttgatatttaatcaactgagacgcagttggcccgtttcgaccgggaccaaccgggaaatttaaaaaattcaaaaaaattcaaattttaatttatttcatgtgaaaataatacaaaattaaatttttattttgttttttatttaacaaaagccgaaagttaaagctaattaaattaatgaaaattttcaaatcaaattttcttcaattatttcaaacaattaatcatttttggactaagtgatcgaatattattagaaattcagatttacgtttcacataacttttttcggcacgctttttccaaaaaatttttgaggaagaaaggggtccggcggtgcctataggtgccgcaaggggaaattttgaaaatttgagtgtaatttgttaacagattttcaacaaaaaaggcaggtttttgggattattagactcaatttgtaaacggattttctttaaaaaaatgataaacatgtatcaattaaaaaaacaatgaggaatcatattttgtcgataggaaacccatgagtatacaaaaagaaaattatcgcaattaccaatgaatccttgataaatgttttttaaatattaatattaggtatttgttgaaaatttgttagtttttataaagaattttttggaaatttgataaatttttatttgggacccaaacgtgtggggcccaaacgtgagggcccaactgacatagaccggtagtttttgtaaaaatttttggagtcgattcttagggtatatttttcatttttattgcatttttgttaataattttgggcaaaatgccaaaataggcaaaaataggttctttcaaaattttttaggctttttagacgctaaaaataaaagcctagaaaataggcactaattatatacactttcaatctcggaagtattctttaaagaatgtatttacccggggtgtgctttatgtatccaccaaattccgttccaaattccatggggaaattcctttatgagaagaccaagtgatcgagaaatgctttacgcagtgtaaaagccaggcggactgatcagctaagggtgtgggtgattggtctagtggtatgattctcgcttcgggtgcgagaggtcctgggttcaattcccagatcaccccagat

SEQ ID NO: 31293 - DNA, 1820 bp, Heterodera glycines
  misc_feature (61)..(61): n is a, c, g, or t
atttttaaagttttttgaaatttttttaagtgcacattggtggtgtctgcaaaaaattttncaccgggtttaaaaaatctaggaaaattagtaagcatttgtagtgttccgatacgtattcctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttatcttttttttcagaaacttatcaaaagcgccccaaactttgcagggatactgaaaggaaaagaattaacctgttttatcacattagcttgtcatcagtttttataaaaaattttcaaaattctgagtctcctattattttatttttttttcaaaattttgaagggcggagggggggcgaaggcccaccacgaggccgcgaagcggccgagtgagtacctcggtgcatgaaaattattaaggaagagagttcattatttgtttattttttgcataattaattcataaatattttttccagaaaatgctctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaatattatctagtcagttcatttaaataatttttatccaaaaaattttttttttgtttttcggggcagtccccctgaaccgatgcgcccagatttatggggagaccgaatccttccggaatagcttcactatagcctgtactctaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcaatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccaaagcgatgcgcccagatttatggggagaccgaatcccttcgg

SEQ ID NO: 31294 - DNA, 2074 bp, Heterodera glycines
  misc_feature (1985)..(1985): n is a, c, g, or t
taatttatacgtttaatttaaataaatcaaattaaaacattaaaaataaattaatattttaatttaaaatttatttgcttattattaaattgaaatgtgaggccagaaaaaattagaacaattaaagttaataattttaatatgtataactttataaaatttaatttaaaacaaaatgaaaaattaatctgataaaaggaattgtcgaaatataagataacagttaaatcttcgggtacctgtttggttatgtgattttcctaactaaataataattcattattttttcgacctaaatccaaaacttctttataggttaaaaaagtaaaaaaaatatgaaaattgaaaaaatggaatgataattattcttgaaaaattacatttgagattttctttccggacacaaaaaacacacaaaaaaaaatgccgcgatggacaaaaaaaggtgcaaaatcaattatctaacttttcctatgattttttatcaataaataatatgtcagttttatttgatttttaaatatttatcaaaggtttcaattccatgattcctaattatagaaaaacagaaatattaattttagcaacaaacgcattgtgtaatacagtgtaaaatgaaatgttttacagatctcatatttctaaattaaaatttacattttatgatgaataaatgttaaatttctcagaagcggatgtagataatcgatagtcttagtgcacaatttctggctcagcaagtcccgtttttacaaaaattcccgggtccatttaaacttttttctaatttctttgtaaaattatttgtacgaattacggcactaagagtaatatgctcctttttaacgcttcctcactatttttccactaattttttctttttgaataaaaggtgatgatttatttcagttgttaaataaatttagagatcctatgcatttaatgttaaaaattattaattaatttaaatttaaaacaattgaataactcggcaaaaaatcagaacaaaaaatctttaaaaataataatttcattattttacaatagatgttctgatgaaaaaaaagtttctttctagccatataattattataaagaggagccaaaaaataaaattgctaattcataaaattatttaaatacttatttacttaaaaaagccaaccttttgtaattataatttcattataaatggatttattattaaaaaaacgaaaacataatcaaaaaaataaagacatggaccatgattagctgacctgtattgatttataaatttccattttttattggttttgaaaatagaacttcacaacaatgtataaaaattaatctcaaaattagcaatgaattaatatttttcttttttgaaaatattgaaattaatattttaaaaaataatatctttattatttataaataatttatataccaatattccagttgaatattttcaaaatagttaattaaagttaaagaattttttttttgtttatttagtaaaattaatctaatactgccaggaatagtgattatatatgaagtaggcgtaccatcaagataaaaaatatttgagggaaaattaatttatgaagttaaataaataacaaaaattaaaaataaacaaataatttaaacaaatataatatttatttcaagaacaatgcgtattttaatatgtacaatttcaatttgttataaaataaattttctttattacactacaaaacttaacagtttaatgttgaaaaaaataaattaggttaaatatatgctatttttttgaaagtgtaatatttattaactttttttcttaaaatgcgtatgactcagaatgatttaatattttttggatgggttttattatttatttttatatactcatatcaatcatattataaaactaattatgaaattataaaagcttatataaaatttattatttataataattaaatgcattttaataaagaatatttatttanaataattgaaattagttattcccaattaataaatatttttaaaaaaataatgtaaaattgaaaaaagcataaattaaaaaagaatcatt

SEQ ID NO: 31295 - DNA, 2043 bp, Heterodera glycines
  misc_feature (1886)..(1886): n is a, c, g, or t
  misc_feature (1971)..(1971): n is a, c, g, or t
aaagtttaggagggaggaaaggggtcataagagtgtctttgtaatgaaaaggaaggaacaattcgaaaatgatggaccatcgacggactgactgatcattttgcctgatcagtcctccccttttgatcattcttttttttcgcatttccccaatctttcaacgaatcacccaataaaatcgttaccgcttctgtttgtgtgaagcgcttaaataaaaaggcggaggagagaatcccccggggctggcaataaagtgagatgatcggcgcaataaaaggggggggggaaacgaaagtcgtcaaaagtgcgcgcgaagcgatttcgacgggagaaatggggaaatcgaacaataaacagaagaattttgtgaaaataacgaaaaaggaaaggaaaagaaaggcaaaggcaacaaaacaacagcagaaaagggcaattcgaaaagaaaatttaaaaaaaagaaaaaaagctaaaaatggcaaaaaatgggggaggggaggaaaagatagggcacaaatacgaaacacggagaccccacgaaaacccatgggaggcaaaaaataccaaggaaatgcaaatattaccgaaaaatagggattaaaaaatacttttaactattttttgtatgttaaatcaaatgtgatactccccgcccatccgaaagttgcgaattaatttaaattttatttttctgtgtgttttaaacgacatatatacagacgtaccatcgaacattgagagattgaacagaatgttaagcgctgagtttcgtctttccttcggcacattttgccccaaaagtgccaccaatttggccaggtttttgttgacgatttcatgaccaacagagggaacggtgctaagattgagcagaagaaaccctaaaaatgcgacggcaaattgaacaaaaattcatccaaaaaatgggtataccaaaaaatgtttctggtaattcatttgcattggcattcccttgggtaatttgcggcggaagaagcgaatcaaaaaaaaataaaaataatgattttataattaaaatcgaaaaagtaccgaaaactgtgtccagaaaatgagtgtcgtgcttcgaaatttgttcaaacagtcgcaatggacaaaaacgggacaaatttgagagaagctgaacaacggagacgcattttgttgcatttgaaagttgcaattgcaaacaccgcttaacgagtgaggccgaatcggtcagtttttctgcaatttgaagagaatgggcggagatgttgatcaaaatggccaaaagaaggggcaaagagtccgaacgatcagtgccaaaaagacgcaaaaggtcgtcaattaacgcatcggaattggcaccccaaaagtcggaattgggggaaagcgaaagcaacaattttagggcggacagctgaacatccggacgagtcccatcggagagaaacactctcaattccatctccatctctgttaaatttgaaaattaaaaggataaatgtttaaaacggaatctaaaattggcacgcattcaaacaaaatcaaagatttaggtccaaacttcgagactgaattgatttctttttattcttgcattagttaaaaataacgccaaatttaaaattttattaattttttgaaaagaaggaaacacttctgcttgttttttcctttaataatacagtagattcttagatttatgcacaacaagggcgtatgaggtgggtgggggtttctccagcctttgacagacaaaattttcggggaatttcctctccgatccccgacttttctctctcccgagggtcggggaggtgccctaattaaattatttaaatttggactcggagctatcctttgcattttagtggcagtgatggattcgttgaagtgttcagaattanagtccgttgggttggacccgaattatggtataccgtagtttaatttggtatttgcttacagaaattaatttttgtccattttaanggtgggacatatgcaaagtgcggaaaacaacagattttatgtgagtttattgctttttcaaatttaaacccc

SEQ ID NO: 31296 - DNA, 1445 bp, Heterodera glycines
  misc_feature (1432)..(1432): n is a, c, g, or t
ttttaattaatacagtctggcgccgaatctttggcgctgaaacgacccatccagtctctttgccatcggttttttttcattattcgcctcatgccgttcggatgtgtttatacgattctggcactcacacagtgtaattaccgacacctgcactttaactatccaggattctgcaaggagtttaataaatcctgccgcttgttttctggaaattttttgaccctttttaaaattttttaaaaatattcaaagtaagattgaaaatatataatttgcgtaaaggaataacaaatttaacatttcttagattttttgaataaacaacattttcacttattttgtcaaaaactattagaaaaatgcataaacatattattataaaaaatattaaaattttttagatttataagcatgagaatataatttttgtttttaggggcattaaaataaatctgaaaacatatcttggaataatgccttcaattgcactgattatcgctttcacgacatggtcttacagtcttttttctgtttggcataaaacactcaatttgcctaatgatgatgagattaatttgattgacagcatttaaatgagaacataagcaattttttggtttatcgtggaagaaatgtgagtaaaaaaaagttttgatgagataaatttgagatatcggttggaataaaacaaaattttaacagaaagataataaagaatgctcacacttcaattttaatggtttcatatttacacaaaaaacttattactaaaaacaattaaattttgactaaaaaaatttataaatttttgctaataaaaaaacataatttcaaaaaactttgaccaaaaaacctttgatttatggcaataatttttttttatttaatgaaattttagaggaaaattgttaaaaattagggctatagaatataaaaagattgttttatgtttatgtttaatttatgaatttgatatcacgatgatcaatttttcgtcaaatttttattttgattataggatcatttaactgttttttagttcattttaattttaatttttgtttattttaaattttttaaaatttaaattttgataacaattaaggatgatttgtcacagcaaattgtaagaggagctgagacatttgattttgcagtttgtttttgtattattgccatttgtgggtacaaaatgaccaggtttgttgacaaaaaattggacataaattcaacacgacgacgacaaatcaacaaacaaatcacactcaatttatgcattcaggtactgtatttaatacatcttgtaaaagtcttgtcaattttttagaatttaatttaattttagtgaatttaggcattatttccactaagcctgaacataattggcattttaatcattgcatcaatttcgtttttaaattttgactcactnaaacttacaaata

SEQ ID NO: 31297 - DNA, 1564 bp, Heterodera glycines
ggtggcttatgcacatacttatgcaaatactttactgaactaacactattaaccttttcaaggttaatgtgacacttgaacattttcaacaggtacaaattgtgtgggacaacccacctgttgtctaatgcatgtcttcttccatttgcaaatacttcaacagttcttccatcatttggtcttgcgtacaatgccaaaccattttcaagaacaattgtctcttcttgaaatgctttaggatatcccttggagcatttcctccctctcattccattcttgtcaacaaattcttccatgcatggacaatttgggttcaaatcaccacatggaccatggatcataaatcttttaaccaattcaaacaaatcaggcactaattctttatcaggtattctcgcactaattcctttcttctcaacatcttcgccatttatcattttatcttgttctgtcaatgtcaaaagcaaatgaatgtgcggtagtccccttccttggttctctaccggatacatccatgcaatcacttcaccaaaaatctttttcttagcaatctcattcataatagctttaacttttaagttaaaaactctgacaaccaaatcaggtctatcaattgatgtctgttcatgaaacaaattctctgaaatctctgcccattgcgggttacatgtcattgtcaaaaacatgtcaggcttaccaaaccgtcgaacaacggccatagcatcctgaaaatacttctctacatatctcggactatttgtcacacttggaggaagaatgaccttccttcccagcggcaaacctctttcttgagctcgtttcatcaacatgttatcaacattcttatatgcatctgccaaaatcttcttttggttgttctttatccaattcattctatctccttcaatctttacatattcatcaacacaatactgttgaaagagctttccaccgaacaaaatcggattaaactctctctctctaattgctaatgtgtagcacacatattgcaatctcgttactcttctgttactatttctatgcttcatttcagggtgccaaccaagcgtaccacgcggataaaacagcgggtaagtcattggagttaccattgaatctgtgcccttcaaaatcttcaattcctttccacgttctctcaccacaatcttggcattaggtacttcaccgtcagccccaggtacataaactgcagcaacttcattcgctcgaggtacattgtactccaaacgtctgtccaattgccttccggtctcaaacaaaagcttgatctcggctggctctctgttctcatttctagctctctcaacttcttcatcttcttcttctttcatcatcatataggcttcagcaaaaggattcacatttttaatcacttcatacgcagttctcagcaattgagggtcaattccgatattggcatctctcattgctctcattgcattttctagtatctacgatgaaaatctgcccataagtaggatcatcgccatcttctggattcaaagccaaattcattctatgataaatctgaccgtaaatgcgg

SEQ ID NO: 31298 - DNA, 1779 bp, Heterodera glycines
  misc_feature (19)..(19): n is a, c, g, or t
  misc_feature (34)..(34): n is a, c, g, or t
  misc_feature (39)..(39): n is a, c, g, or t
atggttaaaaaataaaatntaatgcatttccgtntattntcatcaattttcctcataaaatattttccctttattattttcttttgaattaaatttattatctatcatcaccaaattttttaatttattggttaaaaaataaatttaatattttgtagtgaattttcctcctaaaatatttttccctaattattatttttaattaaatttattcggccttttaattgatgcaaaatctccccacatttaccactgtgtataattttatccacatttcttcttttttaaataaatatttattctgtcactgttctctcccctccctttttttgcccattttctctccccaaattcgcccatttttattactcataatcaattcgaattttattcttcgcttcaacacaattttcacagaccatcataaatggatttcatcactttttaaatttgcagccgatttaaaattaaaaaataaaaaattataaaaaatccaaaaattcttttgcctttgtttcacatgcggacacatgtttttcccatttaaataatatgctaacacaatgttggcttcacatattcacataagctggccaaagcaattaggcataagaaataatttcttgccaaaaacgcggtttttccattttttcactgcgtatttttgcatttaaattccattttttaaatttattacaaaatttttcggctcttttaattaaattttcgaaaaaatgattaatcatcacacaaaaaatgcttttggcccttaatttttgaatttgttaatacaaaatatattattatttctgtcccctgctggggaaacggagtttcccaatccaaaaaaattgcttattttctcagctttttaaagcgttttttcggcataggcttgctgaaatccaacaaattttcgattttttttctctaaaactaaaatagtcttcccccttctgctgatagaaatgaattttcacgaatttagtgaccttctccgtttcctcctcaaatgtgttctgtgagttggtgaaatgtcctcggcaacacttaaattaaattttattactttgattacatttcctcaccattcttatcaaatttcatttaaatctctcataaacagggcagtgactaatttggtccaaaatttgataaactaaaatggaatattttaaaactaaatattttaaattcaatttttttaaattttatcattttaatttgtattaacaataatttcaaattgcaaataccatttaaattatgctattttatttatttttagtacaaatttaaaataaattttaaaataataataaataaatgaaatatcattattaattttttgctataaattattttatttatgaaattattattatttaattatttctcttaggaattatatcattgttttaattcttttgcttataaaattattattatttatgaaaattgttattaatattttaatctattaatatttgaatcttatataattgttattattatttaattatttctcaattaaataaaattaaattttccaattcattttcatttcacttaatgaatccattcatttaatctgtcatcattccatttgttcatttcctttttctcgaaatgacaacacaaaaaatgagctgtcctcgcctttccccccgcggcggttccttttaattataaataattttaatagtgaaaaagaaattggccacgacattggcacgccattgattaggctcgccttttttttattgtcatgacgaccat

SEQ ID NO: 31299 - DNA, 1073 bp, Heterodera glycines
tgatcaatttttgatgaaaatttggaaatgaaagaagaggaaagtgaagaaatgtccacaaattgtgatcaattggaacaaatggcagaaaataatggtcaaatttgtgatcaaattcgaattttaaatgacaaacaaaagaggaaaattgtggaaaaattccataaaaaataaaattaataaaatgggaaagaaatactcgagaaaagaatggaataaaattgaaacgaaaattgctcaaaaatcgggtgttagttataggaaaatctacgaatggtaaagagaatttggaatgatgatcataaatagttattcatatgagcaaaaacttcaaatagtaaaacaatttgatcaaataaatggcaaaataaaaaaaaataaatgaaaaattggagagaaaaagagaaaaatgtcaaaaaataataacaaaatcagaagtattaatagatggaagaaagaaataaaaaacggaaagttggagaaaaaccaaagaatttttgagcaaaaaattgaaattgtgaaaaaataattcaaaataaaaaacgaatttatacaaaaaaatgggaaacattcgaagaaggaatggaaagaatttgatgcaaaaattaaacaaatgtttggtgttaattattggacaattgaaagatgggtaaaaaaattaaaaatcaatcaaaatgtttcaaagggtgaaatttttaaacaaattgttatttattaattaaatttaaaaatttttattatttaatatattacagggcagaagcattatacatttgcgaaaaaacggaaaaaataaaacaatattatcaattgaaaaaccaaaacccaaagctcaacgatcgccaaattgcggaaattttaaatattacaaaaagatctttagaaagatataaatctgaattcaagagaaaaagtgaaggtgtcacggattgactgagaatatttttcagttttcagggccattcattgttaggttttgataatttaaatttcttaaaatttatatattattcggcatttcattcattttcccattggtgcttatatgtagagtaaaagtattatgcataatg

SEQ ID NO: 31300 - DNA, 1423 bp, Heterodera glycines
taccgtcccttttttccctttataaccgtgccctctcggctttcgctcatttgtcgtccctttcacgggaagggcaaaatcgtgcaaagaaagcgacgtcagagacaagttgccccgcctattttgtgtacacacaaaatacgattatcaaagcacacttttgctgcaccgttgagaaaggtaacgtctttggacaatccgtcagtaatggataatagtcagtggatatatatcaactttttttttaatgagttatggtaaatgtgcgaaaacaatcttaataattaattaaattttttatcatttgatagaaattaatatagacttctaaaaaggatttttttctaattatttttaaatcatttttacattattttataaaaagatcttgttttttaaatgggaataattttcataataaattcggccaagattctgaaaagcgtctcgacagtgctggaccattaattccctttttctaaaatggatgctttttaaccaaaatttgtgacaaatagattaatgacctattgacaagcattaagcaaatgcatcttctctaaactaattaaggagtctgtccactagggcaccaagcttacattcacccgttgaccgatggaacaattaaagtttgatcacatcacaccaattatgccggatatcaccgttttagtgtaatattcgcaacttcgatgtaacaacttcgtgtccccctggctacgtttgccttgaggcttttttggctccatttgttgtgcccagacaatgactggtgtgtttgcgtgcttcacaaatctgtcgctttgtgcccattcctttcccttttggcaggttatcccgaacagggatgggcgaaacttcgagcttcgaaaacatcgcgttttttgggcttcgaacttcgagcttcgagtaattttcccgaagtttcgggaaaaataacctctaatgattggcttatggtaaaccttaatttaaatatcattattaactttttgtttttaaatcttcactacattggtggtccagtgggttgtgcttttggatccgttcctatttcccattggatcagttcccctccaagtgttttttcttttaatttttcaaaattaacatttaaaaatataatataattgtaatatttttaatatgtagacccaaaatttacatcttttaaccggcgataactacccccgccctatttttcttaaaaaatagactcaaaatcggaaaatattttcattttttgcttgaactaattggaactcgctttaataaaagtcttcttccttttctctaaaattaacaaacaaataagcagaaaggaagaatgggtaaaaagaaataaattaaaaaatacaaaatttatttctaatttctaatcatcacgcccgccgctatcatttcctcccccatttcttcc

SEQ ID NO: 31301 - DNA, 1125 bp, Heterodera glycines
tcctgaaattttttgggggaaaaagaaaggaatccaattggttgaaaggcctttttggttttttttcaaaacacaattttttttaacggtgggccatctccattcataacactgacaatgagcatgctttggtttcatttttcttctgtcctggaaagagtcgagcatttcggcgagtttttgtcgctcgtccgcgcttaacacttcttccgggtcgcacacgtaactcttcagaggcattttgcactttgcgaattgcccctcgcgcaacggatttggataatcgttgatcagtgaggaggcggacaaaaattggggacagaaaaatgggaggagaaaaaatggaaaaagcaaaaaggaaaactcagtagcagaagcagagaacatatgtaatttagcaacaataatattatattattataaaatatagatcaaaaaaaaagaaaagaaatttatccaacaaaagagacgagcaaataaccaaagcaattaagaaactaataatcaaataaataaacgattggtggtcattcgaaaaggagcgcactttagtaaaataaacaaaaaaaatgtaggaattacataaaatgaagcatatttcaattggtacatataataatacatagaatatgttacagtcagttgcaaagcaacggagcaaaatttatgcaaagagaaaaacccaaatttcttgagaaatttttacttctccaaaatgccatctttataatgaaaaaacaacagataaaatgagaatttcagaatagtttttttgaaaattcaatcaattgcctaacagtcatttttcttaatgcttctctttttgaattgacgacaaagctgcaaatgagaaatggtattatgtattcaaaacaaaaagcagtccgaaattctcacccaaatggtcacattgtcaatttgggcaaatattttcccaccaattcaatgacccactctttagtcaacatttcctccacaaatttgtcattttgatttatcaattgtttgaatttgatcttaaataaacgcaacaaaagttcatggtaattttccaattctttcgaaattttccgtccctttatttcttcatccattttgtttgaatttttgctgtctttcgctttg

SEQ ID NO: 31302 - DNA, 1179 bp, Heterodera glycines
ttattaaataaaaattatatttattattaaattccagctattaaaatttgttataaaacataactgcaattagcttaatttttattttataaatgtagcgggaaaagcaatagatatatttgaaaagatttttttttgaaaattacataataaatactgatgaataaaatccaagggtcaagtgtgaagcaaattatatttcgtgaaagaacttgtacttggctgctcaagaagataaagaattataaaatttcatttttaaataaaaaatttatccacctatttgaaaaaagaataatttgtaactaatattaattataaaaaaattgttaaaaggtcttcaatcaactacgtaactcaatgcagtcaaatcaagaatatattagaaaatatagaactaagtaacaattaaaaaacgataataaacaaactatagctctgtcgtagaattatttcatcaaaattttaaagcagacgtcaatcttcatttttcgaaatatgtttacaaaaataggagttaagacgaataaaatctgtttaattcatcgaaaaatattttctgaatataatttaattttttctgtgcatattaaataaaaataattttgtaactgaacatatttaataaaaatgaatgtaaatatttatcgaaaataaataggaaacaatatatttacttcttattttggcctcgaaacattaaaaaataatttaataaattaataatagaatttcttttaatgttttttcatatttgagtgatcttagaaattaattttttttttaatttcatttttattttcataaatttttaatagaaaaatgttaaaaagatgcaataaaatcaaatttaaataaaaatatacatggtatgaaaatacattatatctaaattgtaatataaaaaattatcataaccttgcttaaatatttcatagcactataagttcgctattattctgcaaaaaatcaaaaaactttattatctttcctttgaaacgcattaattatttatagttctatgggcttatttttataataattaaatttaaataaatacttattgtttaaacaaaaataattgccaattcttttgaagactttcatttaatgtggtcaatgctctttccgaatccggttcccaaaaattacattatccaaataaacaatgggaaatgg

SEQ ID NO: 31303 - DNA, 1190 bp, Heterodera glycines
  misc_feature (53)..(53): n is a, c, g, or t
  misc_feature (1025)..(1025): n is a, c, g, or t
tataaaattatcaaaaaaagagatagccatttttctgggatagagtataaatntaaaaattccctcaaaaataaaaggtctattgcgcaccgccctccctactcatgctcgagagcatttgtatgtgtataaaatttatcaaaaaaagagatagacatttttctgggatagagtctaaatataaaaatcctctgtgaaataaaatggcgattgtgcacagccctccgtctcatacgcaagcgcttttgtgagtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagacatttttctgggatagagtctaaatataaaaatcctctgtgaaataaaatggcgattgtgcacagccctccgtctcatacgcaagcgcttttgtgaggtataaaatttctcnaaaaaagagatagacatttttctgggatagagtataatttaaaaattccctcaaaaataaaaggtctattgcgcaccgccctccctatcatgctcgagagcatttgtatgtgtataaaattatcaaaaaagagatagccatttttctgggatacctctaatataa

SEQ ID NO: 31304 - DNA, 1679 bp, Heterodera glycines
  misc_feature (1521)..(1521): n is a, c, g, or t
  misc_feature (1553)..(1553): n is a, c, g, or t
  misc_feature (1626)..(1626): n is a, c, g, or t
ttattttattaattattttatataataaaagatgggctattaataaggaagggatgcgagacaaatttcccattatctctccctttcctttcttttactctcttttcttttccattgcaatttactctctttttttcccactccctccttctcccacacacacgcacgcgtccaacagactgctgctgcacagcagcacgcgtctgttcactgtatgcccctctcacccgccgctgcccgcgtagacagacaatcagacagtgcactattttcccaccatccctccctctaacctctacatcctagaaggagaaatcttttaccttctttttctgtgctatttcttttgtcttcttcttcttcttaactatttattttcgtctcttttctttatattctcttctttttcaaaacaatttcttttcatctcttttcaaattcatttttaacgcaaaactcaaacaaatcgccacacaaattcaaaacatggacacatccggacaaacaatcaactttattatataagattttatttatttatttaatcctctttgatggacagacaatttgttttgtaagtttatttacactgaatacatttaatttattcattctcattcatccattattcttcacattttccacccaattcgattggttatttattctcttaaattttaattttaataaacaactcaacttttttctacagaaattcttcttatttattttataaatagaaccctaaattttagattgccggaaccggtggggtaggaccgagactggaaaatggaccgggactcccccctttttcggaactcccggtcacaatttttttgatcgggatcccgccgggactggaactttttagaaagatgaaaaattggtgaatgtcaaaaattgaaaaaattagacgtattatttgtgacattttttatttgttttaacactcatttttcgcgcgatttaaaatttggacgattttctattcttttttaaaatttcgacaggcctcgcgagtttcaaattcatggcaagaaataataaatacataaatttaattaatttcctgggacgaaatcgaacccgaggatatttttcctattaatcacaattctgaagcgcgagactaccagtgtctttgtccggtaatagtttagatggtacccccccttttttaaaaatttttttcaactttcaaaaaatcataaaaacatgtttctaggggttttcggggtcgctgatcacgaatccgacatccatttcgaccgattccgaacccctgacccggattcgaacaaaataaaaaaagcagtttgggaacaagactgaaacatacgacacctatttcccagaatttatttggcgtcagcgttttggagacagtgaaaatgcgttttacaatttttggttgcatgtctctgagttttatccatgcgaacattgattattttctttttcgtgcatttgaatcgatttttagcaataaatgtgaattttgttaaaaaatcaatttanaacaaaatcaaaaatttcaataaattctctanagttttgttgcgcccctccctgtcgaaaagtgatctcattgaccgtgcccgactcatttccttgtgtaatctncacgtgaaaatgacccgtccagtgattatattgtctatgctgggcatgtgctt

SEQ ID NO: 31305 - DNA, 1471 bp, Heterodera glycines
  misc_feature (1382)..(1382): n is a, c, g, or t
tttgagcacgtacatcagtttgtcttcgtcctctcttctcagtttcatcccttccacttcctccaggcgccaacaaatttcccaatttgtcaagtccaaatttagcaaaatattctttaaaaacatttaattaattagtcaattagtgactgaaactgatcaaacccaccctcaactcgcgctttgcttttttggccatttcggaccgtgaaattttggccattttcagtcgttccaacaaatgttttcttatcgcgtgctttgcccttatgaattcaatggccattaactgtaattgcttttgccattaaatttaattatttctttttgtccaccttttgttcgtcccttttgaatcccttcgcaaattcaacgaatttctgctcaaattccgcgtctgtatgctgctgttcgcccaccatttccatcgctttttcgcgcctttcctcgtccaatttggccaaaagctgcaaaaagacggcgacaaagtgcagaaaaggttgggtgggcagcacagagcccaattggcacatttggccgagcaattccatgccaatttcctcaaataaacgggcaaaaagaatgaatggcatttcaatcgaaaatttacaaaaaaaaaatgaattttgcctttgattcttttggcaaattggcgacgaattgcttcaattgtgcgactctttgcgattcgctaagtgtcggcgcattattaattcggtggaacagagaacgatttgtgggggataatgaggcgacaaaagtggccaatttgctgagataatcagccgggaaaaggtcattttgggccgcagaaaaggcgaaagggcaaagggcggccaaaattaggagaaaaagcggcaaaaagaagagaaaagaaaagcgaatcatttggggaaataaatttaaaatattaattaataaggaaaaaagggaattggcccaacaaacaacagacaaacagcaaaaacgagtttaaaacaaaatgcccccggggaaaggcaaaagggcgcaaaagggagaagagacccattaatgaacgaacaccaatcaaagtcaaaatcaaatggaaaagaacaaagttggaaagcaccacatccattctgagtatttattttaaaaccaaagcaattaacaaaaaaagttgattaaattctacaaaatattcaatttttacaaaataaacgatttgaattttgagtagcgatcacattttggtgaaaatattttaaattaacaaaaaagaaaatgttatcggtcagacttaattacttaataattaattacacaaaacaaaaaggaatgccaaagtacaaatgaatacaaaactaattaataagttaattaacccaattaaacattttaaattaaaaaatgtttttccnaaatgtttttcttctcctttttcaaattttgtgattggctcggaatgccttttcctccgtctcatcgcagcctaaaaatattcggccaa

SEQ ID NO: 31306 - DNA, 1642 bp, Heterodera glycines
  misc_feature (717)..(717): n is a, c, g, or t
tttcgctcacagtttgatctccaactgatttccctgttcagaaaggccgcgtcctcttcattgatctgatgccattgagcgctgctgaccaccacgacaatggcctaaaaggccaaaaacataattaagggagaaaagattcgttttgatgccaaatcggcacaaaggcaattcctttccctaccaaacaaacgaccaaaacaattgccaaaacggagagaaggaagacgagggcgagcagaaagcgatggctggagagaaggcgaacggagaggggcaacgggggccatttggaagagggcggcacggctgacacttggggaagggcgatctaagcaaatgggaggaggaggggggacgagggcatttgaaacatcaaaaaacgaaacgaaatgccaataattatgggcgaggggggaacggaactctcgagggtcgtctcgggttttctcgtttcatcaaaatagcagaatccgtgcagcctcacaacacactcaccaactgtgctttgctgctgccctccggcattttttcctccgccaatccttcggcacttttcctttcgccatccagcaaataatcattttttgttgtcattccttcgccatttcccaacttcggcctcggctgctgatgataattttgttggtcgtcgtgtgccaaactcagttcggctgatgaaaagggcgaaattggcgcatccgatccatcgacggngacgtcagtcattgaccgaatcggcaccgatgccgtggccgaagacagcgaagaccaatcgggggacgaattggaggaggacggagaagcagcagacatttttatgaacacaatgattcaaaaaggagacaattccctaattaattatccgaatccgttattcagtacgcggtccctaatgaataatgatggttaattaagcaattgatggggaataaaaagtaacgaactgatcatcattgtttgcttctgataaaactttaacctcacccaatgttcgttatttatttattttttaatgctgacatcattaaatttgaagaataatcggggaatttgtagggggaattgagagggattaagccactttaattaagcatcgattgacccgtggcgcactctttgaggccaaattgaaaatcacaaaggaaagaagcaaacaaaagcaaaaagaactgagaatttggagcacgaattgccagtttaaaatgcatgggacgaggccaattccattaagccaaagaagccgaattttgcacatggaaatgaacggcacaaaaattggccatcggagaaggccaattttggaatgcatccgccagcggtcggttgaccaatgaatgcattttaaattctgtccggagatcacaaattcccttttcccccaaatttccggcggtgccccgccccaacggccaatgaatggttttggttggccctgctgacccatgccattgcgtgtttaatttccttaaattggcttcaatttatttccgctggatgggtgataaaattcaatggaagggatgggaaaaagaatgaccaaatatggcaaattgataaagaaatggacaaaaggaacctcctaagggaatatgtatattcttaattagataattactaataagtaatgaccgtaataagt

SEQ ID NO: 31307 - DNA, 1727 bp, Heterodera glycines
cttacccaatgcaattgtcagcattcaaatgaatattgactccattcaaattgtctgccgacttttcgtaacccctctgaaccgtctccccaatttgacaccgcttcaacagccaattaacatatccaaataagcattcgtgcttctgcagggtcagcttttcgttggtccgcttgttcaccgattcaaactgtgccattgatgatgatgccacgaagagaccaatttgaacattgtatttggcagcaatggtggcactgacaaatgcctaaacaatgttcggttaagtgtactgtctgtcagcattgtttgaatgacgtaaatgtcgcggaccaggccgttttcacgtgggccaagtttttgaactatgacttttttcattgtcaaccaaatcaaataatcttggtatcattcgatagcctcaagagacctctattaatctgcaaaattttgaaaaatttcgttatggttcaaaaaaattattgcctgaaactccaaaaaactggttttccaaaatggccaacttttttttgaaacttaaccaaaattttcataattttgcaggctaattgaggaaacttagggctagcgaatgataccaagattatttgatttcggaaatgatgaaaagttggttttgggttttttgcattataattgtttaaattaaaatctattgactaatattaattaaaaaattatatattaaataattaaattttaattattcgaatagttactcggattgaaacttatcttaaaacctataagccataaatttttgctttgtcattccacctataaatgcttaagctagactatttttgtcggatggtcccagcaatccgcatttttggaaatttctagatttgtgagattgtatggattacccccaatttttattctttttggtcagtgttaccaatgccgtcgcctcccaaaagatgttgccacaaatgaatccggcgattgctgctgctgattttcaccaatttcgaccgaagaaaaggcggcggaggattttacatattccattaaaaattaatttttcagtctgcaaatatttaagaaaaagttgaaaactgaattattttttggatttgtatgtagggagagcatgactgtgcaaatgggggaggcgggtcagttgggtcgggtcataacgacgaacgaaagggtcaacgggggcagggggtgggaacggagaagagaaaaggtcattaaattaattagtaagtaacttgaaatgctgtataaaatttacggatcaattttctactgacggattgtccattattgacggattgtccttcacgggggggggggggcggctgggaaaggtgaagagaaaatggcaaaaatgataattaaattaattaataagcgacttcaaatgttgtataatcgtagacaatcttttaaatcaaatcaaacgatcgcaagatttttgatcattattcaaaaaaataataaagtttgctgacgagtacgagtgcgaagtgttcaagtggtcaagaaaatgtgccgttcagaataaacgtggagcgacaattagagatttttaattgaggatccgaaatttgtaatgcgtacaggtggacccagcatttagggttttcgttaagttagccatgcttaatgctccagaaaatcggtgacggaaagggaattcgtagtcgtcaattccattcaaaatgatcgacagatttcacaaatactattaatta

SEQ ID NO: 31308 - DNA, 1068 bp, Heterodera glycines
aaaaaagagatagccatttttgggcaagatttttttcgttagcatttcaatatcgtgtgagtgttggtagagccagactagagaagaaaaatgttggtaccaagtttgcggtcaaatctccaagagaaaaaagagacagccattttttcggcaagaatttttttcgttagcatttcaaatatcgtgtgagtgtttgttagagccagactagagaaggaaaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgtttgcatttcaaatatcgtgtgagtgtttagtagagccagactagagaaggcaaatgttggtaccaagtttgcggtcaaatccccaagagaaaaaagagatagccatttttgggcaagaattttttcgttagcattcaaatatcgtgtgagtgtttggtagagccagactagagaaggaaaatgttgtaccaagtttgcgtccaatcccccagagaaaaaagagatagccattttttggggaagaatttttt
